United States Patent 8,716,465 (KIT FOR MAKING INDUCED PLURIPOTENT STEM CELLS USING MODIFIED RNAS) - sequence listing, part 2

SEQ ID NO: 720 - DNA, 155952 bp, Homo sapiens
gatcagatgattatgatggaagcctctgctaaagaaccactgcttttctatcaggattcctaaacctggcttctcatcctaatcataatcatcttaaaaacaaacaacagtcaggcccagtggctcatgcctgtaacctctgcacccagggaagccaagggaggaggatcccttgaggccaggggttcaaaatcagtctgggaaaatagagagtactgagaccccatctctacaaacaaattaaaaattagctgtacatggtggtgtgtacctgtagtcccagctaccagggaggctgaggtgagaggatggcttgagcccaggagttcaaggctgcagtgagctatgatcacgccactgcactccagcctaagcgacatagcaagactctgtctcatagatagatagatagatagatagatagatagatagatagatagattgatagacagatggattttaaggaaattttgctgatttgccaggtttgggagccactgtgtcagaagtgttcaaaccacagtgactccatcataaatagggacttgataaaacaaagctgagacctatggggctacattcccaggaggttaggcgttcttagtcacaggatgagataggggtcggcacaagatacaagtcacaaggaccttgctgataaaacaggatacagtaaagacaccagccaaaacccaccaaatccaaaacagtgatgaaagtgacctctctggtcatccttactgctcattatatgctactcataattcattagcatgcgaaaagacactcccaccagtgccatgacaacttaaaaatgccaggcagtgtctgaactttagaccctatagggtctaaagtggagaggaaccctcagttctgggaactgcctgtacctttcttggaacactcatgagtaatccacccattgtttagcatataatgaagaaataactgtaagtatactcagtcgaacagcccattcttttattcctttgctttcttaataaacttgctttccctttacgggcttgccccaaattcgttcttgtgcaaggcccgtgaacactcccttggggttgggaccagaacctctttctggtaacaaatacagtagagccagaactccactaaatgaactttactggttatagtctctttaagaacaggaattgggctgggcgcggtggctcacgcctgtaatcccagcactttgggaggctgaggcgggaggatcatgaggtcaggagatcaagactatcctggccaacacggtgaaaccctgcctctactaaaaatacaaaaaattagccgggcgtggtggcgggcgcctgtagtcccagctactcaggaggctgaggcaggagaatggcatgaacccgggaggtggagcttgcagtgagcctagatcatgccactgcactccagcctgggccacagagcgagactccatttcaaaagaataggaattggctgagtgcagtggctcacgcctgtaatctcgccagcactttgggaggttgaggcaggtggatcatttgagcccaggagtttgagaccagcctgggcaacaaagtgggacccccatctctacaaaacaatacaaaaattagccaggcatggtggtgtgcacctgtagtcccagctactcgggaggctgaggtgggaggattgcttgagcctgggaggtggagactgcagtaagccatgatagcaccactgcactccagtctaggcaacaaagcgagaccctgtatcaaaaaaataaaaataaaaaataaggaacagggatcattcccatccccatccctatcttccaaaaattttggatggggaaatttccaaaacatcccaaatccaaacatttcaaaagacaaaaagcaagacaacctgaataacagcgcttctagggattgctcactgtagggcaggcaggcaaggacccactccctcttcatgactgcaacacctcaccatagctataaccagcctccaggaggacctgggcattctcagacattatgtaccagacgttttggaaatgttcaactgaatgagatttggaagtatacatatttttctatgatatatgcactcaagttaaaaatgtctttgtacaggagattcgaaaaatatgagcctctagtctagagacttaggaagagtgatggtgtaactgctgacctacaagcatcacacagaggcatcatcactttggcattggtttataaactcaccgacaagataatcttttcctcctccaaactcccatggcacctctagcataaagtgcactgcacttcaacactgttgttcatctgtcacatccattacactgtgagctccttgacatcagggtaggcaacctattcatcttttagaacccagcagagctggtaagaggctattctttttttttttttttttttttttgagatggagtcttgctttgttgcccaggctggagtgcagtggtgcaatctcggctcattgcaatctccacctcctgggttcaagcgattctcctgtctcagtctcccgagtagctgggattacaggtgcaagccactgagcctggctaatttttgtattttttttagtagagacagggtttcgccatgttggccaggctggtcttgaactcctgacctcaggtgatctgcccacctcgacctcccgaagtgctgggattacaggcgtgagccaccacacccggccagggctgttctttttttttaaggcaatggcactctttccatctcttcctcctgaccattccaccaaacatctcccacagatacaaaccatagagaatatcaggtattttcaactttgctaatcaactctttaaaatgatagtccattttagaacttgaacaaatatttactataccatttatcgaccccaagttgggctttcctcctcttaaagaagttcagtgaactacaagaatttgtggattaaaaaaaaaaaaatttaacccaaagactcctagtgacctttgctggagctaacacagcatctcttaatccagctctaaaggatgtgaagagctccaggcctgaggcaccatgctgtgcagcaatttacttcttcattgcaccaggctcatccctcattgcccacagcatccaggggtaaactcggaacaaaagattgcttacactttcataacttcaaaaattacatcacacatgcatgtccagtgttaaactacaactgattacatgtactgtctaacgaaattgttgaatacttgctctgcttttctccctgttggccttacaatccctgtttctaatttccttccatcctcgggtcataaaactttatacccagtggcctggcacaaaagtttcttttcttgtttccctaatatccttaaagcaggcattgcagtccactgtacttcttccttctatacaagctggaacaccctgagtcctaagctttactgtgcttaagaatgacccgtgggaggctgaggtgtgtggttcacgaggtcaggagttcaagaccagcctggccagtatggtgaaaccccatctctactaaaaatacaaaaacattagccaggcgtagtggcgggcgcctgcaaccccagctacttaggaggctgaggcagagaactgcctgaacctgggaggcggaggttgtagtgagccaagatcatgccactgcactccagcctgggcaacagagtaagactccatctcaaaaaaaaagaatgactcacaaagcgaattggagactccaatgcaggtgtaccacaaactacactttgatctatggtgtggcagatgtcacagccggatcacccgcacatccacaaactatacgttgagaccctccgcacacttagttgttatatacattattaataattcacaagtgaacacaactgtgaattattaaaaattcacaattcattcattcattcaggtcgaggtggtctctttcacttcttaaactcccatccttttcctacacccatgacttaatatctctgagaataagtgagtttctaaatgtctgagttaatagaaacattctttttacaagcaaaacagaccatttcctcagtaacccttcccagaaccacccatcttaccactcttaccactactgattaaaaaaaagaaaaacaggtagtgccgatcaaaccaggcaagctgaagcccatggctcctggacacaaatgatgacagctgtgactaaactcctaggcaaggctctttgatgtgtctatctggccaataggcctctacatcttgaaagcaaagtagcaacattgagaaaaaaaagggccaggctgtgaaatgcaagttcaaagcaagcagcaaagtattaatagttgagcttctttctgcaaataaaacacagagctctagaggcagcccctgcaaaatcaagagcagaactcctcaaggagtcctctcacaaacagagaagtactcagagaggacatcattttattcacctccaacagtcaattcttcaaatctgacttgatcattttatcttcaaaaaacagtcagcacggccgggcgcggtggctcacgcctgtaatcccagcactttgggaggccgaggcgggcggatcacgaggtcaggagatcgagaccatcccggctaaaacggtgaaaccccgtctctactaaaaatacaaaaaaattagccgggcgtagtggtgggcgcctgtagtcccagctacttgggaggctgaggcaggagaatggcgtgaacccgggaggcggagcttgcagtgagccgagatcccgccactgcactccagcctgggtgacagagtgagactccgtctaaaaaaaaaaaataaaaaaaataaataaataaataaataaaaaaacagtcagcacaatactaaaatccattccctgtcttattttcccattgcccctgcattcgttcaaggtgtcttcttttcttacctccatgactacaatatccatctaattgctacaacagctgattgccttccttgcccctccacttcactatccacaccagtccattctctcaactgcccccagagcttttttttctaaatctaaccttagaatctgatctcatcatgaccttgcttgaaacccttccaaggaggcctatccccagaaggatgaagtccaaactcagtagcaggaatggcctacaaggcctttcatgatttggctgcccgactacccttccaacttcattctctgccatttcttcaccacatctcatgttaaacccacactatttgcacatccctgaacagagggtgctcaggcttgtatttttgcatatttcacttctgctattggtatgcttttcctatatcctcctctataccaggttaacagaatttttttttttttttttttttgagacagattctcgctctgtcgcccaggctggagtgcagtggtgcgatctcggctcactgcaagctctgcctcccaggttcacgccattctcctgcctcagtctcccaagcccggctaattttttttgtatttttagtagagacggggtttcaccatgttagccaggatggtctcaatctcctggcctcgtgatcccccgcctcggcctcccaaaatgctgggattaaaggcatgagccaccatgccggccagtaacagaatatttttaaaagacaagtcaactcaaatctcaccttcgccgggcacgttggctcacacctgtaatcccagcactttgggaggccaaggtgagtgaattgcttgagtcaaggagttcgagaccagcctgggtaacatgacaaaactctgtctttacaaaaatataccaaaaattagccaggtgtgcatggtggtacacatctctagttccagccccaggaggctgaggtgggaggatcacctaaacccaggagtttgaggctacagtgagccatgattgcgccactacactccagcctaggtgacacagtgagaccctatctcaaaaagaaaaaaatatatataatccaccttatccattcaggcttctctgattccccaaggagtgccacctactctctcctttatgcttccattgtactttgtgtccatctcaacataacacttaccatgctctgctgccattatttgctacctgtttctctcctcaatcagattgagagcttcttgaaagcagagatcttgtctttgtatatctggtttctaagaatgcatactgagtaaatgaatagaagaaaaaatgaatgaggcaattagtatgtatgccttgaatggcattaaatttaggcctatgccaatcaatgtgtaaaggttgagaaaataaataaggggaagccaaggatagaaaataaaaccatgctcatcagaatagaagaggataggctgggcgcagtggctcacgcctgtaatcccaatcacttggggtcaatagtttgagatgagcctggccaacatagtgaaaccccatctctactaaaaacacaaaattagccaggcttggtggtgcgcacctgtaatcccagctactggggaggctgaggcaagagaatcacttgaacctaggaggcagaggttgcagtgagcctagatcgtgccactgcactccagcctgggctggacagagcaagactccatctctgaaaaataaaataaaataaaataaaacaaaaaaacagaatagaagaagatagctaagaaccacagtggtcaagccagcctggcttcaacagagatgaatggagagaccacggtcagccccattaacagaagaactggggccaggaacggtggctcatgcctataatcccagcactttgggaggccgaggcaggcagatcatgaggtcaggagttcgagaccagcctgaccaatatggtgaaaccccatctctactaaacatacaaaaattagccgggtgtggcagcacatgcctgtcatcccagctactcaggaggctgaggcaggagaaacgcttgaacccaggaggcagaggtagccatgagccgagatcacgccattgcactccagcctggcgacagagcgagactccatctcaaaaaaaagaagaactgagttcaaaatcagttcgaaaggttcaatgttgggtcacaggatcaggcaaaaagcagaggcagaaaggccttaggagtgttccaagaactagcactggaccagctgagagtcagagagagttcaccacgtgggaacaatgcagccagtcatgtgggatggtggcaccatgacagtatctagtcaggacaatgacagccctagggataatgctgatgagttcctgcttcaaaaaaggtcattgtcattcctttagtcctgatacctagaactatacaagattgttccctgcctctccccaagccccataacttgatcttaaaggcattattgtcaattaaagtagtcccaagttctagaagctatttttattcagcctcgtctaatagggctttcattttaaaatagctttattttgaatctatttactgttcccagcccctatcactttgttcttataaacatattcattccacatgcatcactgacaggcactgctaggaaaggaaactaacccatcttggccacctttacacatcaggtacttatactaaggtgatttctatatattacagtattgaatcaccacaacaatccagtgacgtaggtatcattacatattattatccccaattaagacattagggaaatgaaacgtaggaagattcagagaaagcacaggaaggtgaatatgcccaagatttcacattaagtaaatggaatgcaggattcaaatttacccctgtctgaatctaaatctcattctctttccatggcatcattctctctcctctctaggcctttatagaggaaatataggcccaaataaaatatcaaaatctcaggatgggatgacaggcttgattaagaaacccagtcaccaagaccacgcagtaagaaatgaaaaagaaaaaaaataataaaatgctgagaaccatagtctgcaaagtgaaaggaagaatacctgggagagctagagtgacctccacatgcaaatacaccctgcagacaggaacagtcttgatgggaagagcaaactccctaaatggtcggttgtaactttcctactagttgaaaagtcaggaaaagccttgtgtgctaactctctggacaagcgcacaagaatccagggttgtgacttcaaaaaaaaatatgctgacaagtcagagctggcagaacaagaggaggtcgagttgatgagaaaagagagagagagagagagagagagagagagagcgctgtaatcaaggagaaccaactgaagctggagggaagcagaaagaatagccaggctggttcaggaggcagttctggtacctctgaccccattgcccacccccagtaggcagcatgaaatatgccagaggtcaacaattttttttttttttgtattttttagacagagtctcactctgtcacccaggctggagtgcagtggtgcaatctcagctcactgcagcctctgcctcctgggttcaagcaattctcctgcctcagcctcccaagtagctgggaatacgtgcccaccaccaagcccagctaatttttgtattttcagtagagaaggggtttcgccatgtttggccaggctggcctcaaattcctgaactcaggtgatccaccggccaaggcctcccaatgtgctgggattacagttgtgagtcaccgcacccgacccagaggtcaacagcttctgccctagatcagaagtttactcactttgctcactcggtataaatcaaggaccctctcatacctgggaatgagttttgtattccagcctagaagtagagccagtcccagtttgaactttttgcctttctgtactcccagttcttacccttttgctgagcctaggacacatgcaaggcctgcccttcttaatccagatttttgagtcttaatcccaatttttcctatagtttcccatacactccatggcagcttagagtaggctgaaaactgctgaactgtttaagacttaatccttcagagtaacatggcagaagtagcacacttttttaacataaagctgttcaggactctattacagaagaggctatacttccttaattacattctattctacagccacctcaaaataactagtgaacacgttcaaccaggatcattggcaacagccaatgggcacagtgatctggaaatggtctagccaagctgtttgggctgtagaccatggcattcctaagagcaaaataggcaaggagtccattaatatttcacttgacttatgtcaccatggaaacccctggagtagtgaatggctttggggagtggtcagattcaaccaaaaataacagaaatctctgtcccccaggtaaaggattcctactttgtgtgtgtctgtgtgtgcacacaggcacactcgagagacttttggcattctttgaagtcactggaggggcacagagataaacccactcagccttggcctccaagactaacagaacacaacgtttccctgaaagaataaaaaaaaaaatacaggcataagaaaacacacaaacatgggcttagagatttaaatacacacacacacacacacacacacacacacacacaggccctagaaggaacatacaccctgagatacgcactcattctaaaataaactcgggaatacagaaggacacgggcatgtcctttcagagaggcacacttctaggccctaagtaggagaaggaagaggggagaggaagaggcagggagagggacagggaggggggaggagggagggagagagagagagaaacgaagaagggggcggaggaggagatggaggagacactctttattctataggaggagacatcacggaagagaaatcaacactgaggccttggccgggcgcggtggctcacgcctgtaatcccagcactttgggaggccgaggcgggtgcatcacctgaggtcaggagtttccagaccagcctggccaacatggcgaaacccggcctctactaaaaaatacaaaaattagccgggcatggtggcgcggacctgtaatcccagctactcgggaggctgaggcaggagaatctcttgaacccggagacggaggttgcagtgagccgagatcgcgccattgcactccagcctgggcaacagggcgagactccgtctcagaaacaacaacaacaacaacaacaacaacaacatcaacaacaacaacaacaacaacgaacaaaccaaaaaccaatgaggcctgaagataaagacacatgtacaaccacggatgtcagacttccagaggcacggccaaggcaaaagacaaacacatacagactgcagcaggcagacaggccggttccagagtcaggctccggtgaagctccgaagaaacaaacacgcagggagatttcggaggcgtccgaggacaccgtggggcccggctggctccctctgtctctgtgcgcgccccttccccgggtcaccccgcctgcgcccgacctgcgcccgcgcaccgcgccctcggggctccctgggacagcccgcggcctggcccgtgcgcccgggctcccctccccgccggcccggcacttcccagctctgacgcgggagcttctttcacaccaatggggctcgcgcgcggaggggccctgcccctcctccgggaaggtgtgtccctgtttcctcacctgaaacttcctaggagaacccgatccctccctcccgtcgggcggccaggggcgggccgcgggtggggcggccgggcctgcgctggggacggctctggggactgcggccggcgccgggacctggaggggacgctggggccgaagcagcatgtgacaccgaccaggtgggtgccctcctcccgtctcggccctgggctcccggcggctgtggagcccggcggaggtggggcagggacaggaaggaagaggaagccaggcctttcccagggatcagcccccgctgggtccggggcgcaggctccggaaatgggggggctgggcccgcaggcagggctcggggtgtgtggctgaggaccctggtggggaagaggagaggaactagaggaaatgttgttgcctacaagtttgcttccggtcgggtcccgcctaggaaatgggcaccctgcccccagacgttccccgggccaataatcagggctctttcttcaaagtaggcgccctggggaaagctaagccatatcagaaggaataactgagattccctttctaggctgttccttacctggagaggttttatcggctccttttccttaaccaggccggggcctttccttatgtatctccataggtatttgcatactgtgtgagtctatgtgtagcttctctccgtgttaaccaaagctccgtaacctggaacagtgaatcctgccctgcccctcaccccagttccctacatatggggagcctcctaaagcttgatgtgaatcacaacgttgcattcttagcaaggtggaaagaagttatttagagttgggggctgaggtaggcgttggggtgctagaatgcggacgcagagctctagaacccctgagcatcttttgcagttgccttccggcaagactaccggaggagagccagttgtgatactacgtcatttccagatctcagtccctttcttcccttcctggatcttgggttccaaagacagatttgccctcctgtctacctagaagtgaactctggccaggactcttgtctggttgagagagaagggtgtgtcaaacagatgagagagggtggttttcctttcgagcttcctccctagcttgctcccctactgcactccactgtctggccttgcatcttgggcctaatccagaggtcccagctccagctaaaaagctcttgatgtggcctctgtctcagacgtcttgttttatccacatttggagcatgaagaagttcctggcataggccttagcaaaatgggtgtcatttgttaaccaatctgtgggcctaaaagtgaagccatggctagtgaaggagtcctggggagctgggaagatgggatgagggcgtgtcagttctgggtgagactgatatgcaggaggaatgtatgtcatggtcctagtggggaggagagagaaatcaggaggagtgcaaaggaatccctctcatcaacagaatatagtgattctcaatagagagaagagtgttcatatattagaggtcctgagagtgtatcagtgcccttaacgcggtctgtctgaggttccgtggccacgttacacgtggtgtctgtgggatagacaggaatacgtcatttgtggtgtctggagaggtcagtcgctatgtggtatggacaggaatggagtcactcgtagggtcttgggttcaacgggagcagcattactcaagtgtcagtggtgtagacaaacaggtgaccaacagctctagtgtagacaggggctgggtcactcacagtgtctgtggagtaagcaggagccgatcacttatagtgcctgcaaggtagactggaacaaagtcaccctcaaggtctgtgttaatacacaaacacgtcactcacactaatgttatctgtgtgtatgccaccaggaccacagatgagattgtagagtgtaagtcagcattgacactaataatgttcttatataaactatctggtctataaggcagttggtgtgacattttcagacattagagaatagataaatgtgtattacagctttcactggcatggtgggactttcctgcaatggatagaacacacactgtagtagtcagtggtccagaaagctacccctgttttgatatctttgtagtattgagggcagtgatgtcaaacagtgaataaagttatatatctatgtggtgatcttattttaacctcaatattattttagtgatttgtaagtcagaatatttgaaatcaaccttgctagaaaatccaggaagcatggtcctcaaaaatatatatatggcactgagtctcagttcaaagatttggcagtttgattggggaggggttgtatccttgaaatacagtgttgtttctagtgactagaaatagacaagagctaaggtgttggggggggctctagggaagatagtgagctctgtcacacattatgttaaagggatgacttgaagctttgcctctcaagaagtcacacgtgggtgaggttatgtggatgcagaatgtctgtggtctgaagcaaggccgtatccccataatcccatgccctggctttgcctgtacacagataaacagtgattattcaccctcagtggagaaggagatgaggatgtttgcactctaacgtaatgagcattgcaaaaaactctctcctgatgcctttacgtgagtaagaccatgatttacagatttcctttcactttgtcacattttagctttgtcatgcctgattgcaacgggatcactgagataggatcaagtatagggaacgtggggtatgttctccctttgcggtaactggtggctgagcaggtgaccactgatatttccaaatgaaaaaagacagttagaaacggtgtcaatgggcttgcagaggcaggcatgcactgtgccactagattggaacagaaaatgtccaggtagcacatggtatttatagatataccctagatatggcagaaacacacttttatttagaggctacttgttttgaagacgtgatggtgtatatggaggagagggcctgaaccatgcagatgtaagtgaggagagactacaggtttagtcccatggtctccttaggccaagtttcagaaagtgtcttaaagtaagcaagtatattattcgatgtgtggttgagagaacagggccacatcacagaatcacccatagggattatagtattttgtacttaagggctagacatagggagccaatcgcatatggtgtcagttaactggaaaaggacataaaagtccttctgcctgtgtacaattatgtcagacatatctctttgccccatatagatggtatctctgtctctgggatggccagaatcttgtcacatactactctgcagtgtgctagggacctgcctgtttggttatgtcaggctctattgcaagagtttgtaaggatggctcagtgtgtgtgtgtgtgtgtgtgtgtgtgtgtgtgtgtgtgtgtgtacacacacagtggctaagcaggacagtattctgagcaggtgagttttcagtttaagcctggaccagacaagaaaggtgcacggtcaggtgcagcattgggtccatagaattctggggtcttctctggactgatggcctgccagctttctttcagtaggacctctaagtgcttacaggagacttaagtcaagcgactttgcttcaggtttgcccataccatttgcttaggagatttgagcaagggtctagggtctttgacctttagtttcttcatctgtaaattgagcagtttctgtgtgtctctgaaggtccttccggctttatgaatcctgtgtttctctcttacacttattctctgtctctcaggtcaacagtatttaccacagccaccatttctatgacccttaaagatagcagtgtacatttttatgttaccttatttaatctttactagaactgtgaaggaatccttttatctcctttttaaagataagaaaatggatgttcaaataaatttaatggtttctacaattgtcttaaaaccagcaaagataccagagaggcacaaccaaacactgatccacactcttctaactctatattcttccgtcattcattcatacgatacatctttgttgagggccaactaggcttcaggcagagggggttatatggcagtgtttgtcccttcatggtgctcataatctagcctggaaaatagacattaaatatgacatgacaagtgcaaggtgtgtttgaggagaagcaaaggattctctgttgcaaaagaggattccaggcagaggagcagtgtctacaaaggcctacaggtgagagacacagagagaagtgagctaaagacactgaaagccagtgggagaggggggggatgggggcagggacagatggtgacaggtgaataggctgctagagaagaaggcagagccaggttgtgcagggagtataacccatgctgaagatttagatttcatctcaagagcattcagaggctgctgaagaatctaagctagaactggtgcttttgaagctcacttaggtgctgtatggagaaaggactggaatagcgtgaaatgggtggaggccagtgcccaagctgtggccgggtgcagtggcccgggcgagacggtagcagcatgcaccagtggagagggatgggatagaagtggacagtcttaagggatatttagcagacgaggtcaatagcacatggtgattgattagatatggggaatctgggccaggagggaaacaagaattttattttattttaattaattaatttatttatttagagacagagtctcactctgtcacctaggctggagagcagtgatgtgatcttggctcactgcagcctctgcctcctgggctcaagggatcctcccaggatccctctcctgcctcagcctcccgagtagctggaactacaggcacgtgccaccatgctccactaatttttgtattttttgtggagacagggtttcaccaggttgtccaggctggtctcaaactcctagattcaagcaatcaacctgcctcagcctcccagagtgtcaggattatatacataaagtgcattgggaaactcagtttttcatctgtaaaatgggcagaataatggtacccatcttatacgatgactcttagatgtatggcacatacatatttaaagaagcatttcattatttttaatgacatgtatgcaggaaaaccttagtgtttcagaatgaaaaataagaaaaattaatttgttgtgtatagagctctaaatgtttaaagttctgtgtaaactgttaatcatgattttaggaaaaggtgggcatattccattgaagtaaaaggatcacattttattctgacctgaattttattctttatgtgaaaaatatttattaaacactgagtataggccactattaggctaagtatggataattcagcaagtcatagttcttaatctcataaattttactatctattggttgcaatagagggtaactcaaaatacacacatcattatataattataattgtataaatgctacaaaggaaaagtaaagagaattatagttggtaagtgctacaaagaggggtacaatttaacctagttaaaagatcaggggaggccaggtgtggtggcttacgcctataatcacaacacttcgggaggccgaggcgggtggataacgaggtcaggagattgagaccatcctggccagaatggtgaaaccccgtctctactaaaagtacaaaaattagctgggtgtggtggcacacacctatagtcccagctactcgggaggctgaggcaggagaatggcttgaacccggagatggaggttgcaatgacccaagattgcaccacggcactccagcctgggtgacagagcaagactccatctcaaaaaaaaaaaaaaagaaaagaaaaaaaaaaaaagactggaggaaactgaaggggtaaaaccaggaaaatgtaataccacaagtaacaagagagtatttctaacctcagtactgtcaaatactgacaagaaccacccaaaatgaagatccataaggtcttctttggaattaacaacatgtcgattgtagggaatattggcagaatgccgctatcaaagctcagttggaggcaggtgggatgtgagagtatgaagacagcagataagagcaactccttctagtcatttgaaagatgagaagaatgtgggaatgcttccataccccaggggttgttcagcagggatgttgaaggtatgagtgcacagtgttcctggggaagcaggcaagaaatgacagagcatggaaaggagggatacgtcttttcctgactgagggcggaagatagaaagagtggaaatacaggttgctttggatcgcaagaaattgaggtgagagaaacccagttccatcagtttctattttctttgcaaaataggagatgaggtgttctgctggaagtgagaagaaaggcaggaaggtcgaaatcaaaagacaggaaggtcaaaagaattaatgagaagagttcatatggatactgaggccaaggggagagtaaggtgatgcagaaagcacccttctgtggtcttccttcaaggtggtaatgtgtctagttcaacactaatccaataaggctgttatcatcccactttacaacagctgcctctagaattggaaacaaaactgttagttacaatgctgtagtagacactatggaaaacagaaagatgagtaaactccaaaccctctgtaaagaagatgaaaccatagcacctcacacattggctatcatagcctggcctattttaactgatgtccacagcttaagaggaagaccctctcctgacactgcttctctggcctaatagatctgaggtgtgtcccttgctgtgtctgggggttatatgaggatgagtcactcctagtgtccgaagagtagacagggagagacagaagatgacataatggagtctagagagaactgacaactgggagcttctgggcactctctgacaatggtcctctgctataatttaattgttcattatgacctgtttccctcacaagaccacagtctccatgacgacaagatctttatctcattcactactgaatgccccacacttaacagggtcgctaggaaaatatttatgaaataaatacatcaatgacaagttttttagaggctattgcttattttgttgagaacctgttgtctcaaagaatgaccctaaatggaaccaaataaatgcatcactcttcttttttatggtctcttcctctgataggtaaaagcagagttgttagaaacatttgtctttgattcctccttaggattcagccctgatggaggctgaggaggcccagcgtggagcctctcctcccatctctgccatagaggaattcagcattatccctgaggctcccatgaggagcagccaggtctctgccttggggcttgaagctcaagaagatgaggacccatcctataagtggagagaggaacacagactctcagcaactcagcagagtgagttaagggatgtgtgtgactatgcgattgagacgatgccctcttttcccaaggaaggttctgcagatgtggagcccaatcaggaaagccttgtggctgaggcctgtgacactccggaacactgggaggcagtaccccagagcctagcaggccgacaagcaaggactctagctcccccagagctctgggcctgccccattcagagtgagcatctagacatggccccattttccagtgacctgggaagcgaagaagaggaggtggaattttggccaggacttacttctttgacattgggatctggacaggcagaagaagaagaggaaacctcttcagataactctggtcagaccagatattattctccctgcgaagagcatcctgcagagaccaaccagaatgaaggctctgaaagtgggactatcaggcagggggaagagctgccacctgaggagctgcaggaaagtcaagggctcttgcatccccaggaggtccaagttctggaggagcagggacagcaggaagcaggatttcggggggaaggaactctgagggaggatgtttgtgccgatgggctattaggggaggaacagatgatagagcaggttaatgatgaaaagggagaacagaagcaaaaacaggaacaggtacaagatgtgatgcttgggagacaaggagaaagaatggggctcactggggagccagagggtctgaatgacggtgagtgggagcaggaggatatggagaggaaggctcagggtcagggaggtccagaacagggagaagagaggaagagggagctgcaggtgccagaagagaatagggcggactctcaggacgaaaagagtcaaacctttttgggaaaatcagaggaagtaactggaaagcaagaagatcatggtataaaggagaaaggggtgccagtcagcgggcaggaggcgaaagagccagagagttgggatgggggcaggctgggggcagtgggaagagcgaggagcagggaagaggagaatgagcatcatgggccttcaatgcccgctctgatagcccctgaggactctcctcactgtgacctgtttccaggtgcctcatatctcatgactcagattcccgggactcagacagagtccagggctgaggaactgtcccccgcagctctgtctccctcgctagagcccatcaggtgctctcaccagcccatttctctactgggctcctttttgactgaggagtcacctgacaaggaaatagatcaaaacagccagcaagaggaatccaggctgaggaagggaacagtgtccagccaagggactgaggtggtctttgccagtgcatctgtgactcctccaaggacaccagattcagctcctcccagtcctgctgaagcctaccccatcacacctgcctcggtatctgccaggcccccagttgcctttcccaggagggaaacctcttgtgctgcacgtgctccagaaactgccagtgcccctctctcaatggatgacccatctccctgtgggacttctgagatgtgcccggctgccctctatggcttcccctccaccgggaccagccctccgaggcccccagccaactccacaggcaccgtccagcacttacggagtgactccttccctggttctcacaggacagagcagactccagacctggtgggaatgttgctttcctactcccactcagagctgccccagaggccccccaaacctgccatctacagctctgtgaccccaagaagggacagaaggagtggtagggactacagcaccgtttcagcatcccctactgccttatccacgctgaagcaggactctcaagaatccatctcaaatctagagagacccagcagtcctcccagcatccagccctgggtctccccacataatccagcctttgccacagagtctcccgcctacggttcttccccatcctttgtctccatggaggatgtgaggatccacgaacctctgccccctcctcccccacagaggagggacacccatccctccgtggtggagacagatggccatgctcgtgtagtggttcccacgctgaagcagcatagccaccctcctccattggccctaggttcagggctgcatgccccccataaaggcccacttccccaagcctctgaccccgctgtggccaggcagcaccgacctctgccatctaccccagacagctcccaccatgctcaggccacccccaggtggagatacaacaagccgctaccccctacccctgatttgccgcagccccaccttcctcccatttctgctcctggtagctcaaggatctacaggcctctacccccactacccatcatagaccctcccaccgaaccacccccattgcccccaaagtccagggggaggagcaggagcactcggggaggacatatgaactcagggggtcatgccaaaacaagacctgcttgtcaagactggacagtccccctccctgcctctgctggacgcacctcctggcccccggccacagctagatcaacagagtctttcacttccaccagcaggagtaagagcgaagtgtcccctggcatggctttcagcaacatgacaaacttcctatgcccctcttcccctaccactccctggactccggagctccagggacccacctctaaggatgaagcaggggtctcagaacaccctgaggcccctgcgagagaacctttgagaaggacaacccctcagcaaggagccagtggcccagggaggtcacctgtgggccaagcaaggcagccagaaaaacccagccatctgcacctggagaaggcgtccagctggccccacaggcgggactcagggaggccaccaggggacagcagtggacaggctgtggctcctagtgagggggccaacaagcacaagggctggagccggcagggcctgcgcagaccttccatcttgcctgagggctcttcaggtgagcaagaaccgggaccacagtgacacatcagaccaagcttttcccagctcttcccacctcatcccatcttctgtccctagggttcctaacattctctctgctggcttcgctcacatgtgtgcctaacctcaacacagagagagccccgaagtgccctccaagctccttgggatgctcttccttcttcttcccctctatctccctgtctctccctcaaccagcaccttctttggatgtcccaaggttattttggactcccttctactcttcagttacagtccctgcttgctctcctcctggggagtagaaaaggccttctgtacttgtcccagtcccatcctgacccgtggctcgggacgtcactggtactgatctctttcacgctctctgctttgccactttcttccctcccagtttcccaataaagcccattttcccttctggacccctgcatctcctgctctagatcttctttggctctctctatccctctgaaatctcagttatcttccccatttccacttttagattcaagaggtccagccgtggagaaacatccgggaccctcagacactgttgtttttcggtaagtcaccctctcccctaacagccacactgtactctcttcacttgggatactgagagtcccctagtgaggatttcagttgataagggttctgagaccccgaatggctcattcctgtttcttcttggtgtaaggaggagaagagagagatgccgggatgccagcttagggagattgtctttatctacctcattcggtcagccgagcctacgagtcatccatcttcccaagccctatggctgtgaactaaaccccacaaaagctccatgttagcccaagtgggtcaagttgcaactctgtgcctctccgggggatttggtcttgacatcccagcacacatcccagaggctagagactttgtcccccacagtcacctggggtgctctgtgtctaatggccagtaggtaccccagagcccttctttactccacagggagaaaaaaccaaaggaggtgatgggaggcttttcaagacgctgctccaaactcatcaactcctgtgagtaccttgaagtggaactatagaaccaggtgggcattctgcccagcactggagaggggcttgtggatgtcagcagtggggtggggatgtccctagcgagaaggcattgcagaagatctgtttccctgcctccgctcaccgtcccttcttcctgcttctcttccttcccatgcttctttgccctgcagcccagctgctttaccaggagtatagtgatgttgtcctgaataaggagatccagagccagcagcggctggagagcctgtccgagacacccgggcctagctctccgcggcagcctcggaaggccctggtctcctccgagtcgtacctgcagcggctctccatggcctccagcggctccctctggcaggaaatccccgtggtgcgcaacagcaccgtgctgctctccatgacccatgaagaccaaaagctgcaagaggtactgggcaggccacggtggggagggggctacagaaaagatgacaaggtcttgtttgctagcatccttctctcctgctcaccactgccaccaagagtcggctgtccccaccacacaggcgcgtgtacatgccacagctgtgggtcatgtccattctgaagaagttgaattgttttctggatttcaccacctcccctttcatcctcacctcctcatgccataggccacttgctcctacctgatgttggtctgggctatacatggtggccattgcctctgaatttgtgtggaggaatgtggagttaatcccatcatcactgctgtttcagggtagaggaaagcttccctgttcaaccagggtttcaggctacactacagttttcctctttagccaaggcacattccggggctctttgttgggtcccttgaagagggccctttgcagctgtcctgtggtccatcaatctaacaggggccttagagtgatcatcagtccctgcttgattgttactcccaacagcaagactgaactagaggctgtttgtctgattctaagctattaccattagtaagttttacatggagagcgcctcttattaatttgtctgaaatatggggtaaaacctttcttcccagaaagacagtatggaacaatggaatagaataatgtttaagaaattaggttctggaagaaatgacctggatatgaaaaccacttttttttaaaattattaatttattagagacagggtcttgctctgtcactcaggctggagtacagtggtacaatcattgttcactgcagcctcaacctcctgggctcgagcaatcctcccgcctcagcctcccaagtagctaggactacaggtatgtgccactatgcctagctaattttttaattttttgaaaagatggtgtctcactatgttgcccagttgtctcgagctcctgggctgaagcaatactcccgcctcggcctcccaaagtgctggaattacaggcatgagccactgagcccagccccagagcccactttaatatttccaatttacctttggccaaatgacatttgtaaaactgagatacaaacagttactgcaaggatcaagaaacatgaatgcctggtacatagtaatttctcaaaaaatgttgacttttcattttaagtaagccagacctaggtttgaaacatgacttcaccatttgctagcttaggcagccttataacatcactaaatctcagtttcctcacttgcaaattgaggataataatgcctacctttcagggttgctgaatggtttaaatgaaataatgcatatctaatttagcagtaatatttgatgtatagtttgataaatattagtgccgtactctctgcctttcagaggcagggaggagtaaaatttgggccaggaggacttatggacagacaatgcttttaccaagtcagagagagaatacatttttagactttgcaaagttcagacttgagagccctgttgtggctgcaaatttttaagcacagagaagatatttagaaaataactcatcttccccatatttgttgaccaaacagtgggagatgacacgagttctagctctcttttaccaactccagcatgctgggaagtccagcaggactcctattccagccctggtctcatgtttgtgagaagaaagggctttacatttctatctcttaaacacacatattcattttataaagtagtacctctggggttcacaaagtgctttcacaggctccatttctttcaactgttgcatcttccacagtgagatgggggtcactatatccacataaaaggacacgaaaagtgagattcagagaggttaaatgagccacccaaagtcagtcgtgtagtgaatgttagagcaaggatgcaaatgagccttcagtgtccctgttcagggttgttgtatgggagggtcatctggctgtgtcattggtcatccaagtcatcaccagggtgtgtctcctttctcttttctatccaggcatctctcttgaggccacatgcttggatgaaaagcatgaggagcccagctagaggcacggtcatgagtcatagcgccccctgctggaacctccagacaagttctcacatgctgggcatgcattaaaccacagctgcgccatcttgttctcagatatcctgcttctgtctcctgcttctcgcgccatcttgttctcagatatccggcttctgtctcctgcttctcatctgtcctcaaacctcaaactgagctcatcaccttcatcccctaaatctatgccttttcaaagttctctggctcagtaaatgactccatcattcacccaggtgcccgactcaaaaagcttttgctgtgagtacaaaacattagctttgaaccttccttctctttgaggccccatttctagcaaataatccaacccttccaattctacctcataaataattataaaattaatctacttctcttcagctccatggctattcagaccttcatctctcatgtggaattattacaacagtttcttaacatggatggcttttgcttcttttcatcttttcttctcattctgcttagaaataactttatgaaaaacaggctgggcgcagcggctcacacctgtaatcccagcactttgggaagccgaggcgggtggatcaactgaggtcaggagcttgagaacagcctggccagtatggtgaaaccctgtctctactaaaaatacaaaaattagctgggcgtggtggtgcatgcctgtcatcccagctactcaggaggctgaggcaggaaaatggcttgaacctgggatgcggaggttgcagtgggctgagatcgtgccactgcactccagcctgggtgacagagcaagactccatctcaattccaaaaaataaaaaaaaataactttatataaaacaaatgtggtcaagttattctcctatgtaaagcctgttttcattgtcccattgtcttaagtccaaacaattttacattgtttacattacccttcaggcctcctcgactgctgcagcttcatctctggccactactgctgtacacttggttcaaaaaatgctcaatttatttagtttagttagtttgtttgtttgttttgagatggggtttcactctgtcaccaggctgaagtgcagtggtgcaatctgggatcactgcaacctcacctcccaggcacaagcaatccttccgcctcagcctctcaaatagctgggactacatgtgcacgccatcacatccggctaatttttgtattttttgtagagacagggtctctctacgtcgcccagcctggtcctgaactcccagactcaagtgatgcacccacctcagcctcccaaagtgttgggattacaggcgtgagccactgcacccagtctatttagcttttttaatataaatttcattgtgtatattaaagatatacaacatgatgttatgggctacatataaatagtaacagaattaccctagtgaagcaaattaacatatccatctcactttgttactcattttttgttcttgtttttgttatttagatttcttgaaagcatatttttcttttatacctttgaaggcctgtacctgtaccctagattaaatcctactcaaatgctcttcccctccccgcagatcaacttaggttctggtgtgactgtgaaccataaaaggatcttgctcactgctctatccccaaaacattacacagtggctggcatattccagggggtaaataaaatccttaattaatcttcctcatctccaacctcctaggtcaaatttgagctgattgtgtcagaggcctcctacctgcgcagtctaaacatagctgtggatcatttccaactttcaacttcactccgggccacactttccaaccaggagcaccaatggctcttctctcgtttacaggatgtgcgagacgtcagcgccacgtgagactccccttctcctaaataccactcactcagcctcactgttgttaggctttaaatgttccgttatttttttcccctcttagaaaccctttcattttcacagttatgggaagaaattgggcctcagtttcttccatgattcccgatggttataggaagaagaatggcaagaagaggagagggtctgtgggtggatagatccattaatggataagtaaatgagcaatgcttcctgggttgaggttttggattactgtggtcatgcactgcattggagatgaggtggaaaaaccatctaaagatcagaaaacctgaacagggtcaaaagaagaatgagaaatggaatattagaataaaagtgttaaatcaggctcaaactcaggacagttttggagcgaattctagtgcatagcaaggagcacagagcagagagtcaatagaagttattggctaatggagtgaagaagtcaccagctcagtgtacaccaggggccagtcagctgtttagctgaggtccagaagtctcatgagactcgtttaaatcctgtacaggttcctttcagacctggaagagaactttgagaacaatatcttctccttccaagtatgtgacgtagtcctgaaccacgccccagacttccgccgggtctacctgccttatgtcaccaaccagacctatcaggaacgcaccttccagagcctgatgtgagactcatcccccatttaatccccatgtaggccctgaggtgaccatgcaccagtccccagcccagagggctatcccaagagcacactttccccattccgccctctgtattggttaccccagcatcacatctgagcgccctgtacatcagctcccaccgctctttcccagcccacagatactccactgacctcccttccccgcaccttcactgcatcccccattgctccccatatcccccctcccctaaggctcactctccgtgcaggaatagcaacagcaatttccgggaggtcttggagaagctggagagcgaccccgtctgccagcgcctttccctcaagtcctttctgattctgcccttccaacgcatcacccgcctcaaactgctgctccaggtagggcagatgctaccttgatcctctccccttaactcaaagggatgccctcaggaagacccacaacaaaggaccaaccattcttctgccaggtgtccacatcctgtctccctgctgcccactgcctgcttgcttggaaatatttgctgctaaaatgtggtccctgggcttctccattcaccagcccccaatcatttcttcctgtttcccatttcttcctcccatctcactcctgcctactgtctgttcaatagaacattctgaagagaacacagcctggctcctcggaggaggcagaggccacgaaggcacaccacgccctggagcaggtaggcagccaccacctccactctgaccctctgtgtgttcttctcagagaggtctttcccacctaggcccatgactccagggagcatgggaggtgggaccctgttgggagagctcagccacctccctgcatccgccaaacttccaaacatacacaccccacggccacctctcccacgccgagcacactccacatcaagggactgtgccctctccaccatcacccccccattcagtctcacttttactcagttcaggaatgttctgccaagtcatacaaagttgcctaggacttgtgcttgatactgcctgcccaattccagcctgggaaaaatgactgaggctgtcataacctatttccagattgcttgcaagggactcaaaggtcaaagcctctaacacagtgcccttcccctttcctcactctctgcacccctagctgatccgggactgcaataacaatgtccagagtatgcgacggacagaggaactaatctacctgagccagaagattgagtttgagtgcaaagtgagtcggtcccatgcaccccatccctgcccatgaactcccttaacatgtcctgcagatcaccccctaacctggaaccaccttgctcacattatccccagcccctcccctcatttctgcccaccttctattctgtcctatttctgggaggcctacttgggtctccaagacatactgctaagtgaaatgatgaaggtaaagaattgtgtgtatattatatcacctttggtataaaagtgggaggatacaaatctatacaggtgtctgcttgtgtgtgcataaggaaactctggaaggagaacaagaaaaaaaggaacagtggttacctgaggacaaggggggtgcatttgagaaatgggcaaatgagagagaacttttcaggatgagcctttataaaagaatgttttggtgcttgattcatttattactttatcaaatctctttctagtctaatcaaacccacataagattggatccaaatttagagccagcatccctcattgaaatacaaatctaaaatagacattccacattcaaattccaacttagaacagatactatcttttttttttttttgacagagtctcactctgtcgccccaggctagagtgcagtggtgcgatcttggctcactgcaacctccacctcccaggttcaagcgattctcatgccttggcctcccgagtagctgggattccaggtctgcaccaccatgtctggctaattttagtatttttagtagagatggggtttcaccatgttggccaagctgatctccaactcgtagcctcaagtgatccacccacctctgccttccaaagtgctgggattataggcgtgagccaccacgctcgtgcttagaacacatactatctttacactcctgaaaaagaaggaaaatcccttattcacatactaagcatagaccacaccctcatctttaaccaaattccagctccaagacgccccacctagttcttctcacccccatgtttgattccagctgctcacatatctctggtataaaaaatggaattgataccagacctgcctctaatattttattttaacctctaagacacatatagtgttcactgacttgttccatcacataccctgattggactcttccatccctccttcagttcaggcttctagggcagagctgtcccacacactcactatcctgagttggaccataggcatcttctatttacctgagcatacaaccatgggagccacacaccagtggacagtggtagttagagggttcagagagaaagagaatctaagtgatgggttatgagccagaaggcagatgtggaagagatgcttgttcaagtggaacttgcatggaagtggcatggggaggagggtgggactgggagcaaacctcatgcttctcccatctgtgacactgccttctctctcttcctctgccctgtagatattcccgctcatttctcagtcacgctggctggtgaaaagtggggagctgacagccttggagttcagtgcttccccagggctacgaaggaagctgaacacgcgtccagtccacctgcacctcttcaatgactgtctgctgctgtctcggccccgagagtcagtgactggagtggcaggccagggcacaagaggggaaggggatgaggaaagaggggggtctgaaagggagagagaagggtcatgttcctagaagagcccttctcaatggcttaacccatagagcccaggtcatagcctagagaagagaaaaacaagcccaaagcaaaaaggggatcccatcaaactgtatcatgagaccacatagcaggacatgtaatatggtatagacacagagcaaaatgtagcaaattagcttatcacattctcacatgagtctatttgtggcttctttggactggcctcaacctgctattctagagatacttagctaattccagagcttaagtctctggtcttaaggttcttgggaaatgtatataaattccatctcttcacctctttaaagtggtaatgtatccactgcactaggtgtgtggtttgccagactaggacaaatccctgaggaccctggagctaccatcttgggagcaagttaggaccatcttatggtttttgtgggaatttgcaggctgtagatgtagggatttcgaacccaaggttatgagggtaggtgaagtatggaaactctagaatcaggttgaaaagatttgtattttgcaggggtagccgattcctggtatttgaccatgctcccttctcctccattcggggggaaaagtgtgaaatgaagctacatggacctcacaaaaacctgttccgactctttctgcggcagaacactcagggcgcccaggccgagttcctcttccgcacggagactcagtgagatggggctgggcagaggagctgggggtgggggaagatgggcagccgagaaaagaagtgagaccaaggcagaaaatgtgtccagaagacagccacagcctcatttagcccattctggactggggaccaccatagagaaattcagactcctaaaactaatggataacttgcaggagattggggtgggagagggtacaaagtcaccaccgaggcttagcatctattttatactctttactcaagagggacaaggtctgtgtagtatcagaaaggagaaggactggtatggagtgagcaaggaattggaatactggtatctgtgagcacatgcctccatgcctgaggcagaaacccttctatgccccagctggtgggcacagatgtgaataagacaagtgctgggtgacttttactttctgtgctcccatcttccaaaccagtcctctattgaccagaaatccatagtgttgagaatgctgatttgctcatgttttcaataataataaaataaaatacattcacacagacatacatttttgagagtattaatagtacctataaaatctggaacacagtgcctgcaataatgaacatgtaaaagcctgtagctgttattgctattataaaagatatatgaacagtcatttaaaagtttgacgtatctaagtgtttgaggatccctatgttgtagacactttttcagttttgtcccttggaagatacttcagagtgggaccgataacacctgttctcatttattgaacagaaggactagtatcggagtttgtgtgcaaaacagcacataagtcaaataatcaggtgcagatgcatgttgttggtttggtgctttgggcactgtgcctggaacagtaatagtccattcccagttacctaggcacaactgggcacagaggctaacagaatgcagaaaccttcagatgattacaaacctaagcttggattacaccgtgcaacaacaacaaataaaacagtagacatatctccctgatctaattattattatgaaacaatgatcatctctgagatagttagttgaagggagataggcaagcgagtgtcaagaatcatgccaaatgatggagggaatctaaactgaaatgaacacttcgcttagcacaatttccaaaacagaaaatctccagactttatgactaatgaacattacgccccaacttggaagatatgagaagccattaggaggataattctggaaagagaagaggaaaagtaaagtgtgacaagacacattcacatatagttcaagattgtgtcatgtttccaaccaaaaagagtcctatatagtgtttgatagaagtcatggaactagataagtccttcccacagtcttttgccatccccatccttggccctcctcctacacccccacaattgatgctatgaccctgctttgttttctcagaagtgaaaagcttcggtggatctcagccttggccatgccaagagaggagttggaccttctggagtgttacagtgagtgagggtctaagagggagagaaaagaaagcagggtcagatgtcacctttggatacaggagtttaaagggctgggtgggaactctaggctttcatttattgatattccgtaaaatgtcagggtggaagattggcctctagagcttaaaaacctgaaatatatcgcctaaaactgctcatcactatggcagtcccccttccccatacattcccttccttgggcaatagtttgctctttttaaaaatatttgtccccttaagtctaagctgacattattttgcctagattttacctgcttgaaggtcttgttggggtaggggaagaaagcctgacggtggtagaaggtgtgcaggaggatagcaccccagatctatcttgaccacacctaagaggatgacctgaggtcacctaccccaggcttctgggtgcccatggggagccacaggcacacacacattatgtatgtgtctgtgttcacaccaagactggacttcttatgcctctcatgtcagccccacagttgtcctccagcaaagattccctaatttaaatccagagagaatctgacctcaaccctggacctttagtgactgaaaagaacaaacaactacaaggaaccctgggaatgaagtaggagagccgtgtagtaactgaacgctgttaacttgctcactgtgcactccatctgctggcttcagttccccagtgggtgaggagggcaggagcattcttcctccttcattttgaccttgtgaatggcagatggggaggatcttgagaaagcaaatagtaatgcagtattccatttattttacaagagaatcaaggcagtgtagtaacaaaaaagagccataaacccacatatgatggaatactgataggtgaagcattctctgaggcttgttttcttgagcttcagatctatggacatgtctcctggttctcaaaaacatagaaatagagaaatcttgaatgtcctcaagattcatctgatcaaccttgatcaataaccatcttgatcactgatagatgagtaaactgaagctccagggctttcagtctctggcttaggtcaaacctgggacaccactagttaagtctttcttggttccacatctggtactgggaagaaaatgaagaataagacacagactcagattttataatccagttggagaggcaaaacacgtccatgtagcagttaaataagggataaatgccttggcatgaacaagcagtcttaaaagagttcagaacccattgaagactagagtcagggacggtttcagagggaagatgggtcattagctggatctcaggtatttgagatgatcacatgtatttctcaacccgtctcctctggagaagtggaatttttggtccatttcatttctggtatgtctatttctttattaaccattttcaaatttcctcttttgtctgtgactttcaacagcccaaatctgtctctatctcaagtcctcccacgccacccccctccaagtccctgtctgtgttccaatcccctgcctctcctaacctctcttcacactcttctcttccaaagactccccccaggtacagtgccttcgagcctacaagccccgagagaatgatgaattggcactggagaaagccgacgtggtgatggtgactcagcagagcagtgacggtaagcgggagcatgcgtgagcagcaggccaggcactgcaggcagggcagtgctgggagtgtgttcacttcctgcagctgccatgacaaagtaccatggactgggtggcttatggcaacagaaatgcattctctcacagttctggaggcaagaagtcccaaatcaaggtgtgggcagagccacgcgtcttttgaaacctgtagggaagatccttccgtaccttttccagtctggtagccccagctgttccttggcttgtggcagcatccctccaatctctgcctctgtcttcctgtggctagctgccttcctgtgtctgtgtccaagttttcctcctttatttttttattttatgtattattattatttttgagacagagtcttgctctgttgcccaggctggagtgcagtggcgcaatcttggctcactgcaacttccaactcctgggttcaagtgattctcctgtctcagtctcccaagtagctgcgtgagccaccacacctggctaatttttgtatttttagtagagatggggtttcaccatattggtcaggctggtcttgaactcctgacctcaagcagtccacccacctcggcctcccaaagtgctgggattacaggcgtgagccaccacgcccagcccaagttttcctcctttatatagacacctgttatactggattaatggccaccttactccagtatgacatcatcttaactttattaattatatttgtggcaacctcattccccataaggtcacattttgaggtatagaggattagaacatcaacataaatgttaggagggacacgatgcaaccataacagtggtgaaggctcaggaatggacagctgtagacttggccacacccagggccgccatgttaggacacttggaggctgggtttatgctggaggctccccagttcactcagcctgaggattcagaaaactctccaggaaggtgatccagagaagctatcgtgagcctttcccaggtaattcttcccactcaccctgtgcccacaggctggctggagggcgtgaggctctcagacggggagcgaggctggtttcctgtgcagcaggtggagttcatttccaacccagaggtccgtgcacagaacctgaaggaagctcatcgagtcaagactgccaaactacagctggtggaacagcaagcctaagtcttctctgagaggagtttcgtgagctgaagaacaagctgctcatggcaagggctggccccagaaccctgcaagagaggccttctgtggatggagaactaggccttctcaaagctcaaggacaaaatccagctaacccagtccctcggcccaggcctcctttcgtgctttgtgcttggtgggggggatttcgagggactttgcactggactctgggaacctttcatcattaaaaaaagggggaccattggggcctgagccaaggaactttccttctactgccttatagtgcttaaacattctccgcctccagggtgcagattcagagctggccagagtttcagtgatagccgtatgttaaacagaatctcacctcagtctcctggagggagatgtttaagaggggttaacacatcagatgggagggtcagcccggtgacctctaaggtatcttctaacctagaaattcaccataattatggtgcaaggtcagtgtgtctctgagatctatgtctgttggtggcaatgtgagggtgatactctctcactctaataaacttggcacttctccgagtattttcttctcaaactcctcagcactgaaaaaggttcaaaacatggaatcccgagagttcctgcctgttgggtttaggtgtcataaaagtctaaggtggtgcataggtgatggcagttcctgactcctgctttctgacccctgagagtttggacagattttctgcttgttacagcttcaaaggttgtagaaaaagttagaagtaattgataggtgatgaaaaccccatctttgctgtacccataaggtataggtatagactagtttgggtggattgggcaaatccgactcggaccatccatgattttatattgtgacctgaattattgtgaaaatatcttctcagctgctttagctttcttctttgtgaaaggcagaatggaaagaggcctgggatccaagtcacaagacccaaactgcaggccccacactgccacagttcaacccttctgtgtctctgtgccctgaaatgtaaaacatgggcttgaaccaagtaacgtccaaagccctacttaactctaacaaatgtgttattctctagtttctttcaggttgcctgtctcagttgaagaatatgactaaatttttttctcattagcatccatatataacaataccatagtcatcttttatgccatcttttcatctataatagtccttcctttgatactctactactctgtttcatatttaggaggctcaaaagtagaattgcattgcagcctcgtacagaggtaagaatgatgctataaaatttgtcctaggcccacttaacaatgatgtgacatatttgtcgtccttttaataacacacactgttttcaatgtatcctaacatgttagcttgcttaattttttattttttaaatgttttaagtttaattaatttttttgtagagacaggatcttgctatgctgcccaggctggtctcaaactcctggccttaagcaattctcctgacttggcctcccaaagtactgggattacaggtgtgagccactgtgtttggccagtttactttatgttgaaaaaaatcatcaccataaccattaagatgtgggctaggctggatgtggtggctcatgactgtaaccctagcactttggaggccgaggcgggtggatcacctgaggtcaggagttcgagaccagcctagccaacatggtgaaaccctgtctctactaaaaatacaaaaattagctgggcatggtggtgcatgcctgtaatcccagctacccaggaggctgaggcaggagaattgctggaacccaggagtcagaggctgcactgagccaaaattgtgccactgcactccagcctgggcaacagagtgagactccatgtcaaaaaaaaaaaaaaaaagttgtgggctaatattattttatcataaacaagatgacattgctaaaatatccaaaacaggatggttttagagaagttcaattgaggtttttcactcttttcaaaaagccagatttttaaagtaaataacatgtattatttgtatatgctataatttgcatatactaacatataaaataataattgattcatattgattgcaataacaataattataatccaaactatttgtacaaaccagtatttgaatactggccatatggctcaaacagttccatatccagccctatattattttcaaggcaaattctccattattttctcagagaggtacaatagcagcttctgaatgcaaataatttttttgagttgcatggctgctgctttgcttgaagttgttaaggctttctcatccttttgaacataagttctgtaagacttctaactaaaactattctttagatttttaatatgtattcatttaattgggttatactcacctaatctgggatattagaaagcattaggctttacctgtcttttaagtccttggttaaaaaaagaaaaagagaaatttagatatgagtaatgtctcttcggttgaattactgaactatactttaggtttagaaaaattgaatataggttcactcattgtcctctccgtcttcaaatttccagaattgaactcaacttcttcagtgattactggaaccattacatggccatttcttaaaagagattatgaaaacaatcattaaccaagactttttggacagaactgcatttgaagcatgtatgattatacagtattttgttgctttcttaagcaaaacaatgcattgagtagtgtcttcaggagacaaaaatagttctattcatagaaccttttctgaattgtaatatgcttggagcttaaaatcatatagatgtgtgctcaattattttatttgtgcacttgaccacactggacttctgtcatttttgcctaagcacacagcttagaaagctatttttttaagtttatttttactaccaacttttacttaaagttaactatgacctttagcttttagctgtgcactacttgctctgtcttggccatttatagtgattttaataagaccagcctgcaagtatctggaaggcacaccgtttaatatgtgtttattttccctaattttgttttttgtctcaaataacttttatatccatgacagataaaatgaatctgagttctatgactgattttgttttaaattagcctttaggatagaagtggttaaaaagtcttttaaggctgggtacagtggctcacgcctgtaatcccagcactttgggaggctgaggcgggcagatcacgagatcaggagattgagaccatcctggctaaccaggtgaaaccccgtctctactaaaaatacaaaaaattagccgggcatggtggcaggtgcctgtagtcccagctactcgggaggctgaggcaggagaatggtgtgaacccgggaggtggagcttgcagtgagctgagatcacgccactgcgctccagcctgggcaatagtgtgagactccatcccccaaaaaacaacaacaacaacaaaatgtcttttaaaaccctgattacatttgctggttccccttcctttgcacacatatttacccccttaaataaacttgattccctgagggacctcatgttggtctgttctttttttttttttccctgaaatggagtcttgctctgtcacccaagctggagtgcagtggagcggtctcagttcactgcaacctccggcccctgggttcaagcaattctcctgcctcagcctcccgtgtagctgggattacaggcgcatgccacaaaataatttttgtatttttagtagagacggggtttcacaatcttggccaggctggtctcgaactcctgacctcgtgattcacccaccttggcctcccaaagtgctgggattacaggcgtgagccaccgtgcccggcctggtctattcttgatagtctgtgtgctttttaagtatttagtgatgttgcccttatcataaactcctcttgtttatggggtcaaatgagaattccagtgttttgatatagtggcccttcacagacagttattccccacccatcccctcaagacacaccactgagacttgtgcaggtttatacttgttgatgtttcagacttacacgtaaatatcttttgtggtggtaactctgctctatcgctaacacagtccagtgaccccagagccacactggctgtaaacatgactcagaagctgtgtgattacagcagttccaagcctgtagttgagggtaatcttctaactctgaagtcaggtgtgtggaagggccgaaggttatgagtaaatgagctgaagagagacagatgccaaactcagtcgtgattcaaatgcacttcttgcttagatttagaaaacattctctatgcttaatagtctttgacccattttttccaacccgcccattgtaaatgacagtcatggagtggaaatttccctagcttcttccttggaagagcatccattcaccctgcagttcccaaggagcgtcgcaaaaacgaggctaagggcacagacaaaactcgggcagtgaaggtgagtgagtgaggttgttgattctgggtggctgtgagtggggcatctgtgtaggaaaggagccgggttggtgtgcgttacaaactttttccgcgctgctggggtgggggtagctggtgtctgctgctccatgaatgagtcatgggctgagggtagaacttgctctagggaggggctgcgtctggctcacagcattctccaggagcaccaaggggcagatgaatattttctggcagtttacctgagcatttcagagaggcaactagctctgaacaatgcagatggaaacccagaaggagagagggagccagtccacatggtgtgctgagatgggggctctgcatttgctcagaccaaggggctcctgagcaccagggagaacattcagactgttggggaaagggtgggcaagagcaacagaccgtgggatattgtgggagagtcatagcagctcaacaggacagactgtaggctatcccagaagcagacagtctcagggagaaaagggaaatgcagaaagcaaagaaatgatgggccctcagtgggactcagccagcccgttctaaagtactttcttattgagatcaacgtgtggtgcaaatgagaaaattatccactgctggatttgaaagaaccttgaaagtctttgtgtctaacaccctcactggttacagtggagcctggagaggggaagtgatttacctaaggtcatacagtcggttgcttataaaggacagatttgtccagctctatgtccactgctaggatgtaagcaagtgacctgctgagcttgtgctcatcacccaaagggtgaaggtgacctgccatacactgcaaaggttgagtgaacagaaaatgcacaggcagaatatttttgagagagcaggaggaggtggtggtcagacttgtggaattgttaataagcaggtttgggttatggaattgagcttagtcaggcaacatgatccagaaaacacgaatcaaggtggtgttttcaaagcagttcattgtccttgcacaagcagggccttaaagaactgaagagtcctctgtgtgtgtgtgtgtgtgtgtgtgtgtgtgtgtgtgtgtgtgtgtgtgtgtagaggtggctgcttagattcaagggaggagagtacaaacagatctttgggagaaatgggatttatgcagtaagactgggcttcctccccgaaataaaataatacttgtgatgggctcagtggctcacctctgtaatcccaacactttgggaggctaaggtgggcagatcccttgggcccaggagtttaagaccagcttgggcaacatggcaaagccccatctctacaaaaaatttaaaaattagccaggtgtggtggtatgcacctgtagtcccagctactggggaggctgaagtgagaggatagcttgagctcaggaggttgaggctgcagtgagccatgatcacgccactgcattccagcctggacaacacagcaagaccctgtctcaaaaaaatggattaaataaaataatatttgcattaacaaatattaggggaaaaagataaggtgtgttccagttaagaaaccaagagaaatgaatatatatattgagataggatgtcactcttgcccaggctagagtacagtggcataatgtcagcttactgcagttttgacttcctgggctcaagtaattctcccacctcagcctcccagagtagctgggactacaggcatgtgccaccatgcccaactaatttttttgatttctagtagagatgaggtcttgctatgtcacccaggctggtcttgaactcctgaactcaagtgatcctcccaccttggcctcccaaagtgctgggattacaggcatgagccactgcaccctgccaaatgtatatttttttaaagtgtttgacagtcatcttttgaatatggttctgggaacattttttgtttatcgggtatgaaaatatacctgatctcaccaatttaagtaatttataggaagtaatagaaaagtcagactaaaatgaacaatctgttttgtatggggcaatgaagtgaaataatgaaatagtcaaattggaatgcttggaaacattaaatgcttgttgtggttggtagctcagatgaaggggcttttgagaaacagaggattgtatccctggcaggctagatgaatatgggttggggtaagggtgcaggagcttgagaaggggcactttgggtagaattatgtggaaagaatgacataaaaaccaatagaatgaaagtgtaccagaaagcactctagaatctctgtgggtggaaattccattcttagataatgaagctgtggcagtaggaatgtatgtgaggcaacctgccagggtaatgagatgaagaaacaaataaaatgtaaaggctacagaatgaagaagcaagtaaggtgtagatgccacaaccctgggtctgacaccaactcctcccctgggcttgtgtattttgcacatcttactcccagatgcctgggctctgaaacccagagtccgtttgatattctctcctcctcactcatgcagtcaactcattgatttcttcacagcattgatcacattgactgctttcctatttccctactgctgttttggtctcggtcccctcatctctgggtactggaatgacttccccactggtccatctactctcagtcttttcacccacaatctatctggaagagtgttccacagtctcaaatttgactttatattatttacccccctcgttgtctaccaggtaataatgctgggcccaacctagccatccagcgtccatgagccccctctgtttctcacactgctccttaggttacacgttcactaacctcactacctgttcttctcacacatcccaactccctttctagttttggaacattcagcttcctgctccctttgacgactattctctcttgcctcttacatatcacaataatgtgtctatttctttttaaatcaaactaaacagtactgagtatttaagttatttaaacacagacccagggcctgtggaaagatttgattctagctcaaatctagcttatacccactcttttctgacatgtcccacccaatcccagcttttgaccttctttaacacctccttctaaaactatcactagacattgcttattgcagttgacacctcatgaatgggcttaaatcatgtccagaatgtattccttttgcaactttgggcaaataacttcaatctctctgagtctcagattttcagttgtcaaataaagaataccttatacggtggttgtgaaataaaattacctagcagagagctagatacatgatgaatgccaaataaatagctagcatcatcattaatattttgcctaaggaccaatttctggattaagtaagctatttcagctcctgatggttttgtaaaacatacaagcacacaaaattggctatcatttatagccttttacttgttaaggctctttcagttttttcaaagatatattagcattcccaaagcaagactcttctatctgcacttgctgaagtggagaataaaaaactaaaagacttctatctagacttggtcaaggcatttattttaatttcattttcttaaaagataattgtaagataatttttaaaatagagatgggggttgggaggggggggtggtctcgctatattgcccaggctggtcttgaactcctggactcaagtcatcctcccacctcggcctcctaaagtgctggattacaggcatgagccaccacacctgaccttggttaaggcatttttaggtaatcgtttaaacctgtttcttgctctgtgaatttggataattgcatttatattttcacacctgttcaacctccctccccaggacctatggccctgtttgggcttttgatcatttcccaatccagcacctcttggagctctttctacttgtactctcaggctgtccctgacccattatcaatgccactttttcttctgcccagtgctccttcactatgttgttctttccgtaggaaacatagtgagcctgcctaagaccagttttcttcctgctacgtgctgtgcctgcgtgactttctcttgacttgaactagtgttctctatgctgaataggcctaagagctgcctttggtctttttagtccttgtctctgttacagaccctagttctatatttttcttacaacaaagatctgtaagttctaccctatggggggaacttacagaccctactctacccagataaccacttatctaaccagataactacagaaattttatcctcaacatatataaacgaactctccttttccctaaatttgcttcatctctgatatggtctggatgtttgtcccttccaaatcttacgttgaaatgtaattcccaatgttggaggtggggcctggtagaaggtgtttgggtcatgggggaggatccctcatgaatagcttggtgctgccttgcaatcatgactgagttctcgctttgatttcatgccatatatggtcatctggttgtttaaaggagtgtggcaccctcctcctcttcccttgcttgttcctgctctccctttgccttcgccatgaccctgcactttctgagaccctcaccaggcaaatgccgccaccatggttcctgtacagcctgcagaaccgtgagccagttaaacttcttttatttacccagcctagcaatgcaaaaatggcataatacaatctccattattttttctcaattatagcatttcttagttaccaaagtcttattttctttcagttaattatctaccacattatattgattctgacttaaatattcgtcaaagctgggcacagtggctcacacctataatcccggcacttcgggaggctgaggtgggtggatcatctgaggtcaggaggtcgagaccatcctgaccaacatggtgaaaccctgtctgtactaaaaatacaaaattagccaggtgtggtggcgcatacctgtaatcccagctacttcggaggctgaggcaggagaatcgcttgaacctgggaggcggagtttgcagtgaaccaagatagtgccattgcactccagcctgggcaacaaaagtgaaactccatctcaaaatattcctcaagtctgttcgctcttctctcttcaccctgccctactctacacatctctcagtgaggctgtctcagcagccttggattatgtccctgcatctcctctttccttctatcaatctcattctctgttcaactttctttttttttttttttttttttttgagacagagtctcgctctgtcactaggctggagtgcagtggagcaatctcggctcactgcaacctccacctcctgggttcaagcaattctcctgcctcagcctcctgagtagctgggactacaggcacacaccaccatgcccagctattttttgtatttttggtagagacggggtttcaccatgttggccaggatcatctcaatctcttgacctcgtgatcctcccacctcagcctcccaaagtgctgggattacaggcatgagccaccgtgcccggcctgttcaactttctaaaacacaaatgtgggcgagtcatgcccatgagttaaaactgccagtgccactgtttgcccaaagaatacatgcaaacactcagcatcgtgtgaggcctttcccaatctccctgccagcctcatctgccaccccagcccctccactcaaaccctaccactctgagcatctctctcatcctcttaccaatctcagtggtcttatactggctatactttctgcctgaaatatccttccttccttcctctgcttatccagattccactgttccttcacgagctagctttaatgccttagactctagagctttcttacgtggcttttcctccatttgagttcctgccactctttgttcccaggctggcacctcacagcattggccccctgtattgtaactggtcatgtgattgtcagactccccagagagagtggcagttccctgaaagctgagacgagattttgtttatctttgtgctgacccagtactgtctgtgcctgtaaacccccgtcacctgatggaatggatgtctgccctatatctcagggctttgttataaactcaaatgaaaggatatttatgaaagaacagtatgaactaaactacaaacacaagaacgctgaatctcccggactggccctctggactcgaatatcagcacttggggatgaatgaagaaggtgcatcatttccagggaagcagatttgctgttgactaataaagaccatttacttggagtggggccaacaaaagcctaattgtcttttgtagcctgtttctgttttgtgttccatttccgcaaataatatttaaatagacatttaaaattaattctaatgggctatctcataaaattatctgaataactaatataaaagattcagggccaggtgaagtggctcaggcctgtaatcccagaactttgggaagccaaggcaggaggatcacttgagctcagtctgggtaacatagtgagaccccaactttacaaaatatcaaaaatttagccgggcgtggtggtgcttgcctgtagtcctagctgctcgggaggctgaggcgacagggttgcttgagttcaggaggtcaaggctgcagtaagccatgatcataccactacactccagcctgggtaacagagtgagactctgtctcaaaattaaaaaaatattcagcctacaggaacaaaaaatagaatggggatcaaacagttttagaacatgaaaggaaatgatttttttggacagttgcagagcctgtatgagagtcctaatggtgaggggtggggtgaggagttactaaaatgccagcagtgaacccagggctgcctaggcgtctgaacagtaagaaagttgggtaaaacatggaggccaacttcaggattatctgtttgaactgcaaaactaacatggatgtagatgtccttagcaaagtgctacaactaggatttgccaggtttagcaaaaaaaaaaaaaaaaaaaaaaattaaaaatgcaagatatccaaatagtgcagggaacaggcttatgctacaaaattatttgttgtttttctgaaattcgaagttaactgcacatccttttttttatctggaaaaccaagctataacccaaatgacttcaacaactttgagcccgatattattgacaggatggggctctggggcattttggagaaagaattgaggaagattcgcgtggactcttcttgctgtaaacaaccagagtagtttagggccacagtgaaactggtggtagattgccatctagtggaaagatattagtagtgaaagctaaaattggaggactggacagattttttgttttttgttttttggttttttttccggagtttgccaggaaggattccgctctggccaactgcaaagtcctgaggttgcactgttagacgaggaggacatgggtggggggaagggagggtaggaagcagatggaataggagcaaggctgaaatgcgtttacctcgtgttctaagcagagtgcctggaccattgttccattccagcatgcagaaactttgctccctctccacgcaaaaccagagcaaaagctagagcttcctgtaagaagcgcaagattcttccacctgaggatggctcaaagtgatgtggaactatcagaaacaaaattgtaaagatataatcactcatcgttacaaccagcgacaaaggaagtcatccaaaaggtgacagtgtggctggctacacaggcaagctcagatcttgaaaaggttgaaaaaatgcaaaagttaaaagaaagcacacactggaattccaaagacggtatctcaaagtgagaagcctggaagaaactccgctctgcaagcatgctgaagaccaatacgaacagtaacactagcaatgataataataaagccaaacttgggacaggaaggagagagaaaagagaaatgtactcctgcgggcagacatcataatgtcaacatacaatacaaacacagcagatgcacttgagttttatttcagactatcttcccaaagaaatgaaaatattctagaaattaaaagagttgggccgggcgcagtggctcatgcctgtaatcccagcactttgggaggccgaggcaggtggatcacgaggtcaagagattgagaccagcctggccaacatggtgtaaccccatctctactaaaaatacaaaaagtagctgggcgtggtggcacgtgcctgtaatcccagctactcgggagtctgaggcaggagaatcgcctgaacccgggaggcagaggttgcagtgagccgagatcatgcaattgcacttcagcctgggcaacagggtgagactctgtctcaaaaaaaaaaaaaaaagagttggataaaaaaaaaaaataatactaagatggacttaaaaacccaaattggagccttataacttttaaatcatcctatatgttttctagtacaggacaagagagggtttctaagacttactagaggcaaatatcctaatttccaatgacatgatttgttgaaactaaaggacaataaatttaatgtaaaatcttatggaattctatgagattcttgaaaaatggcttatgaacacttaggtaaaaattagccagaaaagacaacaggtgttctaagctaatctgtctcatttgttatatatttaggtttacaagaatgttatattatcagagtgctatacagagaatatgtttttgattttattgaatcatagaggagttttattcctaaatccttgagggagatagtaaaggatggtatgggatgataatacagttaaggaagatttgtagctagtttaaccctctatacaaaaaaagaagtacccattaatggagtattttcaaagaggagtaccaaaatgtcctgtgctgacctatattctgtttactaatttattaatgatttgattataaaatgtgtaaaacatattgatcagatctgcaggcagaacaaaactgcaaaaaaatggctaatattatataagaactccagagcatcttaagctcaatattgggctaaaattaacaaaatgaaactgaacaggccatataaatctctgtatgtttagattagaaatgttaattctccaagtgcaaaatgaggagggtgaactgcctttaaaacagcttctgtttaaatgacctagaggtcatagttttggaccaagaatatgaaccagctgcacaaaaatgctaatgtgttttaatagagacaccatttgtagggtatcctatttaatggagatgacagctgtaccaaaatgttgaccagaccacattcaaagtaggcttcatttctgacaccactcctaaaaggaacatgggcaaactcacatttatttgaaaagaggcatacagggtggcaaagagcctggagcccgagccccatgagggctagcagacagagctcccaccatcacctgtagaaggcaaagcttttataataggaatgatatacagtccttagatttgtgatttattttttgtagtacttggaaaacaaaacccagatcaatcaaacaagatattggtttatttctagtagaagaattttataataaagctcttcaaaaattctgcaggttcttgtgaaagggagttagccccaagcctcgggccctccactgggaaaacaatactgaatgatgccccatcaatggtgggtagaagagattcctgcaagtcaggagcttggattttttctttcacccctaagtttccatgcttctaagaagttttcacgattttctctttgtttagtgtttgtttttaattctcaattcattttatttttagtatactattaaatcaacactttttatctaagagttgcatgtaaggacagatgtcaaagttgatttccgttcgattcttggtgttagatgctgtatttgctccatacaaaggtgctgctaatcattgaatagcgggagcatgaaccaattaagatctggaggagaaaatatccagccaccatgtagggctttgaaagcaacggaatgctctggtgattaatagaaagagcagttacagtcttccatctattttgccctatgtctgtctttaggctgttcatttcatgagcctcatgagacagaatgtgaaaacaaaatgagatatgtaaatatatacttttaaaaactcaattgttatgcatcataaaacatttcataatttaacaaatacatatcctaatccctaaattaagggtactgaaacctggctattacaatctccatcacatatccgccaagtcgaccttctggttttctcctgacttctgcccctctggtggatttctgcattctttcagagacattttctcattggcttgcacttatctattgttttaatcacacctctctaatccctaaacactcctcttctttatctattaggaggacattgatctttataactatttactgactctcccccttttcatattcatcttcctgtcccttcagcttttttttttttttttttttgagatggagtctcgctctgtctcccaggctgaagtgcagtggcgggatctcggctcactgcaagccaagctccacctcccaggttcaccccattctcctgcctcagcctcctgagtagctgggactacaggcacccgccaccacacctggctaatttttttttttttttttggatttttagtagagacggggtttcaccatgttagccaggatggtctcgatctcctgacctcgtgatccacctgcctcggcctcccaaagtgctgggattacaggcgtgagccaccgcgcccggcctttctctgctcgttttccattccactttctgactcctgtgccatctcctgtctctcccgccccctagcctctttcctttgttcccttcctgacctgttctttcctactttagtacctctcaggtccctttcctccaatctccagatctgtgccttaccttttcttttctgtttagatgtattttaggatagatttttcttctgtggttatctttctctttcatcacccagtcaatgttttgctgcttcttatactactgtcttcacccttcattcatctttctggtccttttcagtcccatctcgcccttctcccaggcaccacccacttctctttttatacaaattggttgtttaccctccttctcatgctccctttagcccttaacatactaaagcaggatctcaagcatagaaccaataaggtctaattgatgtttcttccttcattgcctaatttgtcatttgcctaatttggctcaccaccagaggacggaaggaagttattcaagttcaatgtggatgcagaatcactctgtgcaatggaacaggagggtggtacatcctcagtcagtgtccattctttcctgagctcctgaccccttgtgcagacatctagggagcattctccatctttggttaagttctctcttgttccctcctcttcctacatctcaacctataaccaaacctcccgagattagcacccaacctcaaacggtaaccataaacaaatggaggaggtaaaattgcagtctatgggtgagagttaagcatgaaatggttggtgatcattttagggggtgatctctcaaggtgcttagcaaagtgtcttttggtgcctctgcaagctagggtgggagagacagagaacattctggacccttcgtcctggcccagtgaggtctgggccattatagtctggggatgctgtcacatcctcctgtgcgggagagaactgtctacttgctatcctcggagtgctccccagccccgccccccatacacaaaaacaagagctgtgggaaaataagtcctagttcacaatactagagaagtgacttcagatattctcaggcttctcttgtgatcctgtccctatggggcccaacttccagagaaaggcccagactcagatttgctcagagtcagtcatgggtttgggaatagaatatggttaaatgtcaggaccgaaggaaaagcccaagatgcccagttccttctttagtgggagagatgagcccagggaagaggccctccatgtggtcatgcctggtggtgcccacttgagaatggcatccaatgactgctcagccaagtggaataaaaggacgaaaatggagctcttcattagtgtgagtgtggagacacataatggagacacataaccacagagaaaaccgcaggacggactagtttactgcttacggtggacactccagctcatttgtcaagcaaggataggaaacaaacaaaaacacctgatacaacattcagaagtaacacaggccacctgcttccttcaggacccccacacagagtgtgaagaaaagggaagcgccagccctctttcttccttctcatatcaacaagacgagcctacacaggggaaacgtctaactctcccctcagtctacagagtccacactctttcccaaacccccaacccctgtcctctcagcgagcccaatcctatcccacccaagcagcctcttttcactctttgaccccccaactaggggacatggctattcttgtcatcccctctggcctcctccagtgctgagggctgatccagggaagcagctggtggttcctcttttgccttgctgagtaagggcccagtccctggtctggccccttcaggcatccatgagagagctgacgaaggctgcctgcccagagcctgggggcagggagttggaaatagatcaggaaagtagccatcccctcctgggggatgccccagagcttgtgggcagaacggaccagggaagggcagctctggcaaacaggggtcactccaggaggctgtacctgtggggtcggagggtgtaggaattaccagacaggatggagagtatcaactatcattaacagtgttctacaacagatccccccgtgccccaacacacatagacgcagcttaggacctcagtgtaagtctgggtcaaactctagcctcagggtctgtccttaggaccacacaggctccagcactcaaggtcctgtggtttagtaacattgacacaaagtgaaccatggatcaggccaatgctgtttcgtacatgcaacaaggagaccaggaaccacctgatctttcctccccttctgctagaatctagtcttaatatgacagatgtttctgggatttcagaggtccaagtggcccagcagaatattagctgccatctactctaggccaaatattttcactcctattgtatctaatcctcaccaagtccctccctgacatagaactgtgagtcccatttcagagtcccagaaactgagactcaggagagctagtaactggctgagctggacttcaagcctgttttcctgatgccaaactccagagttctctgctaactctcactgtgctctgcagcctctgcagaattcgagggagaagagcttaatagaactaggggcaaacagaaggattcattcaccacccatgacctgcctcagtctaccctccagataacttggctctttgtcccctcccaccttcctcaatctcaaggggaccttctctcccagcctcaactcacctatattcccagcaggtggttgcatcaggatctgtcctgaggaggcacctgggcaatagccctgcgatgtgcccccgctggggccacagggaaacataaagagagagtcttcgggcggtggaagcgtcagtgaactgggcatggagaaggggaaagtggggaggtagggcaacttgggctgaggggactggaaaagcgggggctgtggagcctgggagaactggaagggtcctggctggttgctctgttggtaatcctggggctccagctcctccaaatatgaacaggggggtggcagggtgatgctgcaaggacagaggaacagctggtgaggtgcaggggtgggggagctccccgttcctaccacagtagcggagtccctacctctcgcctcctcctcatctccatggtaagcccagccttgcaaggctgctgcagctgcctcttctccccactcccgctcctagcatcttacccttgtttctgctctattgctgtgatcccctaggtcattccccagatccccttatccctttcatccccatctcctgtaccactctgtgctcctctcagttaaccctctcctctctgtgtctatcttctctccatctacacccccctacccccacccagataactagagtgacctacccccgtaggttccttaccttgtcccccaggacccacaggggccgtccttgtggctgctgtcactgccagcaacatccatcagcagtggcatcagttggggggtgtggacagggccaagggggaaaggaagatcggcccttcgcacaggtggggggctgaagagtgggggggtcaccaccctctgagcaccctcactgggttgggtgggggccaaagtctggtcagaagtcagcagcatggggggctctaggaacagaaggcaaagaggtgctataacggtaaggaaatgggaggcaggtttggcatcgctgaatggtagacacaagccatgcccaggtccccctgaataggccctgctggctgaaacactggaggactccagtcactcccacctccatcaaacaaggcctgtcttcactatctttagttgccattttcccccagctctgaaggtgggaactcacctggaaaggtatccagaggggactcctgagggaaagggtcaggctttggctccatgggcacagcaggtaggatctcagctgcagagctggaggcaggaagaatgaagactgtagctttggtggtctctggatttgcacaggtgcctcattgccaggagagacaccaattcccaaactctgcctcctacagggcattggcaacttcccgatcccatggcagccaaaatccctctaaatcttagctggcaaccctaggactcatgcctagccttccaatggtctccttctagaccctcaggatcccagcttggaccccacttctacccacagggatgatacagaaagaggaagaattctgacctgcattgactgctggcagggccaggggctgcaggattgtccttgctttctttcccattcagtttctccatttttcgccacttggcccggcgattctggaaccacacctatggggggaaaggtgcttgaagaactggagaagaggggcagagactgaggcttaggtcctggctgttgcacaaggagctacaggactttggaaggtcactccagcactctgcttctgagccctccgtcaggctggttttatcaaaagtctctgcagtgccttcctctcctaatgctctcaggctgtggcactctggaaacagtcagggacacagccacgtctgaggcctcaattcagctcctacccaggctaccgctgagcgctcactctgcaattcgagtgtttcaatggtgggccctccgccactccaccctgccaccagtgagccggccccctttaccatgatgcgctggggggtcacccccaccgtctgggcaatctctcggcgtttatcactgtcaggatagtggtcttcttggaatatcttctctagctcctccagctgatctgaaagaagaagaaacttgtgtgaggaggacaaatgccagtgacaggtaggtgaagagaaagagaggtgctcaccaagtatctccaacagatggggccactgcccctaacccaacactttcccaaagcctttttcctattgggctgggccttctcgctcttgggtgctacagcagagagcagtatgtttactttctttactcttctaccctggtcccaacatcattttctttttttcttttttagacggagtctcactctgttgcccaggctggagtgcagtggcgcaatctcagctcattgcaacctctgcctcccaggttcaagcaattcccctgcttcgacctaccaaatagctgggattacaggcacaggccagcatgtctggctaatgtttgtattttcagtagaggcggggtttcaccatgatggccaggctggtctcaaactcctgacttcaggtaatccacctgcctcggcctcccaaagtgctgggattacaggcatgagccactgtgcctggctccagcctcattttctgatgtgataacccaaccttccctctgagggtcagagatagttgcactaccgcggcccaagagagaatccgggacgaagtgacatacaaactaaccccatccctcaggtctcctgggggtagattcttcacacagccccacctttccccaggatgaccccagatctcttcggtttcctctctttagggacttacctgagcggtatagggttcgtgtctttttcctaatttggcaggtcacttccgggggcccctgcttgtggtctctgttttggttgctctgcgccaatgtactgaggagattggccaggtggcagggcccccggcctgacccacagggcactgggttgtgtgtggcacgggctgagttaggggcacccggagatgatgttggggccagacccatggcattaggctttttctgcttcccgggggctggagaataggacctctttcctatcttcacctctcccactgggagggaacaatcttccccctgagtctggggcctggagcgggctagagttctgtctttgtggggagccctggagcgggggggcgggcacagtctcccagcatcagccccggtggcttctccagagactgctggcggcttcttctctcctgagatggtgcaggagggtggcagttcctcactctgagtgtcctgagcatgaggggctgagccccggagcagttcctcctccccgggtcctgcagccaggggcttctctccagctttctggcctgtggggagccaacatccactgaccttagcaccagggagaaggaagaactggaccaagaggaagtgctgcttcctgctttgcaaacggtttgatcttaagctttaatttgtctacctatcaaatggggtaataattccacacttaccttcctagcttgactattgtgaggattaaatcagataacccaacttctttgaaaaatgtagacaaatttatgcaattctgagacggcgttagctcatggtatctcctaatttgggggtactcaccccttgtgagttcccttttcccagacaccaggggtatgagtttgagggactgttcaggtatctctaagggatcatgttggggctgcggatggaccaggaagacaaagagaaacagattgacagagattctgcttctcccaaggcgggatgctgtttctgctgcacaacaggcattattgcttggagaagggacaagaaaggattcgattgtctccagcagccgaggcaagagcatcaaaagagataacagggagaaccatggaactctgtctctgccaactctcctcagctccatacatgcccccccgcccgcaccccccaccccactaccatccagcacatccacttcctccccctccctgcaaagcaggatctcactctctggtaaacctctctttcgagtaaggaaactgggacccagctagaactaaaaaccctaccactcatccctaaagcttgccttcctttctgtgagctgactgatgcattgggagcttatcatgttccaggcatggcgctaagcacctttcaaagattagcacagtgcatatttaatctctgcaagaacggcactgctaatattcccttctaacagatgaagaaatgaggatgagacagcagagtaatatgtccaagatcacacagcaccctgagcacgtactctgtgtacttaatcaccacatggagtccttcctggggccatcaaatgatccccccactttcacctcccaactgactcataactccaagaaccctcagctcagggagctgctttatcatttccaactaaattggaacatttgtaatgaatgctaagtaacgactaagagctactgttactttaatgaaaattgcatgagataggtcttaaggaataacattttttttttttttttttttttttttgagatggagtctcgctccgtcgcccaggctgcagtgacatggtgcaattctggctcactgcaaccttggccccctgggttcaagcgattctcgtgcctctgcctcccaagtagctgggattacaggtgtgtgccaccacacccagctaatttttgtatttttagtagagatggggttttgccatgttggccaggctggtctccaactcctgacctcaggtggtccaccagcctcgccctcccaacgtgctgggattacagacttgagccactgcgcctgaccctaggaatgactttgtaacagagtgtcaaggaaaaaggtcatggtcaagggtgctgttccaagtcctttcctaggacacaggctggacccgacttgcatgagagggtctgggctggtgaagagggtgagcaggcctctatggagtgaagggacaaagctggctggtggtgtggggaagcagggacaaatttgttttacagcattttaggagagcttgtactgtagcaaaaagcctggtacccagcactgtgggtgctccgtaagcacgtgtcctatgggagtgatgtgcgctagtaagaaggggacgggtgtcagacctaagactagaagggtcctggggctcccagggttctctcccctgcgcgctgggagactggaggcgggcagggggcgcgggggagcggggaggggggttgcaatcccaaagcacagggggcagtgaggtcggcctcctcccaccctaccccacccgactccacccggccctcggcctactgaagctcttaggtcggctaacgctgacctggtgatcacaggcctccccccctccccgaacccccaaagcctgaccccctcgcacgacggggtctccacactcacccagcggtccctggcagggattctctgtgggttccatggcctggactcccgccgccgcggccggcccgtgatgcacaggcgcggcctaatgaagcctcgccgggcgggcaggtgtgcagcccgcacgggccgggccgggccgggggagccgtagcccgaggctgcgccccctcacccccacccccacccccagggcgaggccggcccgggaggctcggctggggcagctgcgagggcggggaggacccgggcctgggcgccgcctgctccgctccccccagccaggagcccaggcccaggtgcgggtctccttcaggcggcccctcccgtggcggggctggagggcgaggctggggtgggaggcgggagcgaggctacccggtggtcttcggggggctgggcccagccgtggggctcacccacaccctatggaggactcagtcctggatcgtggctaaagcccttccctgtggactgtggaaggcgatttctagagccactcctcaaaggggaagcgctgggttgcccaactcccatgctagggcccctccaagcctcagtattaaggagcttcaaagtccccttcctgattttgtttgtttttgtttttgagacggagtcttgctctgtcgcccaggctggagtgcagtgggggatctcggctcactgcaacctctgcctcccgggttcaagcgattctcctgcctcagcctcgcgagtagctgggactacaggcgcccgccaccacgcccggctaattttttgtatttttagtagagacggggtttcaccacgttggctaggctgggctagaactcctgacttcaagttatctgcccgcctgggcttcccaaactgctggaattacaggcgtgagccacagcgctcgccccccgtactgatttgagggtctccagagcacaaaggctgcaccggatgatgaagaaggagctgaaagagccacagactccgtagatccggtacagtccacacacaggaaattcaggtacagccaggggcggccctgccagggacggtgtggttactgtgtttccatccatttggtgtttcgattttattctctgagaatggaagggactttcttgggggagatctcacaggggtgcagccttatgattcctggttcacggaatgtttcttactatctttatacaaacaaaatcagaatttaaaaattcttgcctcttctgagcggggaggggtagaaagtcggagggctggtcagatagaaacaggtgcttggagctgggtggggagcggggcggcctggaacagaatccaggtgttttgctttaaggatttaaaagactctggacaccacgtgctttcatgctgaaatcagctgtgggtacattttcctattcctttaattgccttgaggggcttggcctacacatgtggactttggaggattgtgagacctttagttctttctgaaacacaaaaatgtaaactaacttcgaatatgatcaagacttcaggcatctgctgtttcattctgatgccttccataaggcggatagcttctgttttatgaggcgttcagatagatggggcccagtttctgtgctagaaatgaagcattccaggacaagtgagcaagcagttgtggggcactgacattgcttccaggatcatttgatggtgaaaaatcaggaccatttggtggcgacatggtaaatggaacccaggcacgtccttgctcacagaagcttactggtggagggaagatcatcaaatgatcatgtcagggtagtgtggtcagtggtgagttagaagtatgaaaggctactatggagtacggaggagcaggaaccccttctggactaggatggaagcttcttggagaaggtgacacgtgggctatgagctgtggagtttaccacatcacagtcccgcttaaaacctgacagtgacccctgactgccaggatgaacggcaagctctgacatctgggtctttcccctggatcctcagctcccctgtgttgcccacctgggtatttcagtggtggtgtgtgtatgtcttttttggcctaatgtttctcaaagaatgttcttaaaaccccctggatcagaatttcttagggaatttgtttaaaatgggggttccaatccccagaaatcttaattggttggtccaaggaggtacccagaaacatccatttgaatcccctcaggtaatttttgtgcgtttcagagtttgagacacttttagactttgcaaaaactaagtcagttaaaaactatcctggggataggagtaggggcaagggatggtaggggcctgtgtggggaaaggaaatgaccttttgccctttactgaggtgtctgctgcagtgagaagcgggtgcaattaatttcttaacagattatcctgtcacattaaactgaaaataagtcatccttctctgccattgtttatgttgtatttcctctctctagctggctcccctctgccagggtgaaggtcagaaagcaaagatccaaattgcccataggctgtatggcacccttccacaaactgaaagatacagggtctgagtctacaatagatttgcatagggacttagagaatttaaaatattggcatttttccagcggggcacagtggctcatgcctgtaatcccagcacgttgggaggccaaggtgggcagatcacctgaggtcaggagtttgagaccagcctggccaacatggtgaaaccctgtctctactaaaaatacaaaatttagctgggtgtggtggcacacgcctgtaatcccagctacttgggaggctgaggcaggagaattgctggaatccaggaggtggaggttggaataagccaagatcatgccactgcactccaacctgggtgacagagtgagactccgtctcaaaaaagaaaaaaaaaaaattggcatttttccaaacatagaaatgaggtttttttcccccacaaataatatagttggatgttttgtttatttacatgaagaattttattggctgcaagtgaattttatctaagatgtacattgcatgggaaaatgtctggtgagttttgttgggaaggtgttgtgtttttgatatatcttgttaagtcatatcttccatggatcaacttcaagtgaaggaggtttgctatggaagttaaaatacgggctagagcaaagagacggctcaattatatagaggacaacaaggtattgttttaggggaacttggggctgtttcttcctaagtcctgtttggttgcatttcatctttgtgatcagctgactagttcatagcctaactcaactttgtttagaggacagggaggtatttttttttaatttttaattttttttttttggtttcttagttttcagagctagactttacaccattaccaccatgcacttagaaagagtcatttcttccaaaatctttttttcccctcacagatatgagaatgccagaacaaaaagaaaggtgtctgatactaaaaaaaaaagtagttaatttttttcagtctatgaagagtaagtgaaataagtgttcttgatccttctccctctctctctataatgagaaaaataaccagaagaaggcggctgattgagaacattttttgaagcaaaaccacaaggtaatgtgttcttgttctatgggccacaccccagtgtaggcagcatcaggtcattggaacacctaggaccagaaaggcaagaataagttgtgaaagacaggcagaaatctgcagggagattgtagtcacagccagggagatcgtagtcacagcaaggtatgggaggtcagggcccccggaaaaccaccaggaagagatgacctgtccaaagcagagagagcgaagggaagcctgagccaggcacgtgctcagggaccggcactgccagagcccgggcaaatggccagatgattggataaatactggggaccgatgacagggaaaaagtgaatggtcccagagactgggagagacactggcaactgccaaagtatctgcccaggggcttcctttgaaagcccagaaaaggatggtttcaggttgcctgtgaagggaattaggaacacctggctagagtggaaactgccgggcagggccaggacaagttctggcgtgaattagcgttgtaacttctaatgcccttgccccagacactcaggataatctgcgtttaacaagaatggtgactgtgttttaaacattctgctgctgctgccattgtttacaattaatcgccactgctggtgttttgtaatttagaatgtactttcacatccattctaattctcctgatgtgcctgagtctgggatgcactttcttctttctattctattctagtcttctccaggattgcaatcgctgtgctaattatagcatggcattcaaggacccctcaaaacccggccccaaccttcactcaggcttcctctttggccaccaccactcccctgccctgccccaaagtctcccccactcttccaggtttttgttccaagcttttaccctttagaaatcgccatgccttctcagggtcactgatcaagctgtatatcagcatgaaactttttttttttttttttcctggcaaagtcttactcatcctccaaaacccaacccaaatattccctttctggggaagcctggctcagccttccacagccagaattaactgccccctcctaggtcctccccttgtactgtgtttacatgtatattacatcactgcatacaggctgaactgattagcgttttgtgtattctccactggattgggagttcttagatggtaacatgcatctattcaggcccggtgctttcttcttgctttctaagtatcaactcattgaattctaacaacctatgaagttctatcatatgattatccccatcttattgaagaaaatgtagcataaagagtttaatacttctccgaaggtgacagtggccacctcagatttgaacccagttagtctggttcctgcctgcactcctaaacactaggctacactgtttatttgattgtatccatcactgtactggcatagtgaatcccgcatgggggatggatcattgttcagtgacaaaaagttgaccattgccaggagttagggagcaggggagggaagtggctgtgagttcaaaagcgtagtagcagtgatggaaccgttctgaatcttggctatagtggtggttccacaagtctacacacaagataaaactgcacagaactaaatacacaccagtgcatgaaaactggtgaaatctgagtaaggtcacagactgtatcaaagtcaatttcctggtgtggtattgtactggcgtgacagaagatgtaaaacggggaaagtgtatatggaatccctgtattatttcttacaactgcatgtgaatctacaattatctcaaaaagcaggaaaaaagttgatcctagtgttctgaccacaagtttggttctcctggacttggttaaatataattcacagaaataatgttttggtatagtagcattattaacttttgcttaatagtaactttaaaatatagatttaaatgatatctacacctttaacaggggtgtgggtgagcaagcaggagaatttatatctaatttgttctaaaagtaaaacaataacatgtctcataataggaatgcaaatttattagaaaaaagggtaaataccgaacaactgaaaaatgaagaagatgctatttctcatcaaacaacagtatcggttattaacaatttggcacatttcctcacagcattttttccattattgctgttttgtatatgattttcatgattgtaattacactccatatataatttcaggcatgtctcccttaaaatgtactatgaaaagcacagttctgtattgtttcaaagtcttcagaatttattgagtggcagtactgttatttaactatttttcaactgttggagcaatcttttgaacttaaatattatacgttttaaaaaattaaaaaggcaaatttgaaatacagcttgcatatttttcccttaatggcttttaaaaaataaaaacctcttccacttggttattcatctccctctagatttttttaatagtcccaaacccatgagaagccatgaggctgtttatttcacaggaatagacaggctgcctggctggcaagtggatagctaagcgtaacttcaagaaggggtccgggattctaaggtcgtaaacctgacagccagcagggcagctttagtgagaggcaagaaatgtccctgaacaaggtattttttcctcctttggtatcttgggtctgtaccagttctgctggtggcttgatagatttttccaatgtttgagtctagggtcactggctcccaagaggggatgctctaccaagagtcctcagtgtatgggaagacaactctgtcttctgttcagagtgtggtgctcacaattttgctgttgcttccaggacatgagctcaccctcctgggctttgaagccatccttgtctctggtgtcccaggtaccctccaggtctggtgatgttagtgtcaaaaggagagccatgtcatggccagcaggttcctctatccttttggggcaacacactttaagctcactaactttatggtgacaattctagatctgtaaaattgaagatactcgagcttgtctttaaatatctcctttgcttgatgtcaattgagggcaagatcagtagtgtgggttagaagctgggagcagcttcctttgcacggaggagagaatggtgaaatattaggcttgcgtttagtgaggcgtagagattaaacaatgatagcagactagattgattacctgacaaataattaggcctgcaaaacctgtcattccgttgcttggaaggaagcaatcaaactggataggctatgagatccagcctttgttttgcaaagggattctgatcgtttctgttttacaagctgcattgctgtatgctgcacatgttattaaggtggtgcaaggcagtgcaggttgtgagtgggcaacctggagctcagtcaggctctcattcagagcagtcctaaggaaaaggagagcagagcaacagagagggaaaagccatatttggaactagagatgtactagatatcactggatatgcattcttgagtcaggagacctagtttatgatctgagctcttagagatcctgctccaaggtccagttcttcagcttctcggttgatgtgggctcctgagcaagggaaacacatctctcaaacttaacctgattttcaaactgaattcctgattcccacccgcaaacttgtcactcctcctgtcctcccgatctttgtatcctccacccagctggaatcacccttgatttctctctcacacacagcatctatagaaactgccagattattcctgttgccctctttttactcccagcccactgtcacccattttccagagatttgcatgtgaaagtcttaaaatgtaaattaaggccgggtgcggtggctcacgccggtaatctcagcaatttgggaggccaaggcaggaggatcatgcggtcaagagacggagaccatcctggccaacatggtgaaaccctgtctccactaaaaatacaaaaaaattagctgggcatggtggtgcacgcctgttgtctcagctactcaggaggctgaggcaggagaatcacttgaacctgggaggctgagcttgcagtgagccgagatggcgccactgcactctggctacagagcaagattctgtttcaaaaaaaaaagaaaaaaaaaaaaaggtaaattaagccatatatgtttttctcctatttgtatgcttcagtgattttccagtgtacttacaggaaaattaaaacttcttgctgtggtcctgtgtgatccggctccggtttaccaccccagcttcatctcaggtgactcttctgatccttcaagcacttgaaatagatcaaattttcccatttcaaggtgttcacatatgctgttcctgtgcttggccaaactattctctttgttcttgtgattagttcatagtcaggattgagtttaaatggtatccctcaatgtcaagtccttcagccacattatctgcttaacatctgcctcctgatactttctgtttccattacaactcctaacacaacatataattatatgtttatttgtttacaatctatctcttttactatattttaagtttcatgggtacagaaactatcccagtttgtttcaacaatgtatacctgtgtataggacatatctagcacagtggctgggctctaagtgttaactgtttgttgaatgaataaatgaactaataatgtggaccttttagttggaaaaaagagaaaattatcagatttatggcacaaatggcagttttgggaaattcacaatttgatacattacaggtatttggtaagcagattaagttacaatgcttcctgaaaatatggattggccattttgagaactgaagaatccagaaactagggataaaatgtggcattttaatgtccattctagagaatataatgagacttgcattacactttggtaaagtccatagtcaccagaggccattgcttttcagaggctgagaagaaaagcaatagtcagagctacagcccattaaggctgttacagtcttcaaagatgggcacagacaacaaaaaatggctttgtaggcaacatatagttgaatcttgctttttaaaattcagtctgacaatctctgccttttgattagggcatttagaccacatataaaagttgttgagcctgtaattccagtactttgggaggccgaagtgggtggatcacaaggtcaagagatcaagaccatcctggccaacatggtgaaaccccgtctctactaaaaatacaaaaattagctgggcgtggtggtgtgagtctgtagttccagctactcaggaggcagagtcagaagaattgcttgaacccaggaagtggaggttgcagtaagctgagatcgctccactgcactccagcctggcgacagagcaagattctgtctcaaaaaaaaaaaaaattattgatatagttgagtttaaatttatgatcttagtgctctttttctatttgtcacacctgttcttatttcctgttttctccttatttttgagtcattgaatatttttatgacttaattttatctcatttgttggcttattgagtatattattgatttataaaattcattgattttttttttagtgattgcattgggacttaaaagatatatgtttaatttatcagaatgtgccttaaagtgacattaaatcacttcattgaaatataagaaccttacaacattagacttcttctttttttttttttttttttttgaggcagagtctcgctctgtcgcccaggctgaagtgcagttgcgccatctcagctcactgcaacctccgcctcctgggttcaagtgattctcccagctcagcctcccgagtagctgggattacaggtgtgtaccaccacacctggctaatttttgtattttcagtagagacaatatttcactatgttggccaggctggtcttgaactcctgaccttaggtgatctgcccgccttggcctcccaaagtgctgggattacagacaacattagacttctgtgtctcccctctcagcctttgtgctatcattatacagttttcttctatgtgttataaaccccacaacacattgttattttttatttcaatggtcagttatctttaaaaatattttcaaaataaggaaaaagagtattctgtatttacttacatatttatcatttccagtgctctatccttcggatatatccaaaggatatcattttccatgttaaagcaatgtcttcaagatttcctgtagtaaaaatctggtgacaatttctttcagcttttatatttgtgaatggtgtttattttgtcttcatttctgaaagctgggtatagaattctatgctgatatgttttgttgtttcttgaatactactatgaagatgttggtccattttcttctaccttatataatgtcactaaagaaaaagctgctatcacaattcttatctttgtttctctgcacaggtgactttttgtctttagctgattttaatattttctctttatcactaattttaaatagtttatgatgtgccttagtgtagttttctgtatgtgtcttgtgtttgggattcatttagcttcttgaatttgtgagtttatagtttccatcaaattaggagatttttttcattgattatttcttcaaatatttttttccatccttctctctctccctttctttggggccaccaattttacagatattagccttttgaagttgccttatggttccctaaggcaactgtttttttgtctctgtgtttcattttggagagtttctattgctatatcttcaagttttgtatttttttcttcttcagtgtctgtagttattatatccagtttgtcatctcagacattaatttttttcatccctagacatttgatttgggtgttttatatcttcaatgtctaaacatgcaaatattctcctttatcttcctgaatagatgaaataaaattatgtaactgctttaacgcccttgtctactatttttatatctatttctatcaatacttttgtctagattatggctcatttttttctgctgctttgcgtagctggaagtgttttattagatgctagacattgtaacattgtgaattttaccttaccggatttactgtgtgagagggtgtgtgtatatgtaagtgtgtgtgtgtgcttgtgtgcttgttctgtatcctgttacttggaagtactatcaccttttcaagacttacttttaagttttttaagatagagagggattccaactaaggctaattttccctgccaaagcaatatcttctaaatactccacccaatgccccatgaattacaatgtccttccactctggctggtagaaatccaaactattcctggccctgtgtgaacttcactggttattttaccttttctttttcattggttctttcctcgctagggtagtttcctcacacacatgtagtaattagtacccagctgagggttctctttctccatccttctctccttcagctcctctctgggtggtgctctccttcccagtacccaccttcgtcttcccaaattctcaattctgtatcctcaactcagctagaccaccctctggcctgaaatctggaactttcctctagacaataagccacagtaattgtgggctcatcttgtttcctttttctcaagaatgattgtctcgtactggctgttgtgcaatatctgaaaaccattgttttacatattttgtaaagtgttctaattgtttgggatggtagggtaaatctggtttctgtttgcccattttggctggaagatgaagtgcccacaaactgtacatattgactagttctccactgtgtacaggataaagttcgaactcattagtttagcatacttagtacattacaagcagacttcatgacaatctcctacccacacctcacccacttctagtaactcaagacggcatgccacctcttgaccatatccatactttttcatgtcttagtgcattgcacatgctcttgtctttgtctaggatgactttattcccctgtatcttccatctttccaaatcccgcttgttcctcaagacccaactcaattaccagttcttctgttaaattttaccagacctgagtgttagttgctacaggatatgattttattatgttcttataacactattatagagtgtctttatttgacttacacacctgatggagatgtcttcatctcctcaagggcagtaacctcgacatcttattcacattttcatctctcagcctagcttagtgcctgacttaggttcttggcaaatgtctacttctgaatgaatgccctgtcatagtgcataatcttgctttctgaaaatagtattggcttgcttatttggaggcatgtgggaatgattaaaaaaataaaataaaacttggactggaatagccaccatggtctagcaggtgttctgtgttatgttaatcacagaggatgctgggcaggtgctggttcccttctaagcctttatctcagcattaaaacaattcatagccaatagctgggatttttctctcacagatggtggagttctgtgacttatgtctgggagaggtaagtgcaggaagagttgttccttggaagttccataaagggaatataatcacttccaaagcatcagcttcaactgaaagagctggaatcagctacttctggcctgaccaaagccagtatcttagacagctatgtctcaggtatgccctgaactgcctggggcatgtgtctcaggataatgtatattaaggattcaagattcttaactgttcttgaaggctaacaatttaggaaagagcaaacattttagaagcccacctccttattcaagatggagaagagtaatcagatatgtctctgaataaaacaaagtccaccagaatgttaaacacacacacacacacacacacacactcacacactcacacactcttactcttactctctctctctcttctgagtttgtttacttgcctgccagacaaaggagtatacactgtcaacaaaattcactgaatacttaatgggagggggtcagggtgaggaacaaaaggctttattcactagaaaagggcttcaaggtggttatactaagtagtgattgaaaactccctctctgaatggaaaaaaatgagttcttgtccatacatgtttggcttaatcatgtcccattttagaaagtaatctgtactttggtacactgaggttctgacataccagattactcacaattctgagtcctttatcagcttgagatgttggcttgctgaaagttcatggctgttcagtgacttcatctgattggaaacagttttgatgaacccaacactcagttttgacttcttctatgcacatgtagctataagtgtaaaattgtccttttatagatgtgatcatgtaatttatcccacgttgaatttgggcagggggcatacctgatttagcttggagaagggcacaacatgaactgtatattggtgggcgaaaattaatgatatttgatatatataagactctaaaaaatataatttatcaaatgctgaagaaaagaatttgggctttgcagtaaggaagacttagttttgcattgcatttctgaacatattcatcttaatctgtttttttcatataaaacaaaatatcagtcttatcagctaatgggaagattaaatgagatgatgtatgtaagcaactcccacagtgtcctactgtgtccggaatcggtgggttcttggtctcactgacttcaaaattgaagccgcggaccctcgcagtgagtgttacagttcttaaaggcggcgtgtccggagtttgttccttctaaggttcggatgtgttcggagtttcttccttctggtgggttcgtggtctcgatggcttcaggagtgaagctgtagaccttcgcggtgagtgttacagctcataaaggcagtgtggacccaaagagtgagcagtagcaagatttattgcaaagagcgaaagaacaaagcttctgcagtgtggaaggggactcgagcaggttgccactgctggctctgccagcctgcttttattctcttatctggccccacccacatcctgctgattggtccattttgcagagagccaattggtctgttttacagagagctgattagtccgttttgacaaggtgctgattggtgcgcttacaatccctgagctagacacaaaagttctccacatccccactagattagctagatacagagtgtcaattggtgtatttacaaaccctgcgctagacacagagtgctgattggtgcatttacaaaccttgagctagatacagagtgccgattggtgcattcaaaatcccttagctaggcataaagattctccaagtccccaccagactaactagatacagagtgctgattggtgcattcacaaaccctgagctagacacagagtgctgattggtgcatttacaaaccttgagctagatacagagtgctgattggtgtatttacaatcccttagctagacataaagattctccaagtccccaccagactcaggagcccagctggcttcacgcagtggatcccgcaccagggccgcaggtggagctgcctgccagtcccgcgctgtgtgcccgcactcctcagcccttgggtggttgatgggactgggcaccgtggagtagggggtggtgcttgtcggggaggcttgggctgtgcaggagcccacggcggggtggggggctcaggcatggcaggctgcaggtcccgagccctgccccacggggaggcagctaaggcccagcgagaagttgagcacagcatctgctggcccaggtgctaagcccctcactgcccgagtgtggggcccgccgagcccacgcccacctggaactcatgctggcccgcaagcgccatgcgcagccctggttcccgcctgcatctctccctccatacctccctgcaagctgagggagctggctccggccttgtccagcccagaaagaggctcccacagtgcagtggcaggctgaagggctcctcaagcacggccagagtgggcaccaaggctgaggaggcactgagagcgagcgagggctgtgagggctgccagcaggctgtcacctctcaatcccccctctaaacaggacaccccaactgctgttgggaatttggccgatgaccgctctagctacttcctgctggataggggcaaagaaggggccctgcagttgtagtgtcctccagaggggaactctctaggccagtggaagtgccagtggatcggtccaggggtccttggtagaagttgttagttgaactcatttggggttccatttgtaagaccatctgtagcttgatggcttcgatcctagaggaaacaaatttgacaagaaggttaaaaatacagggcccaaaggcgagtaacagcaagatggctgccatgggacctagaaatgggagaagccatgttgcccaactccagaggttggtataagagtttgaaaggcattgtctgatatcagaagccctttcctgtaaatgccaggtggcatctcgtactatccctgactggttagtgtaaaaacaacactcttcccctaagaaggtgcagagtcctcctttctcagcagtgaggaggtgtgggcctcggcggttttggagagtcattgctgccaaagagtctaattgggattgtaaagtaagaatagatttcattatttcttgcaaactgtctgagaaattctttgagagtgtatggtagtaggataatgaagtagataaaccggctattccagttcctgtagcagtagccattcctaaccctataaatagggatattagttgtatggctctgcactgacggactttagctttgacaggtaccaatagggtctgatttcctggggcaatgttaatgttgggacttagaaagactaaggttcaggtgcctgtccagttagtggggaggcagatataggttgatgttccacataagaagaatatgccttggctaggtagacagaaatttaccctggcttttaaaggaatagggtatactgttttttctttactacttctttctctcttcaagttcttctttgtttcttcctctctttttttctttctctgactttctctttttttctttacttcttgctggtctttccctacttctgccagccacttttgctgctgttttcccctctccttccccattttgatggctttggcagtgtaagactgccacctccttgtgtttttgcattgggtgcaataactctataatttccttgtggtatttaatggtggttgccccagaggttaggaactccctctctttccatattgcagcataggcatgtaggattagataagcatacttgctatctgtatacacatttattctttttccctttcccagttctaaggctcgggtaggtgccactagttctgctaactgggcactggtccctgggggaagaggcttactttcaagtatggttacatcactaactatggtgtaacctgcccttcgtatcccattctccacaaatgaacttccattgatatataggttaaggtcaggattagctaaggggacttctaagagatcatcttgggtggcataagtctggactataatttgttggcaggcatgctcgattggtttcccatcctctgggagaaaagtggcagggttgagggccatgcacatgcatatttgaagcaccggtccctcaaggagtagcgcctggtatctaagtaggcagttatctgatagccataaacttcctttggcacctagtatgccatttacatcatgagtagtccagacagtgagatcctttccttgtattattttgatagcctctgacattaagacggccactgctgcaactacccttaaacagtgaggccagccttttgctactacatcagtttccttacttaggtatgccactggttgtggggttgtcccacaagtcagtgtaaggactccaagggctatcccagcaatctctgtgatgtagaaagagaagttttgtcctgtgggagggcttaaagctggagcttgtactagggcctgctttaaggttttgaaggctgtttctgcctctggttcccattctactagatgagtatttgccctctgggtttccttgattaaagtatagaggggcctggctatctcactgtatccagggatccatagtcggcaaaaggcagtaattccaaggaacccccgcaactgttttaatgtcttagggtgaggataagccagtataggctgtattcattccttgctgagggccctggtccctctggaaaagattaggcctagatatttgacctgctgtaggcaaagctgggccttcgacctagacaccttgtacccttgattagctagaaagttcaagagatctacagtagcctgctgggacgaggcttctgaactggtagccaagagtaaatcatccacatattgaaggaccagagtgcctggacttcagaagtggcctagatcttgggccagtgcctgaccaaacatatgagggctatccctaaacccttggcacaagaccatccacataagttgggacgtgtggtctgtgggatcctcaaaggcaaagagaaactgggagtcagagtgcaggggaatacagaagaaggcatccttgaggtccagaaccatgaaccattctgcttcctctggtatttgagagagcagggtataggggttgggtacaactggatatagaggaattactgcctcattgatgagtctaagatcttgcactagtccccactgaccattcggtttttgtactcctagaattggggtgttgcagggactgctgcatttccttactaagccttgagctttcaaatgtttaacaatattctgtaatcctttatgagcttcaggccttaagggatattgcctttgataaggaaaagtggtgggatcttttaacctgatttggactgggcgggcatttttctcccttccaaattgtcattccaatgcccagacctcagggttgattccctcctcaagtaggggacaacaaatgggtaacttgttccccatattcatgtagataatagctccggccttggctaatatatccctccctaataagggtgtgggactttcaggcataacaagaaaggcatgtgaaaagagcaaagtctcccaattacaactgaggaggtgggagaaatacctggttacaggctgtctcagaattcctcggatggtaacggaccttgaggatagtcatccaggacaggagattaacactgagaaggtcatgccagtgtccaggaggaagtcaatttcctggccctcaatagataaacatacccagggctcagtgagggtgatgacatgagctggcgcttgccccaggcaccctcagtcctgttgttggatcatctggttgggggcttctgacccagggaaccttcatcctctggggcagtgcaccttccagtgattgcctcggcattgtggacatggatgagggggcagcttgtttctcattggacaatcttttttaaagtgtcctagtaaaccacactgataacaagccctaccaggtgattgacctgccccattttctgtcctctctgaaccaccagggtttgtttgtctgagggccatgactaaggctgtggctttcctctgatctcgcttttccttttgggcctgttcctcttggtccctattatagaacaccaaggttgccaggtttaataatgcctctaagattttgttcagggcccagggcttgcttttggagctttctcctgatatctgcagctgattgggtaataaacttatcttttagaatcaattgaccctcgagtgattcgggtgacaggggagtatattttcttaaggcctctcatagccgctcgaggaaggaaggattttcttcctttccctgagttatggtggacatcattgaataattcatgggcttttttctaattctccttagtccttctagaacacagatcaacagatgtttatgactccattccccatgatctgagtcaaggtcccagtggggatccatactggggatggcttgctgaccagtagggaatttgtcccttttttcagctgtcattctatcatttactgactaagataccaggtatctccaaactctcaggctgcagctaaagctgcgttcttttcattaaaggccagggtttgaactaacagtagcatgacatctttccaagcgaggtctaaggtttgccctagaccctgtaggacatctatgtacctatcaggatcatctgaaaacttccccatgtctgccttgacctgctttaaatcagagagggagaaggggacatgtacccgggttgggccaaattcccctcctcctgcagcttgaaggggacataaccgataacctgggggtctttgtggtcctttggagatttctttgcttatttccttctgggcaggggagattagaggaggattatcattagtaggaaggggagctattgggaggctgggatatgggggtaagctgagaggtcctcctgtgggatgtaaattgtaagctttgcatagttgtgtattctccctcaatgaaaagaaagcttggatgtaaggtatttcactcgatttgccttccctcttacagagaaggtcaagctgcaggatagtattgtaatttgtacttccctcaggtggccatttttccccatcagagagaatattggggccaagccatagtgcagaaaaaaatgagccacctctttttcagggtttatgggtcaaattggtcccaatagcttaggatgcatttcaagggtgagcctgttgatgcctgagtgtttcccatctgaaagacaaaactgcccatggttttgatttgttttgtttctccccctgcccaagaacccacaacagtccctggaccctgctgatcggaatagttgtgctcaccgacgcagcagcagaaacactagttttcctcccagaccacatggaggaccaaggaaggttggatttagtggcctttaccaatgcattctcaaaaacctgcatccttgcctgtcctcctagaccacaaggaggactgaccaagaaaaatcggatttagtggcccttaccgacacattctcgaaaacctgctagagtcctaagcattctcctgttagtattgggacgttacccctgtcctataaagatgttatgccccaaaaatgaagtggagggctatgcccttagggagggaagggatctccagggttggaatagcgacaccttttgtcctcacttatatgaataggaaggatacaatttctgaggctccccatattctagcttcaggaataggttttgttaggcctgttagtctgaggagggatcctaaaattccaagtagtccccaggacaatggggctttgggcaaaaattatgtctttctgattggtgagcccaggtgcctaaagaaggtaacaaagtcctggagtttatactagaaatcatttttatagaagaaactagaaaagcaccagagacaggtagcaatttttagaagcgggactaaccttggagaagagaggcaagaggaagtttgtctggcaggcattaggacccagggggcaagggtcaggatagataggagagatgggcgagtcttgcttgggcaacatgcctttgagagttccactcatggccgcagggtcaaccaacttgttgtcgggaccccggagctgcatggctttcctctctgtcaaccctaggctcagcccagaagtacaagaaaagtggaagctggttcgaggcacaccaacgctcccaactccaaagagtcgggggttgttagagagccctatcccagaaaacctgacacccatgtctttagtctggcggccacgctagtcgcttttaactggccgacaggtacccggtatttagccccggaattctaaggaaaaataggacagaatagcaagcgaaaggggtccaatggtactcactgcttggcaataggcgattgtcttgccgctcagcaataggtgatggtctcaccgcccacgcctctccctccacacctccctgcaagctgagggagccagctccagccttggccagcccagaaaggggctcccacagtgcagcggcgggctgaagagctcctcaagtgtggctagagtgggcgccaaggccgaggaggcaccgagagcgagtgagggctgcaagggctgccagcacgctgtcacctctcactacctgcttctcatgggataaacagtgaatagctgatagcttttctgtggtgcaaacccccacctacatgtaccccacatatgtgcgtgcctccactgtccttgcataccctcctgcactctttgcctccttctgacaatgtcccttccacttctatacttgcaccccccttttcatgtataacttatttcttgtttctccctaaaaacacactatttgcagatctaaaatattaccttaattcatagtcttcattaaaattagattctattgtaacttcagtacactgttcctgtttattataagattctgaatgcttggtgttggaaataagactgccctgaggaaggcaaatcatcaaatgcatctgcaaaacagttttagatttgggaacatcagagaactagcatcttagatgttcagaaccagtgagtattactcccttcatcctctattcccaatacggggccctacatggcctatggcataattctaattttactcaaatggcaaaggccttctttgatacactgagaacactgtggaatatttggtacttgttgaccaagactgggagatctgtccttctttctgtgcacaggagaaaacagtcatatttgagatcaaggaatttgtgcaattataaaccaacaaatgctcaacttcccataaaacaagatggagaactgggtgccctatttcattaaaaaaaaaaaaaaagcatatcctttgagaatatataagaatcctggatatctggccctgaaatctgagggactttcttcaccattttctcaccaaatctagtttaaagctttctctagtgcatttgaaaggagtgacaaaagtacatggtacaaagtggcttagagtgactgcaatgttgttttgcaacattttaggcaagattgggactgtaatattcattattgtttgatatagtttgactctgtgtccccacccaaatctcaccttgaattgtattcccataattcccacatgctgtgggagggaccaggtggaagatgattgaatcatgggggtggattctcccatactgttctcgtggtagtgaataagtctcatgagagctgatgattttatcaggggtttccactttcatgtcttgctcattctctctttgcctgctgccatccatgtaagatgtgacttgctcttccttgccttccaccatgattgtgaggcttcccgaaccacatggaactgtaaccaattaaacctctttcttttgtaaattacccagacttgggtatgtctttatcagcagtgtgaaaacaaactaatacactgtttgttcaaaaagagccatccattaaagatgtgtacagtgtgaaacttatcaaagagggaaaagaagactgcagtgtgactgggacaggatacgttatgctgcaatttaaaaaaatgaatcctcaaattccagagtcttgaaacaacaccactcatttgtcactcatagtacatgtccatcactggtcagcagggcattctgctgcatgtacacaaaggcccaagctgaccatcttacagctccttcatctggaaagcacatcttcctcctcagccctgccagcaggagaaatgaaggcctttcaactgcctcagcttcttctatctctccattcttcctgaaaacttactatccatgggtccaaaagatgatctttattcatattcctcattgggagaatggaaattgaagactgaccccctcctttctgctcatattttgttagcctgaagtagtctatggtcatgattaattggaagggaaccaggaaatgtgtgagaaaaatggaatggaatatttgggacaacagtattgtctttgcctcagcctgctcttttgatcactgaatgtctatttaccccccatattagtccatttttgcactgctagtaaagacatacccaagagtgggcaatttacaaaataaagaggtttaatggacttaacagttccacatggctggggaggtttcacaatcatggtggacggcaaggaggagcaagttacatcttacgtggatggtggcaggcagagagcttgtgcagggaaactccccttttaaaaaccatcagatctcatgagacttattcactatcaagagatcagcatgggaaaggcctgcccccatgattcaattacctcccaccgggtccctcccacaacaggtgggaatttgagatgagatttgggtggagacacagccaaaccatatcatttagtccctggcccctcccaaatctcatgtcctcacatttcaaaaccaatcatgccttcccaacagtcccttaaagtcttaacttatttaagcattaactcaaaagtccacagtccaaagtcttatctgagacaaggtaagatccttttgcttatgagcctgtaaaatcaaaagcaagttagttactccctagaaacaatgggggtacaggcattgagtaatttcagccattccaaatgggagaaattggccagaacaaagtggctacaggcctcatgcaagtccaaaacccaaaatgatctcctttgactccatgtctcacatccaggtcacactgatgcaagaggtggcttttcatggtctttggcagctctgcccctgtggcttggcagggtacagcctctctcctggctgctttcacaggctggtgttgagtgtctgtggcttttctgggcccatggtgcacgctgtcagtggatctaccattcattctggggtctggaggatggtggccctcttctcacagctccactaggcggtgccccagtggggactctgtttgggcgctctgaccccacatttcccttctgtactgccctagcagaagttctctttgagagccccgcccctgcagcaaacttctgcctgggcatccaggcatttccatacatcttctgaaatctaggtggaggttcccaaaccccatttcttgacttctgtgtatttgcaggctcaacaccatgtggaaactgccaaggcttggggcttgcaccctctgaagccacaggcaagttctaccttggcccctttcagccatggctggagcagctgcaatgtagggcaccaagtccctaggctgcacacagcacaaggaccgtgggcccagcccatgaaaccattttttcctcctaggcctccaggcctgtgatgggaggggctgcccagaagacctctgatatgccctggagacgttttccctattgtcttggggattaacatttggctccttgttacttaagcagatttctgcagctggctttaacttctcctcagaaaattggattttcttttctattgtattgtcaggctgcacattttccaaacttttatgttctccttcccttataaaactgaatgcttttaacagcacccaagttacctcttgaatgctttgctgcttagaaatttcttccaccagacatcctaaatcatctctctcaagttcaaagttctacaaatctctagggccggggcaaaatgccaccagtctctttgctaaaacataacaagagttacctttgctccagttcccaacaagttcctcatctccttctgagaccacctcagcctggactttgttgtcctattgctatcaacattttgggcaaagccattcaacaagtctctaggaagttccaaactttcccacattttcctgtcttcttctgagcccttcaaattgttccaacctctacctgttacccagttccaaattcgcttccatatttttgggtatattttcagcaacactccactctggtaccaattttctacattagtccgtcttcatgctgctgataaagatttacccaagactgggcaatttacaaagatagaggtttaattggatttacagttccatgcagctgaggaggcctcacaatcatgggggaaagcaaagagaagcaagtcacatcttatgtggatggcagcaggcaaagagagagagagcttgtgcagagaaactcccctttttaaaaccatcagatctcgtgagacttattcactatcacgtgatcagcatggaaaagacctgctcccaagattcagttaccttccactgggtctctcctacaacctgtgggaatttgagatgagatttgggtggggacacagccaaaccatgtcacttccttattctcaatttccatagacaaccaaaaagttcaatttgatcaatgcatctggcacccattccaggatcactgagtgctatacaatagtcactatatcagattaggacctggctcttcttggtctgcagatctaagagctaagaagacaagttttctgctgcccatataactagtacccagtggaagaacaagaacagattaacatcaataaacacattctggaaatccaagaatggaagttatgagccttcactcttctgctttattggcctcttctcactagaaagaaggagctcttcttccactttctggcttttttctgctgtctgaaagggatctcatagttctaattataatctatcccactgcataattagtgtaaatgatgttaaagtgtctggtggggaggagagaggcgagtatctttgaaaggggcaaagacatttcccaaggaggaagaggtcatggtgggaacccaggtactgctttggcaaagttttatgcggagggagaggaaccccacagggttggcttagtttgtatctcaggacacccaggggaactgccattccacctgtttttcctttttcaaggctcagtctttcctttcttcttccctgcctcccttacataattctggagcacacgctgtgtgcagacagcccttggaagtggcctgtggatttttcagggaatacgtgatagttcttaccctgttggcaccaacagtctactgggagaaataattataatattgtatgataattcttaaaatagaaatattatcaatgtaatctgggaggagagaaaaggaaatggccagccctagaacatcggtttcttcagtgaactctttattaatttctgtggtattgtgctctcctgaatccttatctcaagaaattatctgactctttgttttttgaatgtgctttctctgtctcatatctttgtagttctttttaatatccagaggaatttatcatgggtctgtttttgtcctctagggttcttcaaatcttataaactgatgcagtatgggaatttatggaaaaatatataagtagctcatagattctagcagcagtgaaaaacaagacttggaaaatggcttagcagaagagaagttcctactccagtaagattctgggtagggcattaccgtgggaaccttgacactagagtggtggttgctgggacatctctcaactctttctgctttgagtctccaattcaacacaccaagtcctgagtggaagcatctaattgacctcaccttgatgtgtgtttacatcctggtcactagagggtagggggagggaataactgacttctttgctcccatagtgaggggtggggccctgctcccaccaagatccacacagtaaaggttcttccaaaataggagagtgtttggatattgaatatatagacaagcaacttctccctgtgtcattgcctgcctccattttatcagaaaattctgattcatcccggttctataacaacagctctgaccatctactcctgtttttccaaatgcattcggggcatcctcttgggtgctccatggcatctaaactcacataggataatgaccaggcacatcattcttcttccccttctcagactgtttctttgagaatcacctgagaaatgagttaaaaatgcagatttcctagacttcctctccctcctctgcaatgctgatttttgagcttctggaggaaagccgaggaatctgccattttcagcaggtagcccgggagattttcagactaataatggctatgctctttgggaaacagggttttcacctattacaaatttttgccaatgttttctctgctgtatctctcaagtcttcccactctattccctaaaacagtatgtcttctctattgcaaagactactttcacgccatctttattattggctttatactgtatatgtcccaccatcaccagtacagaacttctcataggcctctctacctattctgtggcgatagcatcagggagagccagggaaactaccttctactttctgcatcccttggaatttgtctggatttccagaaattgagttttgtgtggctgtttcggttgatacagtatgagataactggaggccgggcttggtggctcatgcctgtaatcccagcactttgggaggctgaggcgggaggatcacttgagcctaggagttcaagaccagcctgagaaacatggtgagaccccatctctataaaaaataagaaaattacccgggtgcaatggtgcatgcctgtggtccaagctactggggagactgaagtgggaagatcacttgagtccaggaggttgaggctgcagtgagccatgttcatgccactgcactccagcctgggtgacagagtgagaacctgtctcaagaaaaaaaaaaaaaaagataactagaaaggcacaggtactgaccatttagaatggatactgaatagaagcaataggtgactgatgcaaaagtggcctgaatcctcatcatagtaaacagtaactctttgactagacttctgtttctgcaacccaacaggttttcactaaggcagatttgcacaagtcatgccataagtcaaattatttgtccatgtgacctggccctgctcaagggatgttctgtatgacctgcggtgaatattcactctctcgtttgggcacagtatgggcacattatgatccagcccttatgatctcctttggatctttcttttcaggcatgatggtttaaaggattgttttgtaccatggaactatccatagaaaattattttcagggttcttctattgttcactagcctggcttaaaagtatagctttactttctgtctttacagtaagcgagaggttagaaggatatgcttgaataaggagactgccttcctctacactgccagtattttattaagagtattagaacattttctttgtcttgtattttatatattgatatgattttatgtcttctctcaccttgaaactttcattgtagattttaatttaaaaggtgaagaggtaggcctcaatttccttgattcttcgaactctgagttggaagatgatggtagtaaatcattggaggcttagaggtgagagagtaccatttgttctgggaggattctacgtcgtaaatttgtacttagatgtacaagaatgttaaacaccaaagaaagaagcctacatgatctctattctcgaccttgagcaaggattagcattgtcctgggcagcctgtaggaacacacagtatcactgctcccttgcgtttgtacactaaagctttgctcttcctggtcagtcagagcagtacaaccaacagctgaataatatgggaacttatcctgagagcttccaatctatttaacaacatacatattaatctaggttcacatattcatattatgtgagaaatactatctttccttttttttttttttttttttttcgagacggagtttcactcctgttgcccagggtggagtgcaatggtacgatctcagctcactgcaacctctgcctcctgggttcaggtgatcctcctgactcagcctcctatgtagctgggattacaggcatgcaccaccacacccggctaattttgtacttttagtagagacagggtttctccatgttggtcgggctggtctcgaactcccgacctcaggtgatccatctgccttggcctcccaaagtgctgaggttacaggctactatctttctttatgttctccaagtcagtctaattttgactttgtaggctatatctctccaggctggcaagaaattgggcatgtcatgctgagtgtttctttgggtcctgggccttatacagaagagactgcctgcttgtctgttatttgtccttatagatcgtcagagacatctgctctccttgtctacacattctctttaggtctgagatctctctgcttaggaaaacaagatattctgggccgggcacgatggctaacgcctgtaatcccagcactttgggaggccgaagcaggcggatcatgaggtcaggagatcgagaccatcctggctaacacggtgaaaccctgtctctactaaaaatacaaaagaaaaattagccgggcgtggtggcccgtgcctgtagtcccagttgcttgggaggctgaggcaggagaattgcttgaacccaggaggcggagcttgcagtgagccgagattgtgccactgcactccagccagggtgacagagcgagactccatccccccctcaaaaaaaaaaagaaaaagaaaaagatatctgtaaactgtaatctgtaaactggttcagtggttctatctctgtagaagcagcacagtcctcttctctgaggtcttgcttctcctcactgacactccccacctcctcagcccagggacagatctttcttttatgaagctccttcctgctgtctgctttcccactccattctacaatttccctcaaaccttgttcttacactgaatcattaacgacaaaaatttagtttctctttccttgagaacacaaggacaaaggctcagaaattgaggggtctatttgcatcttatccttctagtgtagcaaagaaaaaaagaaggctgaaactagaagtctcatatcctaacaaccaggcatttgttgagttcctactatgtataacactcaatacgcattccttcttgtgaattggtgctgatggtagctcaggcactctgttaagcattgaaggcatatggttgtccttgcctacatcaggtggggttcagggtgcagtcaaaaaaatcaattcttgcaaatttaagcaaaaggggctgggtgcatcaaagaagtccccactctccctccaccgccaaaaaaacaaaacaaaaaacaaaaaaaaccatgatgtggagttagccagatgaatgagagaaaacacttaagaaatatgtagaggccaggtactggaaatgaagaaaggcaaataacaatgaataatctaggctctgccctcaaagggctttacagcttggtgaggaaatggacctttatactcataatacaaggcaatgaatgaaaggaggcaaagctagtcacggttcggcttggaaattgcagcatcagggcttttagaagaaaagttggtcttgagcagcatataacctttaaatactaacacagtggtggagctgatgttcaaattgtctggacagatcaaatctgtctggacaagggagaagagagtaggctgccttgcgtaaacagtagaacattctaaatggagaagccattttaaaattctcttccttgaaaccttgtctggtcagtggcaaaatgtcatagctgagtttggaagattacataccatttgcattgattaaattatttttgttaatcagggcagttaatattaacagtgtaatgctacatgctggatggatgtgttgttatgtactattgctacttataaaatagcaacacctgatcaatttggaagaataacttatattaaggtgttcatctgtattttagcatcattgctataaacaaatcagaaagaatggaagctcttatttctttgtggacaactcaatcctctcaccccacacgtcaacattttctttacctaacaagcagaaatttgaacccaagaccagggatggtgacagtggggtctttgctgtccctagagcagatttagaggagtgcactccctcaaatctttgaatcatggtgtggaggaaaaaggtaagggctttgaagaggctgatgggccaaacctggaggatagtttatctgcaatgagaaaaggggtaagttcatgacaccatttctttctctcgttttttgttgttagtttttatctcatgatcataaacttaaccctgcaatccagctagatgtggaagagaataaggaaaatatggaacccaaagaattatagcaagagcacaacgattataggatgctgagagcaaatagggtagaggggtgctctcctgagctacaaaaggaatggtctggtagctaaggtaaaacacaaagcaaatttattagatttgtccacagtcagcagtgatgatcttcttgctggtcttgccattcctagaacagaagcactccatggcttccacaatattcatgccatcttttaccctgccaaagaccacatccctgccatccagccactcagttttggcagtgcagatgaagaactgggaatcatttgtgttgtgtccagcatttgccatggacaagatgccaggacccataggcctcaggatgaggttctcatcatcagacttctccctgcagatggacttgccaccagtgcccttatggtgtgtgaattcaccaccctgacacataaaccctggaatcattctgtgaaagcaagaacccttataaccaaatcctttttctcaagttcttagaacaagactgttttctgaggtctttggaactttgtctgcaaacagctcagaggagatgctgcccaggggcttgctatggcgatgatgaagaacactgtgaggttgaacgtggctagtggcaaggggctctgggtagcatgggtggcatacgcaaatctcccctcatgactatttcatgtgtgtatgtatgtgcatgtgtgtttgtaatctgtgaatggtaaagatccatgccccatttacacattacttcttatttggttaatagaattctgtctgatgtgtgaatgcttggggtggggataggagatgaactctgagatccatgctcttgaggcttatcaagaaggattgctaggcctaagcttagaataatgaaatacaccacctatctgtgaatgaatgatgtgggctcagacagtaagcatctcagcagcagtctgcactaaagattcttatgccccaaacattactgagtttgagtttctcaacatgctggtgcatgagagctaaagatcacatttaatttgattcaggtgttattaccaataaaataatctataaaaaagttgcaagactgcttgcaagggtatgttaaaatgaagaagccaagtttttttttttttttttttttttttcgagatggagtcttgctttgtcacccaggctggagtgcagtggtgcaatctcggctcactgcaacctctgcctcctggattcaagtgattctcgtgcctcagcctccagagtagctgggattacaggcatgcgccaccatgcccagctaatttttgtgtttttaatagagacagggttttgccacattggccatgctggttttgaactcccgacctcaggtgatctgcccaccttggcctcccaaagtgctgggattgcaggcgtgagccaccgtgcctggccagaagccaagttctaattttgaattctgtaaatacttagagctttctgatgtggctatggaatagactggtgtccaatagaactttctgtgatgatggaaatgttttagatctgcactattcagcccagtagccactatatgtggctatttaaacttttaattaaaattaaatacaattttaattcccaagtcacactaaccacatttcatgtgcttggtagacacatatggtagtggcttccatattggataattctggaatcaaaagagtcttctgtatgggtgatctttatagctggtatttgggaaatagttttcaacttttctgctaactctgatagatttatcaaccagaagggtctgcttgaagcattgtgtgggaaggacttgcaatcatatttagatacactgagagagaatgttgtggtagatggtaatctgagtgtgagaatgaggtacagtgctatggtttaattatttaccttttctcattttcaacttttcctcacatcagagagaccgtgtgtgttgagcaaacctttcaaaacctcgcttcccgtgtgatcctgcttcccatccgtttggttcagctgtctcgagacatctgtttctactcttcgttaagggtggggacagtgacagtgagtgcgcccccgtccctatccccacaaatcatatacagttacacacagagtgtactatagttgatcagcaaacttgcctgtgctgttctctcttgcagacttatatgtcggatcctcagagaagactcaggcaaatggaaactgggcaggcaagccttgattacaaggaggagtaaatggtgaaggaaagaaccgctttttctgtcctcattcccctataaaatttacatttttcccccactaagaacaacagtaacatctctgctaatattatgctaccatgaactaacatcttcctttctttccctattttgaacccttgggtgatttgtctggccatcacacatcgtgatttttgaaagaattaagtacattgacctctcgctgttagcatttctgtagtttgctcaaggagtttatttggggaaggggagaggaaaggttcataggaataatttctttttattttactcccttattgtgtatgagtcaattttttccccaatagctatgaccttcttacaataagggaccatcctgcaagtaaggatgtaaagtatgagtctatttttgccccagtagctatgaccttcttacagtggtgtctagaagagaggttgacaaaagccaacatgcaatataggatttattgaactgaggtgcctgggatttaatggaaagccttgtattttaggactatgtcaaggatacactatctgattttctcaacttccatggctaaatgaagattatcagagacaggaacccaattcaggctggactgccaacagctacccgagtcgctgttaagccctggtaccctaataatgccactggtatcaatcccccattttttcagtactttatcattaggatactgttcatagggtttgcagatggtgggcccactgaactgagctgaaaatatagatgtctacctggccaacaagtagtggaaatagacacactacttgtatgtatgtggaatatacaaatcatagtttagtaaggtttgactgccacctggtgggggaaattctgcagtatgttcatttcaatgtcaaaggcataaataagactcaagtcattagtcacctaactgtaggcttggatgcctaagatattccaaaatagttcagttgccttaaaggaattaaagacttataattgtggttgtgttagggcatgtgcctgctatctgcaaatatgattgctcattaatcaagtaaaactcaggcaccagattcattgtcttcgagggttctttccagctctgaggttgtgtcagtcttcacctagactttgagaataaacttgaggccagaattattaagattcttattgccagctggagctaacatacatcctaccaattccaagccgggtgtgaaatctcctagaaaccacccactcttagatctcatggaacaaattagaacaggaaggaatcctcatctctctttatcagaaaatagccctgtaagcaaggagcatgtaaagaagtagaatggaaaagcaggcaagttaagttttaacaatgctaagcacctgatagattttccttaagttgattcttttttttttttttttttaccaatgtctgaaaaaaaaaaaaaaactacacaaaacaaggaaaatgatctactttctttgggttgtggaacaatctagggtataaggaagacatctttatcttgtagaatgaccagtataacaatatgttgtatcagatttatacccttcccagatttccttgctcccttttcctgggccactggctgctggctccatgaagagtcccatcacttctgtcccctcatggaacatcactgtccaccttgtcttcctccaatgatgaaggcccagtttaatgggcctagtcaggtcaggtgtgggcaccaacgccgctgcagcttccactgtgccaggttcagtgagagccatgctggagcctaccttcccctgggagaggccaagggagatgtcactgaagtgcctggactcagcttcctcactggctgcctggaagaaccagtgacaaccctagtgaaagtgcagtggtaggcgctgggtcataggcagagggatttgcttgtgcaaaggacttgggagagcaaagagagttcagagaactgcccattgtcggcgtggctggagtgtgatgagcagatgggagaggaaggcagacagatgacacaaggctttgcaggatgaccttgaaccttagcccatgtcattggtaagctatgtaagcaaaagagtattgcaagcaggtttgtggtttaagatctggctgcatggtagggacatgattagagggagacagagcttgagaaagggagataaggagatggttgggggaatggagactggagatgatgggggcactacgtggtggcaattgacttgtagtcaggtgaccaaaagtcctgttctggctctgtcactaactttggttgaattatttaagtcttctgctgttccatgttctcatctatgagtcagagttaaaactacctcagctgggttcagtggctcacatctgtatcccagcactttgggaggccgaggcatgcaaatcacctgggctcaggagtttgagaccagcctggccgacatggtgaaaccctgtctctactaaaatacaaaaattagccaggcgtggtggcacgcacctgtaatcccagctacttgggaggctgaggcaggagaatcacttgaaccctggaggcagaggttgcaatgagctgaaatcacaccattgtactccatcctgggccaaaagagcgaaactccatctcaaaaaagcaaaacaaaagaaaacaaaaactacctcattcctagtcttgaaaattaaataatttgaatgcacttactaataggtgcttcataaatacgatttgggtgtgaaaggtgtgaggatggagtggcctcccctgagttagcacagctgtcaggccagctgagcacagccaccaccaagacctcactaaagtaggccctaggttttctcaagataacaagtgatttacttggatgtaaggagcgttatctgtaaatactgtctccacaggattaagggggcagaacgattgccggtgatagaaatgtcaacagcaaaaggccagtaggacactagaaacagcagtgtcaggatgtgccagctggcatttgctgcacgctgtgctatgagtgtgtgagcacacagataaacattgtaattaaccatcctggggtgatagtatgttcatacagtcaaaacaggtgatagattcgaaatgcaatttgaacttaatcatttgggtggggtgatttcagagtcaagtaatttagcaaaccatttttaaagggtgctaattaaaaattgcctggggttatcaatttgctgccagaactgcagaaaaatgggcatggaaaaatttcagtccagctaattattggctaaagcataagacttgattaccatgtcaggggaattttttaaatggggatattttcattcaaagcttttaattttttaatttaggggaagaattattgagacaatagaattagatatattgagagactatactcccggggtgagaaagacacagtatcttatttgctttattttgttcatcattaattatatctagtgtcattaaggcaaataaatttttgtgtactggattgaggaaccttggagtcctagtttgcagacgcttaattgtctgagataccactgaaccctaaaacacaagtgcacagttatggtgtttatttcagtcagcagagtctcagagtttgatgagagcatttagtgtgctgtgagggtggctgatgcaattcttcttggtgcttttccactttcctatagatattttaaaagttaggtgtccaggaaatctcaataagaatcagactgtgaagtttaaaggggacagacagcatgatggtcttattctgtgctcaactcccagtgcctggcatatgggaaattctcagcaggcgtttgctgaatgaaggaatgcacctgccctgttgctctagagccttgggaaacatctgtgaaaacaacaaaagtcgctgccctcatggagattacattctagcaaggggaagagaggtaatataataagtaaattatgtgggatgctaggtgacgaattctttggaaaaaataaaattaacactaagtaaggggcattgaaagtgccagggatacggtggggtggagttgggttagtgggcctatttctttattcaatacgaagctccaaggaggccttgttgagaaagtgaggtttgaaaaatgatatgaaaatggcaagggctctggctagacagacatatggggaggtgcattctaggcagagggaacagctagtgccaaggctgcaagggttgtgtctgaggagtaaggaggcctgtgaagcttgagcagagtgagcagagggagagcaaaaaataagattagagaagtaatgaggggagtcagtcaggctatctaggacatttcagtccattgtaaagactttgcctttcttcctaatcctaagcaggattttaagtagagaaatggcatgaccggctgtggccactgtgctaacagtcaggaaggagctcagggtagaagcaggaaccattgggaggctactgcagtcattcacaagagagaccacatggcctgaaccagagtgatcatgacagagacagcaagaaggagtcaaaatccattttgaaagcagaactagcaagtgcaagagaaagaggaaatcagaatgactccatggctttgggcttgaaaacgagaaggatgggattaccagcaattgagatggggaggtaggagatgacacaggcttttaggagaagagtactggtttagtcttcgacatgctgagtgcgaaaagtccatcagatatcagagtggagatgacaagtagaagattcagtatgtgactttccatgcatacgttgttggagaccgtatgtactaggtgtgaccactaagagtgagacacaatgaaaaataaaagaacgaggccttacctaggagccgtcctacattaaaaagctggaggaaaagatgaggaaccagtgaagggtacagaagactgaccagtgagatagatgtaacaccaggagagtggagagtttagtgtcctgggagtcaagggtagaatgtgataattgtattaaatattgatgagctatgtcaagtccattgaggactgaggcttgaccactgactttagcaatatggatgtcaccagcgcccagttgttttggtggaatggggaggacaacgcatccttggagtgggtttaagagagaaacaggaggggaattggaactagagtgcacttagacaacatttaaaagtatactgcgaaggagaataaagaaatgagttggtggctgataaaggaagcagggccaataaaacaatttaagatagtactttttatgccaattggaatgatccaggggaaaggaggacaaaacccatgatgtaggaaagagaggggcagattgcaggatgaccctgaagggaccagaaaggagaactgtgcacaagtggatggccagctttgatgggaacggtggatggttcactatggtaacagaaggaaaggcggcaggggcagatgctggtgggtggagaatgggatggagtctgagttcttttttgattgctacaattttctcagagaagttggaagctaggtcaccaaatggaagtgaggagttggggaagacgtactgaaagtctgaggaagaggagcagccatgaaagagaaacaaagaaaatgggagaatgaatggattggggacatgcagtagaattgccaggcatcattgaagacccacttaaaaaaggtgtatctggatgtgtgcatgcaattttaagtgaggtcagtcgtcacagttgtcatgttttgtttttgtatttttttttttttttgagacagagtttcgctctttttgcccaggctggaatgcagtgccgtgatctcagctcactgcaaactctgcctcctgggttcaagtgattctcctgtctcagcctcccgagtagctcggattacagggatgtgccaccacgcccggctaattttgtatttttagttgagacgaggtttctccatgttggtcaggctggtctccaactcccgacctcagatgatccacccgcctcggcctcccaaagtgctgggattacaggtgtgagccaccgcgcccgggcccttgtttttttttccttattccccccagcaattttcaggtgcaggagagggagagggtgggattgtgattgggtttcgcctggtgagcctgagtccacgggataagcaatagcatgattctaactgaaatggagtttgcacagatgcttaatgattgtctgttgaatgaataaatgatttaaggaaaagctgaaactttataaaaaagaaaaaacatgtgcatgggaataataagtgccatctcaatgtctgagaaattgcagaatgagtcagacgatgagggtcttcgtgctggctgctgttctgtgtgccctgtcagcctctgcctattcctctgtcctccttccgtggcctgtctacacgtttctattcatgaggaccttggagaattagattgtgtctgcctctatgggccttgttgagcctctctgtttctgtgaatgtcttcataatgtttgaataataatttactgagaaggtttatttttttcttacatatattttaaatattttaaatcatatacaccagtttttaaaaattctgatttataaacatacatgtaacctatttttacaaaatatagaaaaatgtagatagatttataatgaaaaagtttacctacaatatcatcattcaaagtcaaccatgttaaaaattaaatatattctcttccagtattggctattatttacataaatgtaatcaaaattacatatgcactgtatcctttatgctcttagtattagtctattataaatttctcacaaacattctttttactggatacataaaatcccatcttccacttctatagtaacttcggtgttaataatttaaggtaggccaggcacggtggctcacgcctgtaatctcagcacttttggaggccaaggtgggtagatcacctgaggtcaggaattcaagaccagcctggccaacatggtgaaacctcatctctaataaaaatacaaaaagttagccaggcatggtggcaagtacctcaggaggctgaggcaggagaattgcttgaacttgggaggtagaggttgcagtaagctgagatcgcgccactgaactccagcctgggaaacaacagcaaaacttcctctcaaaacaaagcaaaacaataatttaaggtaattctgtcattccgagtggtttagagaagggaagcaaactttccactctcttcttctttccctatctcctgtgcccacagtgaatgctccactttagcactatctgcagtcttccccatctgtgttcccatgtacttctgcctctttttcttcctcttcccatgtctctttgactcctggctcctttctctcatttgtctcctattcatttaccataatgtaagttctgtgagggcatccttataccctaatgtctgtcttacagtaggtactaaaatttgcatgtaaggacaatgatatgtcaacctggaatatcccatttaactggactgtggtttattgaaagttaacttctaatgaaatggccagggttagtttcctgccggggactgtggaactccatctacccagggaaactcatttttatctacattcttgcatccatagtcttacagagagcaaactcttcagtcataaatcttctacttagaaacctgaccagtagatgcagtattggtaaattttcaatgaggccataagaatgcatttacaaaaagtacaaagttaaggttgcttgtgatgattttagctaatcagcacaattttagcaggaagcagatacatctgtcctttccctcaaacttcatatagctataaaatattcaatttcctgaaggagttactcaacacacaaacttggagattaatttagaggccagatccccacaagcatttgtctagccttagactgaacaacttctgttgccgggagcttgccatgtctagtgggaatgggtctgttctgtagttgttggatggaaaaattgttagcagagtcttttttatgttaagatgaaaagtgcctcccacagagtcaacaaaaaggttctggtgtgtggaattttttaaggatgctaaagtatgaataattggaaactttagtaatttgaggcttctgtgatttctctaattctttgtagtcaatccatttatccgatcccctttaatgctaacattatttacttgattttagttctgtgaagctttggctcttataaatgacacatctaaccaagggaatggttaagccttagagcaacttgtggaaagttttcattcctcaaaacaggaatgaataacaatggcctcgatatgactaacattattaatgtatttatatgggtacataattactagcaatatctagagcattatgaaaatgatttgcatagccacttcttaaaatttagggcagggaggccgaggcgggcggatcacaaggtcaggagatcaagaccatcctggctaacacggtgaaaccccatctctactaaaaatacaaaaagttagccaggcatggtggcacgtgcctgtagtcccagctacttgggaggctgaggcaggagaatcacttgaacccggggggcggaggttgcagtgagccaagatcatgccactgcactccagcctgggcaacagagcaagactccgtctcaaaaaaagaaaaaaaaaatctctatcctatatctctcaagccttgaaaataatatattggcttcttcatgatttaatccagggcttcctcatgaaacttattgctcaatgccactggaatgcaaatattccaactgaccatgctgctcagttccttgcaatagaattgaataaaaacttggattaaaaggtcaactttaaaatatgcctaataaattcactgactaaaagctatcccaacaactttctgcatcatttctcttcatctcattattcatgtaggcttccctgaattttaaggaatgcaaataaaagagcagaatgtgtggagcactggggcctaggacattcttttcatgaatatggaactaaaggtagagtgaaaggtatttcttaaataaattacgttgatatggtggagagagtattgatggatgcttatgtattttctatagcacaaaaaagtaaaactcatatattattctaagaatcccttattttatgtccttcatatatttggtcccatagctataatattgggagcctcattacttcaaaatgattatttttaaaatttcctaacctatgatactaaaattattggggttattcagcaagttgtcgtgggacaaagcatgggaatttctataagggagaggtgagcagaatgtcataatattacataaaaagctttctcatgcattctacaaatagttgctgagtaaccacgtgttaataaaaaaagtgatataaaggtaacacttttggaaggaatgagatcatgtccttttcagggacctggatggagctggaagccatcatcctcagcaaactaacataggaatagaaaaccaaacactgcatgttctctctcataagtgggagttaacagtgagaacacatggacacagggaggggaacatcacacaccagggcctgctgggggttggtgggcaatgggagggagaccattagggcaattacctaatgcatacagggcttaaagcctagatgacaggttgatgggtgcagcaaaccaccatggcacatgtatacctatgtaacaaacctgcacgttctgcacgtgtatcccaaaacttaaaaaaaaaagaataactataaaataagaattctaactcaaaaacaaacaaaaaagaattattatgaaataaagaagaattctaactcaaaaacaaaacaaaagataactttttcgggaggctgaggcaggcagatcgcttgaacttaggagttcaggaccagcctgggcaacatggagagaccccatctctacaaaaaaaaaaaaaaaaaaaattagccaggcatggaggctcatgcctgtagtcccagctacttgggagactgaggcatgagaatcatttgaacccaggagatggatgttgcagtgagctgagatcgcaccaccgcactccagcctgggtgacagtgagaccactgtataaaaaaaaaaaaaaagagcccataatcccagcactttgggaggctgaggcaggcggatcacctgaggtcagcagttcgagatcagcctggccaacatggtgaaaccctgtctctactaaggatacaaaaattagctgggtgtgctgccaggtgcctgtaatcccagctactcgggaggctgaggcaggagaatctcttgaaccctggaggtggaggctgcagtgagctgagatcgcaccactgcactgcagcctgggggacaagagcatctgagactttgtctcaaaaaaaaaaaaaaaaaaaagaaagaaaagaaaaagagaaagaaaaaaaacattagctgggcatggtgccaggtgcctgtaatcccagctactcggaaggctgaggcaggagaatcgcttgaatctgggaggcacaggttgcgttgagccgagatcccgccactgcactccagcctgggcaacaagagtgagactctgtctcaaaacaaaacaaaacaaaacaaaaaagcactgaatccaaatcacaaataatgagatttagcatagggaattcagttgcagacagcatagcgtttattttttatggttttagactcctcaggctaatttcatatgcatgttaaaggtttaatttgtagaataagtaaatttaaacacaagtaaaatattagaattgaatgccaaggtctcatagtatttgaaaatcacatgtactcttgtctggaatccacctcaactcttgacagccatggtcatgtcttgaacttccaaatcgagaaaccactccagctacaagatttctaactgaaaattttctcttaaccttttacttcttctatttttcctgttaaatgaggtcaattaaacatgctcttcacttgctgggcgtggtggcacatggctgtaatcctagttacttgggagactgaggcaagagcatcccttgagtccaggagtttgaatccaattggggcaacacaggaagaacccgtatattaaaaaaataaaaaaataaatgtcttcatatttactttgactttgactcttttagcttacactaatattctaagcctatgatgattacttgtctcatggctttcatgttcccatgaacatgctagccattttgagcaactgaaaattgcttggccttttgattttcctttgttactagctgaatgttttgccctggccttggccttggaacatcactttcttcttcagatatgtgaacaaggacggatacaaccagatctaaccagactaggtttaggatatgtatctttcagattgaggaacccactcaagggcaacattaacatacagaggcttcttgacttatgatgtggttacatcccaataaacccatcataagttgaaaatatcataaggcaaaaatgcgcttagtacagctaacctaccaaacatcatagcttagcctagcctaccttgaacatgctcagaacacttacattatcctacagttgggcaaaatcatctaaccccaaacctatcataataaagttattttaaagaattttacatcaaaagtcaaaattcgaagtaaggtttctactgaattctagcttttacactactgtaaagttggaaaatcctaagtcacaccattgtgagtcagggactgtctgtatctactttaaatcttggttagttagggaacaaggaaagaaaagaacaatagttgtcagggactagagaagcggtacagtatgttccctcagcacggatacaagcagggacttcggttactgcactagtggtgctgcacaaatattactgctcacttgctacagacaaggccctactctaggaataggacatacagcagatgacagtcaaggacctcaaggggttcatattctagtagaaggttcatactgtttaatggttaacaaaattatgccattcagataaaactgctcaattcttgcataattttattctcatcatttcccatgtttattgttcaaaaatacaatgggctattaaatattcactattctttaggttttaaaaatataagggttatggtatgatttgccatcctacatttatcagttcctttgactattagttaaaaacacttttctacctctggactctgtatacatctcagatttcttggttctcgggcaccagctatgggtccattgtgagaaatttcctacttttcaactgtgagcgctctcggggccttgcttacatttttcaagttatctgcagggatggaattagtttttatttgttgtgtacaaagtccttgctttcggtggtagaatgaaatacttagagaacagtccatggatctatttacttcccatgacctgtgaagaggagtgatgttgccaggacctctttcctgggttgtacccagagctgttttctgcacgctctgagcctccagggatgccatcccaatggaggctaattgatcaaggctgcctggagaattgttttgagatagattctgaggcttaggctggggatcatcagaaaagaaaattatgattgataagtgaaatctgctgtgggcaaggaagggtaaacttgtactttacatgccaggaattttcgaatctgtatgtgactcccaagaaaggcttgaccttgtagcttcgattttaatctccgcaggtataaggataattcattttatgttgaatagactgctctaaagacaatttaaataatctaatacccctgcccatttcctaagagagttgtgttgactgttttattcccaaataggatcaaattcaacctgctgtcattggtagatcattcttcttaacacacatgtaagaataaaaactattattagtttggtgataaaggcagtgaaacaaacaccgagaataggagtagaaaaatgttctgtgtgaccttggttaaattatgaggcaaataagttgaaatatctccagatacattctcgctcaaatatgccagttttcaataatttattgaaatcatataaattctgaaacagatttttaaaatactttaataatgggatatcttaattatttgatgggaagtattttttaaaattacactcctattgtcctaaatttatgaaaaaaaatgaatgttcaatgcagaacacttgcataaatacacacactttttaaaaaaggtacctttatgcattttgctctgcccttaggcactctttttccaatctagaatatatttctggatgtttttcaattgacaataaaattactggagtacacgcatgttttattgtgtttgtgtgtgtctatggactggatcacaaggtataccagatgtatttctagtgggccatggtaaatatagtctgaaagtcaccattctgaccatacccctctcaaaatcacagagccttggagaagagaagaacagtttcttgctgcgtactgacttggcacataccatcagtcgcaatcaggccagatctatgtgctgctttattttcacagttcaagtaaagctgtggaaaaagtctgagcagcagtagtaggcaaggtctgtgccacacacggaagcagaacgcaaaatgcattccacacacatagaagtgtgacacaaaagtttgagcatttacctgtatgaatgccccagtctgtgtccaccgcttctttgctctgagtgatgctcacccatgcccccctagtcccaattccttgaaccacacatataacttattacatgtcatggtcatgtgtgactccaaccaggttgcaatagctgcagtgattttcagattttccctgctttctaaagagaagtgagatcatagcatgttttcactaatcagtgatttaggtagacagatgacatttgggggtgacaataactagatttataaatgctacaaatccgacccatagaaataagaaagtgactggagtcagaaggtcaaggagcacctgtcactttcccagcagggcccaacctgcagtctcttttatggctacaagctggaggtcaggatctgaactgaacaggagtaagagaagagggacttcccaggggggctcagatagttcactgggtgtacctgagatctcactatctgcagacttgtattgttataaaaataagtgaatacttaactgccacggtgggatagcacataaagagaaaaacatacttaggtagttttaaggaatgggaaggggtgaaatatagtcatcccctgatatctgcaaggactggttccaggacaacttctccaacccccaacctgcagataccaaaatctgtggatggtatacttaagtccctgatataaaatgatgtggtatttgcatataacctatgtacatcctcccgtatatgttacatcatctttagattacttaaaatccccaatacaatataaatgctaagtaaacagttgttgtactgtatcgtttaggaaataatgacaagaaaaatgtctgtctgtgttcagtacagatgcaaccattcttttctttacaaatattttcaatccatgattgattgactgaatgtatggatgtggaacccactgatacagagggctgactgtaataaaaccagcacctagcgctgtatgaaaggttagcactccccttgacaagaatggaagaggccctcgggcctgacaacacacatatggttaaaactagcacctaactcctcagtagcctggcaggaactgggaatggtggcctatgttttaagagaaccccttctgtgggcccccaatggctacagcctgatactcaggtgatggtgtgagataagcctcagtgcttttttttatcccctgtcccccaatatttactaagcttcaggaaactatattcttttttgataagtatccatttattaacactggtaacattttcagggcacacagaacatgcattctttggtagcaaaattttaaaatcacagatatatttcttttatatattatgaatatatttctagtaaggaatatataactagtcttcagaaactgaagatggaaacatagctaagcctcaacttccggtcaagcagaaagtaatgaaaagtgccgaaaatgccacagtcacatgggccactgctccttaaatgccacaatcacgcgggccactgctcctttcattctctacagacaacctgagtctcacactgtcatagcaccaagaagaaaacagttactttcacttttcttatagcaacatagggatttgtgtacataaaacatgttggacaggttctccttcaatcatggtttgtatgtcaacagttggtttcataaaacagagaaaggtggaaagaagatagaagatggtctctttacaaaagaaaggtgaatacatttcgatgcaccaggttgtttaggctaagtcagtaactgtgtgtattatcagccctatgactgctaagtgtcaatatttagaatttcagtgtgggaaagaacctcagacaccatcagtccaaccgcttccattttacagctaaggaaaagggtccggaaacttaggtgaatatcagactgggatgagaacgcaggctttggagttaggctccttagtatatgaagttcatgtatccccatagacaaactcattttctggtaatatgaatacacttctggatgaaccaacagtttttcagtctaaggtatgtcagaaacgaattcaatttttatgcttaagtttcctctgcacagctttctccatttaggttgtgatgatgatgcagactgttaccccctctagacttttgcattcttacttttgaatttgggggttaatgtgtgagtagggctccacgaatcatcatttatctttcacatcatttctctttccacctattgctaactacctatttttaaatttaacaattaggtcaatgattcttgatttatttaagacaataccaaagacagtaataaggtcagagtgacctggtgcacttctaacaccccaatctgaaaggaattttttttcagtataagataatatatatcatatacagaaaactaatactaaaaggtactcagaggtagcccttgttgttagacatttaaggatgttctagactccaagaggaacctcaacagttttctctgattcaaattaaaaacaattttctaggataaatggaatgattaataatgtaagaagaataatcagtactgaattgtatagtggaatgattcccattaggttccaaccgaatataatagagcttatttgctttcttagcatgtatctttcccactactataaaattgagatctgtcatttataatgttacctgtattatctaaacactaacatctttaaacccagtgggcttcccctagagaggtttagattcttgcaaacccaggtgaatcgttcttgttgagcaatgaactgttgagaaatgagataaggcagaggcacacttatggatgccagtcaacaggttagcttttgatggccatggtccagaggagtgggtggtcagtttccacagtcacaacaccagacccgtcgtaggtattggaagtactgaccaatgttccaaaagcaagcacatcatttgctgtaagaaaataagggaaaaaaattagtaactattttttttcttcctccagtgtagattaactttgtcacttaccaaaaagcaagtacacactttgataaaaatatatataaatgtgggataggtgaaatatatgatgtatggctttaaaatgggtaagttctataacttgctgtaaacattcttcctggaattggttattgaccattttgggttatatatcattctcaatattaaattttattagaatcttttctttttctttactaattataaaaccaaaacctgtatttgtaatgtgctacttacttccttccctgggtacaattttagtttctcttgataattcagaattaaaatttaatatgttattacactctacagaatgtagttttagcttcaagtagaaatgatatgagacagatagaaaattacctaaaaaaatgcatgtgattttggttactgttttctcataaagtaagaaaagccaaagtgaatacagcttacattctgtaaaattaatagaaactcaaaggtcaaagccgactttcaaatgtgtaatcttgagcaagtcacttaagctcagccataaagtgaaggcaagagatgataagataatcctttaaactacttatcaaagtaaaaggcttatgaattaagattagaattcatatatttatacatttcataaatatatagctataaatatattttttattttctaacaagttaatgcctaagcacagattggtaacgtcaacctctctttgctgatacaggagcaattcacttcatcaacatgactctaaactcacagctgtcctataagcatcccttggtaaccaatattattttctttaccaaaattcagagagaaaaatgaacaaatgttatggagcccaaactatcagagtcagaagaggccccttttccttcaaacaacacctatgaagttatacacactgctttgggggaaatcaatcaattacaatgctcacttcccactagagggagcctcctatctttctgaggaaatcttgaaaaggcaatttaaaaattcaggaacagtactgcaagataatctattgtcagtattaccagttcacacagcttatttattaaaactcaaattatttttcatagttctttatgtttttactagtgcaaacacaaaagtaaaactacacagtaatacagagtgaatctcatgtgaatattgccctgatacgaacttcaatataggaagctcttaactcttgagtcatttgggacttgggacttctgtgagatgatgtttctgaacactggtgatatacacaaaaatatgtatcgatctagacactgttacatagttggtagatcagggtggtgatctttgagggattcacagcaaagtcaattgaaatctctacctctcctgaatagtggtcttgcctggaacctgggtgcttaccaagtagcttactgagacctatcccaggcctacggtttcaaggttttcccaatagccaagagggaggcaatcagggagcacttcacaccacttcattgcgaaggcaatttagagtgcttcagcaggcctgccaactttaaagtggaaactccctcgtgaagacccatgcatgcacaaccgacttggatttgacacacacattatatgattcgagaaaatggattaaaatcctagtttttacttaggcccaaagaacaggagtacaaaattgtgcttcaagtttatagctgcatataaattcctttctgatttttgaagccagactatggatttcagaatttcaggggtaaatacctggattatacatactgggtttggaagacactgttgtagcctaattaattttcaaatgggaaaataatcaaagtggtttatttgggcataagaagatgaaatttttttttggaaggaaatatttctttgagttaagcaaggccactgttagccatacttgtaaattatgtttttattttattttataatatttaaagttccaacaagaccagttatatagttacaattaattaaagataacaattggttttgattatctctaactttatggaaagtacaataaaaatgatagaaaactaagatgaataagttgagagacaaagtcatgaattttaatttactatgtcattacaattattttggaatatattttcttcaagtcacagaatcatatttttggacaaaaccttagaaaaataaaaaaattttaaggaaaatatttggaattatgatgaacttcctctaccccaaatatctgaaggccaatcatgacataagtacatgaaactagtaaagagacagctgtgtacagatagtagaaaaacaaattacctcttcgtttctaccctagaggatttgtccaacactttagctggctgaattatagaaaatctgacttggatttttccccccattgtttgcagagtagactacagccaaccgtagttgctcaaagacaaccagtcatcagatcaagacccgtttttaacaaaaggcaaaaataaaagttacagatctatgtgcaagcttataagcaacgatattttgtgtgataaacacattaacatagattttacaattttcatccattatctcaggctgttttatttcccaaaggtaaggacgagaattagcactccgtgttctattgttttcagtgatgtcctcccagcttttctctaaagctggaaaaacaggggactacaaagcaagagctggcaaatcggtggaaaccaattattcaactcttttcagttagtggggccatttgtccctggtttcttgcccatctttcctccacaagctacattagtgaactgtggctccttggttggagctggaagcatgaaggagtactctgcaaggccttggatgcttttggcactgaaaagcaacagtgggaggcattcattctctgtgtacctgcatgacttttctgatcaggtgcttttatagaaaaggcatctctctatcaaagagcatgactccatcatgatgaagttaataagttagatctaggttcaaaccctggctctaccattcaccagctttacaaactcagttatttaaactctttggccttgtgtcatcaacagtaaatatgtagaaagtatctacttcacagggaagttgtatggattatgtggccaatcttacatatgatacatattcaagtaatttccatcttctttgctttctcctgttatcctgctgataaaacagatcaggtttttcttttaaaattaacaaaaagagagatgtcatgagctgaacaattagcaaaggcctgaattcaagtgattagtttatagccagctgagaagtagaatgaggtacactcgtaacttttccaggctagcttttgtgaaatacttaacatcatttcaggtgattccttggcctgcatgtatgtatgcatttatttaatagatattaaagcctcattctgtgccaggcactagggtttaaggatgagtatctctgccctcactaaaatgaggactcacattttagtaaaagggaaagatatacaatcaaacccagcagacaggagagaagcatgaggtgggccaaggagggcagaggtgccttcctggcagccaagatgggttgtgtattcaagagggaggtgaagcctttgacagtggggggctactggcatccctagaggcctgcccgctggcctggcttcccaagaatctgtagatcgacgctggttcttttgtaaaaataaatacattatttaaaaaggcaatggaaacatttctaaaatcaataaatcctgagggcaaaatggaggtgctatttgagatgggcataatccttattcattcaagacgtgatctgagtccttacagtacaccagccactcaaggcatagccaggttttatcttccatttagagatgaggaaaatgaagctcagagaggctaaaatcacaggctatgatgataataaaagttgtcagacactaacaagttagtaagggaggttaaggcgatgctttgaagagctctaaagaagagaactgttgctggtctgttctcctgaagtacagagctgtcttttggcagcctgatggagacttaaggagatgcattagtgagagcctaaaaatcactctaagacttaatgaatactttacatctcatatagacaaatgcttaatgaacccattatgatgaatcttaaggctccctaccattctggaacattaggttaagttcggagagttaagttagacatattagacatcactaactatttaaaacataatgggaccactgtctacactcaccatttactctctgaggattcttagcctatgtggagaaatggcaacacattaagaaaatatgactcagatttcattaccaggaaaagaaaactatactgtctgtaacatcagttcactattataggtctttacaattttaatttttgacaaatatattttttaaaaaaaggtcttttatgtacacacatgaggcaaaagattatattttaaaaattgccaatttatactgtaaaatatgaattctgggaagggttattagtgaatttgtttcttataaaatggcatttatacttatggttgctcttgaaaattttcaaaaataaaatcaatatgttgtgttttcactttcttgaagtaaaaaactcaaagtagtcctaatgtaaagctgtggagtacatgtcttttgtgtacttatatttctattagaatcttagaaaatacaagtttgagaccatctataaaataaatatatttatttatctcagcactgccaaataaaaataagtgatcacaaatctaaattttctaatagccaccttaaaaaagtaaaaataggaaaaatgttaatatcttttttatttagcccaatatatccaaaatcattttaacataatcaatatataaaatttggggtcttttacattcctttttcatactaagtctctgaaatccatttacagcatgtcttaacttggacaaggctcattttaagtattcagtggccatacgtagctagtggttactatatagattgaacagtgcagttctaggttgttgaagcaggaactatatttatgattcaattatctgcttttttcagaagaacattattttttggtttgattatatagatagtaattttcatttcatatgtagctatgcggtcacagagtccgaggttataaagagaacattaaattcaaagtgtgcatatacaatcattttgagtgatttgaacttacgatgtgagtggatcaacaaacacttaaatacttaacatgtgttcagcagcaagacagactcagtcctctgcccttcaacttgaaggctgagaactatctagcaggaactgtagaaaggacaaccaaaaatccaaaatccaagcaaacctaatgtgaaattaccaagagaatatatactacattctataaggtatagaataaataaatgcctgcttggacatgtggcaaataatcttccttttttttgaaggggggagggagttatttatttttattttattttatttattcatttatttccataggtttttggggaacaggtggtgtttggttacatgagtaagttctttagtagtgatctgtgagattttggtgtacccaacacccaaacagtgtacactgtacccaatttgaagtcttttatccctcactcacctcccaccctttcccccaagaccctcaagtccccaaagtccactgtatcattcttatgcatttgtatcctcatagtgtggctcccacttataagtgagaacatatgatgttcggttttccatttctgagttacttcacttagaataatgatctccaattccactattgggtatctactcagaggaaaagaagtcattatacaaaaaagatacttacaatcttctaattgtacctgcaaataatcttctaatttttcttctaataattgcaaataatcttctaattgtactcttttctcccaattattaccttctcttcccactcctctaacacttgtgaaagaataactggaggaccctaattgcctataatgaaatgttcaaaacaaacacattccctcttcccggcccaaacatcctggcatggcacttaaggccctttgttatctggctacttcctacctgcttgccagccactctctgctacttgctgttccttgaatagatcaggaatttcctgcttctacgaaaatttttgacgtgttccctccgagaacaaattgacttttctctgcatattttatccttcaagtctaaactcaatgtcacttgctaccctgtaccgctctttgattctccaactgctacaggacaaattaaaaattctcttttctatttacaaaggacttgattgcttccctggaacacactttgtatttaaagctgactgtttagatgcctcgtctcaagcaggcaaagtacagagtgagcttgaaacatcttgctccagaaagcaagagggtgctcaaaaacagatgtagacctgtgaaaaggacacaacgactggaactaatttggggcattagaaaagaatcctgagagagagaggcattataatatattgaataatgaattgccaaaagcaggtggagagaagaaaacctattatttacagaagaatgccaactactaaaggaaggaatggcagaattagagaattagaaaggcaccatttgcagccaccagtgtaataactagtttaggcaagaaccatcaatggatggatgcttaaactactggataaaatgtggagaagaaggatagcacccagttccaaagcagtactccacgtattgcttttaacttcaaaggaaaaaaaggtagcagagtgatctcatgagtccgatcttagctaaatgatcaaccttagcatcaccaataaaaggccatactgatatcatgtgcctcctgctatgatgctagggatgaatacaatatcacccattaatacttttggccaaaaatgcctgacctgaattgaatcatggggaaaccgtagacaaatgcagaatgggggcagatgacaggttagtgggcctgaactcttaaaagctgtcagtgtcatgaaagaccaaaaaagtgaagggacttttctagattaaaacagactaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaacagactaaacagatatgacaactaaatacaatgcatgtttttttagtagactccagattttagaaagttataaagagcactactgggacacttggggagtaagcatatggactgtacactattattccatcaatgttacattttgggggtagatattagcactgtagttatgcaagagaatgacctcgttcctaggagatacaagctgaggaatttcaggtgtttattattatcatgccttcaacttattttcaaatagttcagaatgtaatgcacatacactcatactcacatattatattgtttggagatttgtccctgcccaaatctcatgttgaattgtaatctctgatgctggaggaagggcctggtgggaggtgtttgggttatgagggtggatccctcgtggcttggtgctgtctttgagatagtgagttctctcaagatctggtcatttaaaagtgcatggcaccttccccacaatctctctcttgctcctgatttccctgtggtgagtgcctgcttctgccttgccttctgccatgggtaaaagcttcccgaggccttcccagaagcagatgctgacatgatgcttcctgtaccgcctgcagaaccataagcccaattcaacctcttttctttgtaaattacccagcctcagcaatgcaagaatggcctagtacacatacaaagaaataaatgcaaatgtagaaaaaaaatgttagcacttggtgaatctcagtgaaaggtatacagattttgctgtactgtcccttcagtttttttgtaggtttgaagttattcaacattaaaattccacaatacaatttggggaaaaaatttgggaagaaaggctagcaacttaggaagggaagtgtttccctcttggttcacctttggtttccctgaaagctgaagtaatgccattgcaaagcattaagaaatgtttattgatttaacgtgcatcaaaataaatccaagttgaaaaaaagtgtgccaaatttaggaagaaattatctagtctatgatatatctgcattgcagcttcttggaaaagtatagagagagatgctgagcacacagactgtgtgtggtgaggccccttcctttgtcaactcattgaagctcaccaaggacagcctttacttccactcattgatgcaggaggccctggaaattaacttgcagtgtctaccagaacttcttagtgcttgtgaaaatggtaagagcaagacttattgttatgcatgtctctgataacaagccatcagctgtgctttctttttgagccttatctctcaaaaccctgatctactaagactcttcccaaggtgaacactcatcacctccctctcctgacaactaatccttccttgaactcaaatgtccaaggaagggctattataattctatttgaaactggctgcatttatcttcttctctctcagaagtcacatttcccttgcccttggatgaggactggaatgcattagaaggcttctgatgttcaattattcttccttctccacattttctgtgttatgactcggcctgttgatcgaaaaacaattaggccaggaaaatgctgctgcttggaggaatcaaaactaattatgccagttagaaaatgtttacaaagatcatcagtttcaaacatttagccctttctaaaataaacaaaatcgttatttttatttgttaaagagaattccctaatgtattatgtcatcagcatgttctactcataaaaggccccatgttccagttaaagagccaatcagagctgctttaagaaaaaagaaaagcttactgggcttataaaataagaaccacagtccaaatccacaaaatgtgacctttttgcattaattattagtggtaaagtgaatgaactgtgtagaactctgtgaaaattttcagtgtggaaaatcagtatcagatttaaacgtttgttcaaagagaaaggctgtccacaggctgttctgaactgatttattttgctctgttgccttcaaatcctgtgtcttggtgttgcctcctgtggacactggcctgccccaaaaccatcccacaggggtgagaattatgacctgcagatgccaaagatgactgagtcgcagccatcctaatctcttgctgcccggctgtagagcaaggcaagtcattttgtactgctgggcctcagtgccatccctgaaaacagagagttgatcttttcactgtaatattttatgacttttgttaaaagtccctcaggtgacctcagcatccatttgtaaaatgccaataatacttgtccccagttacctctaatactgctatcgtgaagatgaatgagttaatgtctgtgaagagctttgacttctccagaaaagtgttgaaaatgtgttgtattattatcatcatttcatctgcactgaggaagctttaaagtggcatttgcttctatccttcaaatgtcaacagagattattacaggtacatcaaacaaacagaaatgtcatagaaaagtgaaaaaagagaggaacatgtgcagtagcatggtatgattacttaacatcaatctcaaacctgcaggtggtatttatacaaataagctaaagagacataatccaggcccttttagaatttaccagtcaagagggtctctgtgaatctgctgtgattctgggggctgccggatttgcaaatcgttcactgctcaattgaactcttttaaatttaattcggctgaagtttttcttttatcagatggtgtcagaagtgggatccaaaatggagcttctagcatcccccagcagtgctgagtgaatatgcaaggtacctgcaggacccacttgtgtccactcatctcttagagctgctggggatcatgggtaagctccttcttggatttcggagctccgctgatctctcacagccactggggatcatgggtaagctccctcttggatttccgagctccactgatctctcacagccactggggatcatggttaagctccctcttggatttcccagctccacagatttgtgttttgagctctctgagtttctttgagcaaatttctgatccaaactgggtttggagttgtgacagaaactggactgggtacaggaatggatttgatctgggaattaactggcttggatccagttagaagcctcttacatctgactgggtcagaaaggaactggtagtaagcagtaatattgcaggagttataaaatttggcttttgaaaaatcagatttttgtgttatacccctttgtttcatttttcttacacttgggtaggaaaaaaaaatcactggctaagttaatcaagagaagctgagcgtaaggccaatattttaggtaaaaatgggatccttagtttctggaaaactgagttctttctggcttacacttcaggcctgggaggcagcgaagtcttacagaaacagcaaaatgttactaaagataacacagtggaatgttccgaatgaacaacaatgcatttgaagtacatttttaaaatgagggctctaagtaaagtcccttttgtctaagaatgggtttggcactacagcatgtcaactgctattctctttggaataatctgccttgcactctttgctgacaactgtgggtgacaggattaggcatgtacaggatcgtgggacatggggagctttttcctccctaaaaggggaaacttgagagatgatgggcctgctggaaaagatcccttcgctacctagaagcagccgcctgaacttttttttcagtgtcgctgcaatgggtgggtctttctctggcctcccagatcatttcaccttccccaccctgcctcaggcaatgcttttctctttctcctttctctttcttatcttttctattactcagggcaaccatcttgcccagagaccacaggttgaaactcctggttggaggttggattaatgatgatggagcccaaccaggtgcaaatttgagccttgccagtttgatactgggtgctaatcagagcagctaatgtctatgtttttgtcacatgtattttactctggccagaacagaaaaagataattttcttttctgatgtggctttgccccagcgcgatggtgtggcaagctcagtcatggaggccgctcaggcaaagagaacccagaagcctggcatgccggcaaaagggtaagaatttcttaccagtcagacttctggcttctctctttctgtgcaaatggttgactgaatggtaaaaatcactgtttatctccatcttgttttatgtccttgggagcttgaccttgttaccacgtggcagtactttctcttggtctcctccttccagggaacaggaattttagggtttatgtcataattagctctaaaaattatcttgagtagttaaaagcctgtgtaagctcacaattaactattctagatgctttctgggaagaacagtgaagactgccctatgctgtagctcagttgctaaggctttgccctttcttactggtggtctggtttcgattccctgcttgtgaaataaaagccttttcatttaatttctgcatgaccttgtctagtctcttctccttcatgtactatcttaaattttcctttcgctgagcacctgggaggttacctttggtaaagttcaaaagccggaaatatcggagtgaaggttaggtactattagaagtcaattttccatttatttgtgcttgggaagatctagtcaaattaaccagatgactgaatccttgaatttacagaaagcccttgaagttctgaaagatttgccatgtaaatccctctaagattctggctcaatcttgatcaattcagccagaccaactggtccactcaggccacctcttgctggtgaaattcccgctcctctcacaaaggcatcttccctgctgcctgtgtccctacgcggtgccctgctttcctctttggctccactgcccactcgagattccctgttacagtgagtacctgccactctagctcctccagatctcctgccaccctcctgcaccagcccctccccgacccctgctttaccctacgagggccaccggcatgacttgacctctgctcctttaataatagatggttctttcttatatctcagcctgaaactgtgacagtcccgaaaatgaaatctcagtggtcatggtggcttttcattgtcttgtggaaaaatatttacaacacagaaataggggatgagtgtttaccatcaagcagaatccattcaatcatatggctgtttttagaatagaatttcatttagtgagagtctgaccgctgccttttggggaaaacatcatttgatttaagttcagatggtctaatattaacagatatgatttgttatagcaaaggtaatgaagcaatgtcttagactttgtccataaacctataaatatacaagcttgctcctaatatatttcatcatgacctattttcatttttaatttccccttgctgatatacaataacattatttcaatttaggaatagctgtcatcttcttatatgaatattctaacaagtctgaaaatattagccattcttagaaacaagctactttaattcacaattaatatattctctttctcgttctcgttataataatcaattttttaatactcataccatggactttttcctgatgacaggctgaacttctctttttttgatgaaccttctttgcattaactatctgcatgcaaagttgcatattatcccagcctcaaatttataaccttctacttagcattttactatatcattgtggagtgctgacatgtgtaacactatcttacacattaaatgttcaagtatttttttctaccaattagattataagctccttgtgggcagaaatatgacttggtctaacttcctttattatagaatgtctaatctgcaagaaaccttatctattatttagttcagtggtttaatacagataaaagtgaggctgctcctactttaaccaatttaaagtgctaggctcaaagttctcttcacttgactttacctcataaccaaaccaagttggccttagggaactggctaggtcttcagtgcttcagagaatgtatttaaagagccactgatataatatccaaacactttatttcaagacagggaaacgaattaaagataccttattgacctaggatgcccagcactgaaattcaagtctgttgacttgtagctcagtgtattctctcttataacaaaatcaaactatgggccagccacagtgcctcctgtctataatcctagcactttggaggctgaggtgggaggatcacttgaggccgggagtttgaggccagcctggcaacatagtgagaccccatctctatatatataaaaaaataataaattttaaaaacccaaagtcaaattacgggctttaacaaattggttggctcctcagaagtatttttggattagctaagcaaagttaaatgattaaaactacatactgaatatctgaattgcttgaacatgtggctatgttacctattttttcctaaagcttagtgattcatgtagattgactaaagtcacaggcttcaagccggtggcaaaatggattcagaagtttctcatccttgatttttgtgtaagctacagaccacaggacacaatgtacttaactgaaacactctgtactgcattttcttatttagaaaatgcaccaattccatttataaaccactatctatagaagtgtttcttttgttgtgtcagccattatttaattaagtagtattaacagtctagacaaggaggaatgaggaaatggtcacacaggcttagctgctaagacatggttcaatatttggcttttagtaaaaacattttgctgtatctgtagtaaacacattagataaaaattaaaggtgaaatttcagttaatccactttcactgctgatatggcaagattattagaagaaaggctaactacagagcctttatttatgatttaggaaaatagacctatattgttagagaagaaaaaaattcacttgttataaatggctgtatttgcaactgaaagaatatcaatatatcagacatcaattacaccaaagataagatgattacaaaccttctatgtagaaaaaacattcattttgaagtatttggagacagggatggagagtggcaattttgtttttgtactaaaaaaatcattcctcaaaagctgagttatgaagtttgtacaaactaagattatattatatcaaagctgcaggttaggaagtcatatttacttggtatgtatagacaaatttacaactctaatcaatttggtagaaagtctactaaaattgaactaattttttaaaaagcctgtcaaatcacaactagtatgtatgtgtagaaatggcctgagatagcttttctgtattcttaattaagaaataaacaatcccatatattccttgcaagtatctagcctggaaggcatgaaagaaccctggctcctccctgttcctttgatgccatcagtggtatctagttgttgggggtttcggggcaacctctgattcagacccttgtggcaccttgttgatgaccaggatcttacctactcattgtggtccaatcaatattgggtggaaccctcttgatggctaccattttgacctctcacctttcttcttaatccatgacactctttgcaaaaagcaatctaggaaagcagatatcctcccccttattcttcctaaaacatcagcgccatcggagaaatgtgatgaataattaccaatatgcctttttagtgttgtgcctgctgagtgttggtgaacctcttcctccagagatgatggacatagttgtgatgtctcactgttctatactttgcttggaggtaactacagactggcctctacttgggcacttgaggccatctgatgtgtctggagtaacagctgcctctgatcttaggcttggggcagcttcacttatgagtactggctgtgagcctctgaggcttcattctgttagtgctggggtatctcattttccactcattgatggagtggcagtgatgtgtgtctcctcttctctgagtcaaagaggcatctcctacaggacatgctgcaggcctgtggattggtgctgaggtgttgtaggtatttttgttctaagcattaacaggactgacactatctattttggcccttattccatagaggtcttttccttccaaagaaatccaaaggcatacacaacctatcccatatttcatttccctgttgagggatgaagaaatcatctcagcagattgtttctttccttctcatctaagagatatgtttatatgtgtacatggcaacagggatgaggaacctccagattcttggcatgatttcaggcatctggacacagccctgcctctggtatagggcctgctgtactttcttccttgtatcctcccaggcacttcactggagagtgactgatctcttcttgagtcaagatttaaatatacttcaacatactaatgacttttatttactagatttgccatttaagcagtctttatcttctgctgttgccctagtatttataatatctgaatcaaagaggaatagattcttgaaaaactgtgccacacactctagcctgggtgacagaatgagactccatctcaaacaaaacaaaacaaacaaaaaactgtgctacaaattcagactgcttttttaaacagtagtcttatatgggtcttttaatgtgcaatgcaagaatagtgctgtgttttagcatgagatgacgttgcttatataaatgattttatatctcacgaaaaaaatctataaaatcaaagtaaaaagttatctttactcttttaaaaaagaggctcatatattaaacatattgaaccttattagacagatatctaccaggcttagtgatgtaagctcatgactctcaaatgcaaaactttaaggcaccactgaattaatatactggcacattctgcaggcaaaagcattaaatttttaacagtacaattgactgtatgtggttcaaccttcaaacatgttgcttgtgaataattgcaaaagatacactctggtatgtgatatgtgttactcatttctaaaatgcaaagatagaaggatctactttctgttttgatttagccacaaatccagtgtacaaagaatttactcagcctggaaaatagttaagaggataataagaaaatagaaaagtaacagactaacttcaggcctaggttcctccagtatagctaatttatgacatttgaggcttaagagatgataataattaccatgagaaagaaaaatattacattttaaaatcctgtctcattttcaaagactacagaaaatttctacttggtgctttaattgccattttaggatgcttgaaatctctgtccctttctactccctggaaatgttttaacactttgtaaatacgatgaaaaaggccaagtttctataatctacaaagacattcaaatgctttattatgtacaagagtaattcttaagagtagggagttgtatatatagtttgaaaaaaaatcctaaaattataattgtgttactttctaagtacgaaatttattgtgaacattctgatattacgtgtgatcttacgtttagtaaaaaagaaaaaaaagattcatgggtttaataaaggtaagaaacattggaataagcaagcattcaataagaatgctaaaatgtgctaccccaatcattttggtactaattcattatggtaacagatttgccaagttccatagttcaagactttggcattataacaactaccagcagggctcctaggcagaattaagggttcagtgtgtgtgtgcaaaattagggccttggtgttattagtaaagaactgtattaaaaagaatgagggcaactgcaattctgttctaccaaataaaacattttgtttagagattaaaaaaacaaaaaacaatgaaggctatgttacagttatgcaaggggtgttctcaattagtagaaaacagtatgccaatttgagaaattccattaaaaacagagaattccataaaggtagcaccctagttattacattaaacaaaagtattaatattgagtattattgctacagtttgttcattactcagaatcatgtgagcccaggagagaccaggtttgctctgttctctattattcctgtatatttagcatactcaaagaaaatatcctaattatagattacaattactacatagcagacttactgtaaatatttattgaatgaataagtgtgtatccaaataaagatgtctgctctgcaaaccttcatccaggccctgggtctacatctcagataattcacccagacagccaagacataaaaaaacccaaactcctttggtatttattctccctaagctccctggtcaagggtctctaaatgacttcaaaggaggcccctttcctagaactcagcatttccttaactggtgattgctgattgaagcacaccactcccaggctttccagaattatttaatattgcttctagggcaccttatatgggtgtgttcagaagcactggggggaaaaggaacactgggttcaatggctagatccttgtttcccacttgttcccttttcataggtctccctgccctttgagatcatgagcaacttcagattacctctcacccttagaatacaatgcatccatggatggagctttggaaaatgctactgtgtttctgataaactaagtgcttgttaagctttcactttagcacaactttaatgtggaagtaatgactctttccagctgatatcaaggtatttcccacactttgggaaagatgcaaaaaccactttctatatggctcagtggttttattactgatggaagcatcccattaaattttcttatcaggctgtaaggaaaaaagaaattcattatgtgaagagagacaaggtaagggtttactatataatcaatcaatggtaatacacccttgtttctcttatcaggtaaattgcccctcaaatattttatagtaacgggaatttctccaatctcaacatagaatcctaaaaatatgcacactctgacataccattaatcctaacatttatcatcccttatggttaaacatttataaggttacattctccttaaactttcttaagcctgtaaacagctacaatgaacaacaggtaagtttattatggttttagacagctctgtggagtaattaatgaagcgtttaggtcgatgttttgcattactcaaactttccaattccaaatttgataaagaaattttcaacatgattgatgtaatggttacttctcaggtcaatgaaaatgaatgagcactgggttcaagtccaagcccaagcaagtcacttatttcttaagtctctatcttctagtccattggtctgagagatctggcctgaagttccactttcaagtatattggtccattctcacattgctataaagaactacctgagactgggtagtttataaagaaaagaggtttaattgactcaaagttctgcaggatatataggaaacatggctgggaggcctcaggaaatgtacaatcatggcagaagggcaaacgggaagcaagcacctttgtcacatggcagtaacagagagaacaaagggggaagtgctacacactttcaaacaaccagatcttgtgagaactctatgtggagaacactaagggggaagttcgcccccatgattcaatcacctcccaccaggcccctcccctgatacgtggggttacaaatttacaggagatttggatggggacacagagccaaaccatatcacatagcttgggtttaccttgaccaaggctcaaaacaaggtgatgcagtttcttaaatttttcctttactgcgcaggttaaaattacatgttaatttcttgaatggtattcccacaaattcccttacttccattccattactgattatttcctgagtctcatctgtctctcagattctatattcttttaactaaaggaacaagggtttctaaacagaaggtcatttcaagtttcaataataataataaaagtggtaggaaactttatctggacaattttatatgatcttgccaaatggacaatggcaagatcatataaaaaatagaattctgaccccaaaactgtagaaacgtgcccaggaaaccaatcccttatctacaacaactagcctgggaaatcagcccacgataagtcagacttgcagggattcagaacacagaaaaccaaacaataatttctgcaacaatttgccccaaatggccatgacttaactgaaagctgacaacttccctaatttttggctccactgctaactttagcaccaaccagagaaagccaaatatgctcctctaacctatcgcgtaggatgcttgcttccagtcagcctgcctgcagcttctttgggccaacagactccaattagggtacatcagaagccatccctttctccactacacagcattcccatttctttccctgcctttgaatctccgctgaaatgagttactctgcaagaaactgaataaatagccttgatttattctcttttggtttgtctttatttatcaccactgtgcgtataaaaaaggatacagagagtgcactcagcttcatctagatccacagttgggtcaatctttctgctttcctagttaattattaagttcttgctagctactatttaaaaacctacacactaaaacctcctacctttccaaatgcctaatgcctatctactttgagcatatgactttaccccatcttctcagggaaaacaagcccaataagaacttgctccacatcttctcagcattcacgccagtatctacagcctcatccagtcaattcctcccttcttgtggttgtaatagaaatgtagacatctcctctgtccagggttctggatctcacttcccttactgtctcacagctttgatctacagattatcatcactctctcctgttccttcaaacagttctcatcatcttatttatttctatgaacacttagatgtgttcaaggctgttccattttactctctctcccactccaagtccctttcagttatcaatctctctctcttccccacttcagagcccaaacactggaattacttatctacccttcaatttccattcatttcataacctgctgcagtgtaggttccacctctattactgcactaaaactactaagatcatcagtgacttcattttccctcagtgcaatgtgtattctcagtgcctacaactgtgactgatatggagtagagcctcacttctctggatttcctaattttaaaaatagttctgcattggcttatagctttacctgaattacgtcatctattacaacaacctgataaagtaggtattattaatgtgattcatatttggaaactggagctcacagaggttaaatctccccctgaaggacagacatctgttctgccacctaagattcatccttgcttcttccctctgaaataataatagtattagataggaaagtatcctgaaaaatccttagcagatttcctggtataagaaaaagagttcaatatatgttgagtattatcatttttctaccacctaaaccagtgcctggcacatgaaatatactccataaatactgactgattaaatgtgcccagagaggtcataacagtgatgcccaaataattatttttgctggtaactgtggcctagctggggctttaaagcaggtaggggcatttttcctagatctgaaggcctctagagggctttacctcgtcatactaactgtagggaagaataagaaaaaaatatttttacttcctctttctcaaaaatgttcactcatccatttctgaaaaggtaaaattatagacaatgttacttggtaatccctatcacctttttcagaaaaggatttgcctttatcttattatagcaaatattagtttgtaggtgtgaattgagagggagagcagttaagtcctttttcctattacgtacatgtataaatattgaaattcatgagatttaaatttgaaaatctgctgctttacaaaaatgaagtataattatagagttgaacagaacaaaaggggaagtaaaagcatagatgcactgatttactatcttgccttctctcccactggaatcaatttatgctggaaagaggagctaaagacagctggaggaacaataggttgttaacacaaattataaggaaaggaactccctttaatttttgggaactgagccaagggagaaaattgaagtgagatactgtatttatactacactataacagtactcatgtaattttctgagctcctcaaaaatctctactaaaataaaagcattagtatctatttctcattatgcctaaatattggtaaatgcataggaaaaaatccccagaaggtagctgccagtttgccaacatatcctattaaaaacttttttaccaactaggagacatctttccttagtgtaagaacagagatacaacaggatgcatggacactgcgttactttaatgatgttgcctttaagaaaagataattatgctggaatgcaagatgcaaaaagagactacataggaaacaaagagttcactaagtgcagactcagttgggtttctggcttgaaatgcaatacaagtaaaatatttggcaagaaacctgtaaactacataaaagaggcttaaaaatcaaatttggaagttaaagaaaaaaatcacccagataaactataaaatgcaggtaacatagatggatgtgatatatttctggttgtcacaatgaggtcatgaggatattctggcattctcatgaaggctagctcagagcactcccaaccaatgaggtcctctattaccaacaaagagcatgttaaaattccaaacaacagggttctacattttataacagatgaaatattgctattacatagtcagaactctgaggacgggctcaccattggaaaatagaaatggaagggtttccttagttcaagtgaatatgttaaaagatgggaaaaacaggaaagctaaagatctggaaggtcaaagtatcaaaatgtgccaaattcaataacaaaaaggggcttcaaagctatgctggaagcaaaggcgttgatttctgcctgaagaagatgctgtgacatcaactccaggacacttacttggcactcacattctccatcacagaaaatgatctcacgtgttgtacactggaagttgaactcaagatacgtgatatgatattaaagttctgtttactcggccaggcacggtggctcacatctgtaatcccagcactttgggaggctgaggcgggtggatcatgaggtcaggagttcaagaccatcctggccaagattatgaaaccccatctctactaaaaacacacaaaaaattagccgggcatggtggcaggtgcctgtaatcccagctactcgggaggctgaggcagagaattgcttgaacctgggaggcagaggttgcagtgagccaaggaggttgcagtgggccgagattgcaccactgcactccagcctgggtgacagagcaagactccatctcaaaaataaataaagttctgtttcctcaactcagattactgaaaataatttccagctattactctcgagtgatgatatgcctttcagagactattttgtatattaccaagaataacacggtgaagtatgggctaaatgattatacagacatatgaattttgagatatcaaatacctttcctaaagagtactcgttagtggctctttggaatggccttgaatggggcaagagtctgtccttagactacctcattcaactacctatcactgtctcggaagaacaccagtaaagttaatctgatcttcaatagaaaaacactggggagggtcgggggtagggagagcatcaagaaaaacagctaacgcatgctgggcttcctacctaggtgatgagttgataggtgcagcaaaccaccatggcacacatttacctatgtaacaagcctgcacatcctgtacatgtaccctggaacttaaaaaaaaaaaagtactaggagagagaaactaaacaaagaatcaagattcaagtattgtacactttaaaagaaataattttatggtttctgaattatgtcttaataaagctgttatatatttttaaaaagtaacaggagaatgtttaactggaaaatgtaaagcctcatatatttgagttaaaaaatgtactgagcagagaaagcttccctgttgataggctgaggcctgcagtagactgtgggctcaggagcaggtgacagtctgctggagtcttggcttcctcagcagcagcctccccctagaccctcagtacctgacatcatgtctgccacaaaggaatgcatagtaaatacctgctgaataattatgctccttaaaaacaaaacaacaaagaaaagccaagaacacaaacttaaacgttatgaaattaaaaataggagtttcttctctaagaaatctaacatatatagagaaaaaagactggactaaacaccaaaatactagcagtagttgtctttgggtcagaagattttgggcaaattatgatcatttaatttcatatttctgtctattttcctgtgtgttccaattttgtaggatagagaaaagtatatcctctgttacccctcatccctaccccaagtctgtttgaatgacaatgagtatgctgaaacattgagctgcttgaaaactatttttatatatgttactttgaattatttatatttgtatgtcttttctttccacttgaactgtagatactcagattgcagcagtgatatgttattatccttgtatatagtctgatgctaaggatggcagcaaattcaaccaccttctcttgcaaacgttattacaactgaaccgggaaaaagactagaattttatccacatggctgctctaatgtcatcctaatatgatataatttctctaagaaaaggcacttgactcaaactaaaacaaaagttaacactgtgactcaaagtttaggctagatgacaattctgaagatctttttatttcttggtggtgaagaaaaaaaaacactcagatattaccttttttttcagcgcatgggatcggcagtaatttatctgacattatcccaatactcctgatggaggactgtcatttcaagttctacttcgcaggaggattttatcgccctctcaatcaatgttaggagtcattagagcaataacagagaagaaaaatcaaggccacctatttaggcagggtgcttgccacaaggtagtgaaacacaaaccctaagatctttatgtctgtacaaacgtacaagggagttggccatttagctcccatagttgtggggagcactaggccagactgcctggatggggcaattccctggggcctcagaaattagtattggtaacagcttatatttctaccacttctcatgaaagaaacccagaaattagcaactacccttgaataccctgtagaagtttgcaggcttgtctagaaaggcattaaaaataatcacaaaataacacaaatccacaaccaagcaatcaaccctattcactttccaagccccatttcatctctctaatttttccattatttaagaccgcagccagaaaaacttcagtgggagaaggagaggtgaatccaatgcaacatgaaccaaatctctatcatcttcgtgtcaccaacagaaatgttttagctaaacaaatttgatcgtttgtgatatgtgcacaaattgatttagattatcttgacaagtccagttagtccatccaaccaaatcaactcagaaaaaggaatctaaggagtcaaaatagataattcaaatcaggttgcatgcacaggcacagccacaatgcatcttagcccaaatgacctgaatctcattactaataattcttaattattcagtactgaaaatacaaaatgtttagtcagaacatggtttgggatttaaaaacagagaaaaataagtgaataccaatttttggtatgtggagctgagctacagaaagctataacaaattaatttgaataattatcaataaatttaagaaagtaaatgtgccctaaaattctttcagataatttgtttatccaaatagtttaaatgacctattgtttatcctgctatacaaatcctttttctttagataatataagatttaatgaataaacacacattacaagttagtgacatttacataaagaatcattaatcataccaccttcaaatatatttgcataaatattagcagttaccaagtcctttatcatgtacggcctccatgacttagtctagatgagaataccaccttttgcaattatgggtaatacattctttttcaatctacttttgaatttgaggattggaaccaaagtttatcgtaagcaacggtgacttactcaagtttgtctatacatctgactgtcacatatgtaatcttcccaattttttttcttgcctctggctattctagtctttccctaaaacctactaaaagttactcattttaaagcaattgctatttactgtgtactactaactgctttctgtgaaaaatgtgtattcttggatgttgaaatacagggagaagagatgctccaccaatagctttgtaaacttttcccattaaagtagtattccacaacatgcattcaaatgtcaccacgaatactgatgatcctgtaaagtggcactgtctttcaagagacaagattgatgaggatagaaagaaccagataaagaagtctttgaattctagactattaagcagtagagagtcactgcataacatttttataaggagtggttggattaaacaatattttgggaatattcaacaaatatgatacagcatactagtaggaattgaaataaaatgctttttgcatcgagcattcaataggctgttgccctactaagatgataactactaatcctttgctagtgaaaacccagactttaaattttttttttgaaagcatttaactatttatgttggttgatgaagtcaactgctcaagtgagactgataccttggaaatgtctagctggtgttaatggttcagtttgggagctcttggttgggaaagcactgagctcagctcttgtgactaagatagcttgattcactcatgtctccaacaaatattttcaaatatctacagctatatgtgaaagctgacaaatttaagaaaagaataaaagtaatgtggtttccacaagttgatcactttttgagtataaaaattagggaatggagtgtagagggtaaaagctagaatatccattccttcggttgagatttctgatgcattattattgaagtttattgaagacctagagtttcaagaatttcacttaaataagaatatcaatttaactatattatccttctttcgtggaggctttcttaggtacaacgttaggtccaatttctcaggagttctctttgtgagcagcgtgtactcctctgtctcttgatgtggggccggccatatgactgatttgggtatatgaccaaagaggatagattgccaggtcagaagccaggcctttggggactttgtatgtttctgcttgctgtcttaagtgtttgccactgccttgagaagaagttagctccaagtccaaacagagacttaaagagcatggccagtcagacacccaaacatctattttaagaggcagagcaatgacgcaccaggtgctgtgtacagaagttcagctttagatgaaccaaatcttacctgcactgccctgcagtcaagtaaatgactgttatggaccacagagctttgaggaagtatgaaacacagtatctttgtagcaacagctaatggatacagtggcaaaacagggattagaactgaggcttggaggctcttatttgaatgtagattttatctatcacttttttttcctgttgcactaggcatgacaccgtcatatgtagaacttaatctgttctatttttgtgccctttccattgcctttttcagtaaccttttaactaccttgcctttccattttttgttttgttttgtttttcttctttgtttttttgagacagagttttggcctgttgcccaggctacagtccagtggcacagtctcggctcactgctgggctcaagtgatcctcccacctcagcctccggggtagctgggactataggtgtgcaccaccacacccagctaatttttgtagagatggagttttgccatgttgtccaggctggtcttgaactcctgagctcaagtgatccaactgtcttggcctcccaaagtgctgggattacaggcgtgagccactgtgcctggcctgttttgttaatatgtatgtatttccctgtgctttggaaccaatttttccactttactgacattttgttttctttccttggaaacttaagtctttcaaataatggccagtttctctaacatttctttccaccttaagatccttacagactttgaaaagaaaaaaaaaatacactcataataatcattcttattatcttattatcatttttaccttagtttaatcttatccaaactaggtcgtgacaatttagggaatacttccgaagacttgctctggtattttattttttaaagagaagtccatatattggaatgcatgaacaagaaatgcaaagttagaaacatatcccatgaagcactgtgaacactctgacagctgcaatttatcaacataaattactgtgcttagctgcaaagcttttgtcacagggagacagggcacttcctaaatggcttgctgccctctttaataataatcttagtttttacaatccagacaacctagggcaagagacagcctgatgcacatagaaacagaaaaattcaggtttttatgtacatcaccgggagcactgacatgctactctattcatttttagattagagtcttttcccccttctgtctacatgtggcaatagatgacttagaaaagaaaatgtgggcaggagagccaggataggaagcttagcagtaaacaagtcagcctgtctgctgtctcactttccttttaatcaaggaaaaggcctaacagaattcactgtcatcgtcttagtggtggcttctaacagcactggatagggagaatccttttatttccagcatcacatgaacaaattgatttttaaattcatgcatctaacatgtgttcctaaagccattaccatttagtaaacagcataactaaatgtctttaaactactttagacattttaagcactaatttttctcattttaaaaaagtttcaatctgtgtgttagagatattcgagatatgctactacataaagttttgtacctattcatgaaaatctaattttggggggatgtggttgaattctgtatctcaatattggacttttctaatacggtggatgagctgaaacctgttccctggtccccttaactccaaagcctctgctcactctactgtacatgctgcctttacagaaagcccctgtccgtaagctccattttaagaaaaggagttttaagactgctatccataatgccaaatttctaagctgctttcttctagtattggaaaaacagaaacgtctagtttagccattataatcaggaatcaataacatgcatatctgctaatttccctgcctttatggtctgtgctcctatccaaaaagggttgtaaaggcaagaacaaagttacctatagtctctctctctttttgagtactttcaaattcatcatttgtcaacagatgtactgcagtccctagcttcagtacaacaggacaccagtaaagtcacctgtggtacacagaataagagctgcccaaagatgtctaccttctaatccctggaacccgtgaatatatatgttacatggcacatggggaattaaggttgcagatgaaattaagtttcctaatcagctgaccttaaaatagggagagtatcctggactatccaggtgggcccaatgtaatcagaagggtccttaaaagtcaaagagggaggcagaagaggaagtgagagtgatgtaatatgacaaatacttggcccaacattgctggcttccaagatagaggagaagaaccaaaagccaagaaatgtgggtggcctagaggctggaaaacgctgggaaacagattgtcccctagagcctccagaaaggatcaaaggtctgctgacatcttgttttagcccagcaagacccatttcagacttctgaactacagaactgtaggaggagaaatttgtgttgttttaagccactaagtttgtggtaatttgttgtagcagccacaggaaacgaatacatcatttatttttaagacaggttaccaggaaggctatctacattacagataactgggagacaatttgacaaatatttgacaaattatcagaaatgtttttgttgtttaatggcaaaagtaaaagaataatatgcttttgttttcttttaatttatttttccttgctgaattgtgtcctttaatttataactacaattgctttggctgttatttggcactccaaatggatcagaagtaaattgagactgataaataatttttgtaattaaatacaatattatagcaaagaagaatttaaaatataaacagcatcttacttcaataaaaatgtgttataaaagaatagaaaatcacaagtaactaaataaaaaaataaataaatttgactttatcacaagtaaaaacttctgtgcatcaaaggacaatatcaaatatgtgaaaagacagtccacattaaaaaattttgaaatcatatgtctgataaaggtctagtatctagaacatacaaagaactcttggaagccaacaatacaaaaggcaaataacctacttttaaaaagggcaaagaatatgggtaggtatttttccaaaaaacctcaaaacaattgaccaataagcacgtgaaaagacgctcaacatcattaatcattagggaagtgcaaatcaaaaccactatgagatactaattcacactcattatgatggctatttaaaaaaaaggaaaatggtgaggatgtagagaaaatggaactataatacataactagtgggaatgtaaaatgacacagcccctgtggagaacaatttggcaattccttgaaaagttaaatatagaatttccatatgaccccgcaattccactcctaggtatacacctaagagcactgaaaacatgctcatgcaaaaacctgtacacaaatgttcctagcagaattattcgtaatagccaaagagtgaaaacaccaccaatgtccataaattgatacatgaatagacaaagtgtagtatgtctatacaatggaatattatacagccagaaaaaggaatgcataggtgaaccttgaaaattttatgctaagtggcaacagccagacacaaaaggccacatattccatttgtatgatatgttcagaatagtcaaatccatagagacagaaaaattatttcattgacacataaatgagggatatgaaatctattcacaataggaactcatggtaggtatcatttatatagctgagaaagctctcaggcaatcacacacaggaaaatgtgtcaaaaatatctgcagaaaatgttatgtgaatgtcttcatacatccattatatccttattcctccctctgttccaaatttgagctttactgaatagagtgtgagcacctgcaggcaggggctaaatcttatttatctttgcattctcagtgctgaacataataggcacacaataaatttgttctataatgggatgaagagatcaaagcaaagagtaatggccctcagtaatggctcctgacaataagaaagcccttgtagttaggaaatattcttaaatccctcaaatgcttatttaagatacagagagtgaagtattaccttatgtaggaatgttcagtgaccaaaatgggaaaattacaaatatctgttgctttaaattctttaatttttggcaaattgaatattatgcactttttgtatttttattataaataatttgtttcagtactatgacttatttcagtataaatgaaataagttgaggagggttatttaaaatggtaaacatttaaccatctaatggttaattaaaatgaggaattcaagtttgaacataaccattaaagtctttttttttttttttttttttgacagagtctcgctctgtcaccaggctggagtgcagtggtgcgatcttggctcactgcaacctctgcctcccaggttcaagtgattctcctgcctcagcctcctgagtagcttggatgacaggcaggtaccaccatgcctggccaagttttgtatttttagtagagacgggatttcagcatgttggtcaggctggtctcgaactcctgacctcgtgatctacctgcctcggcctcccaaagtgctgggattacaggcatgagccactgcgcctggccccattaaagtcttttaattcaatgaagggttcactcagccttatttgaaaacatatttgcttacagataattctattgtaatattttaatcctccaatatgtgcttataaggaaattacaaaataacaatacatcattttaattttatctttactaaaagtaatgtagagattaaggccttctgcttctctgtcaaaaaataaaaaagatcaaacaataccggctgtgataagcatacaacttgtgattatattgtgctaataggtccaaggatctatggagataaaatctgattaatatatttatcatctttttatgtttgttttataaaagaggattcatgtttctatttcataaagagacatttaacttcttcatcgggtcattctaaagttacctttaaaacctaagaagcaccttctacctcttaaccaaagaaaagtcaaatatacgcagaatacagagggatacagaaccagctaagtgtcgcaaagtcacaagccttctttcccccaggaaaataaagatcagaatgctatgctagagtacatgttcaggtttttgaaagggatgtaaggatatgcaggtaatgagcaaggcctcatttcttttctgcatatatattagcatggattttagcctatttatataaaaaagtcagaaatataaagcagaggagtttttactggaactatgatgactccatgtttcgtatttgattttctctgctgttcacatatgttttcttgattccttgagaattgtctttttaaaaaatttgtgagtgtatcatttacatgaactaaatgaccaacactacttgccctgcctaataaggagtaatctctgattcactcaggatacgtggaggccttaaagtttgggagtccttaattgcgtttatggctatatcttgctatttggcacctgagtgtgtttatcacactgtcttacgtatggtaggtgcttaaccaatcatgactagttttagatatgtttacttggtgtcccaaatagattctaagtaccttgagtgcagacattatgtattacatgtttttagagtatttcacaacctttagcttggtgctgagcacatgggaggtgccagttagccaaggtagtgtagacccttcttttcattcttgttatgagaagagtatagatgatattgggactccttaactccttacccatttaccaagacacatacacatgcgcacgtgtgcgtgtgcacacacaatctgtatttgatgaagcagatgcagattaatggagacacatttgatcacagggagttttatttttactctctgtgtcatcagcagtttttgcatattacctctagaaaatgttcagaaaagttgtactggtaaatagaattccaattctttgtgatggaaaaagtacttgagcaatagcgagcctatggagacagctaaatcagcagctggcagggccctctctccattctcccctctacggatcagcagtccttggtattcagaaagtagattgtaagcaaatatttttttctagtgaggccggaagatttactgtgtagtattttacagaaaatataaagtctttgataaaatgtaaaagtcagttgttgagataaaatatgactacaatgaagaccactataaatttgagtagatttttcaaagtagcattataattaagacctaatttctctctcctagcagtgtagaaggtggagaggaaagagtattatgtgacaggtaaggaaacggaggcagataaagtctacatgatttactattgattgggagccagaagccagaactcaggattcctggctaaatcaatcaaaaaattattaatgacttctactacttataagatattatactaaaactttctttttgagataactgtagaagagttaaaaagacaatatataaagatgtggtaagttaaattacaacagaagcattatagatttccaaagtaaatgatacctataccaaagggggaaaaaagaacagaaaaaagacacctcaggagattgttttgggctgtggtgttttgtagatagtaatttcccactctaagttttttctccttccatattgaacactgggactggaagataaaaccatattgattttctgtccttcaccatcttgcccaaacttctgttttttaatctttcttttagatattggaggaaaacgtttgttgtttctcatctagagttaatcccttttcttacgttccatggctcctcattgcccatttattctatgcccttactcctcagagtgcaatctgtgagccagcagcagcagcatccctggggagcttgttagaaaggcaggatctcagtcctcaccacagctctagagaggagaatctgcattttaacaagacacattccagtgggagacctgctgatctcggccattctttcaaaaatcagcccctccatttctagcaccattagtctctctttttccctcactatctccttttcccttcttgaacaatccaggggtctttattaagaaacaaaccaagaaacatccctccctactccccatctccaatgactgatatccctttcagctttcagagcacctcacttctgtttctgtggttaccacgttcctggaatgaattttatgcccctgctctctttatttttaattcagtcagtttcttcttaaaacttggaaactttcactctgaagcagtttgaacacataggccacatgaactcacacacgtgcacgtagaggcacacacatgggtgcacccacatgcacacacacacgtgcacgtagaggcacacacatgggtgcacccacatgcacacacacacgtgcacgtggaggcacacacatgggtgcacccacatgcacacacacacgtgcacgtggaggcacacacatgggtgcacccacatgcacacacacacgtgcacgtggaggcacacacatgggtgcacccacatgcacacacacacgtgcacgtggaggcacacacatgggtgcacccacatgcacacacacacgtgcacgtggaggcacacacatgggtgcacccacatgcacacacacacgtgcacgtggaggcacacacatgggtgcacccacatgcacacacacagatgcagatgattaactctgatgaggttagatcaacttttaaaatgaccatagttcctatactgatgggaacattaattatctgagccacatttggttcctgatgattttggtgtgcccactcctatcatgaatctattcaggatcatctacttgtctgtgatcctgcttaggtggctggactgacctacaccaggccaaatttactgaatgcccctgcggtacaactgtcccaatcttgaaagggaaatcttgtatctctgcataaatatcccagcagtatacacagatgcaggttcacgaaagtgaaacaaaatgagaccttgtacttaaggcctatctaagttaggttttcttcctgaatccttctgctgggtaaatcctagacgacagaggtccatctgtagtcttgtgttagacgtgaagaaaaggaggaggttgccaatagattccccaccatcaagtgtcataggaaaaagcttataccaatgaggaaccaaaaaataaaaacaatcttcttcttaattccaatgactttctgaagtcatttcatacaacaaggttggaaggttgagatgttttaaaatttactgggtaccatcacccactcaccttctacgggttttgagcaatctgctcactagtgattggatgttgtgttattcatcaggcctggctcttatgaagaaaaatgaagagcataaaagaaaagaaccaccacagtgaaaatggggctgtgctgaaaggttaatgtgctcttcagcctaggacttcagacagaacacggagcggccacacaatctgtttatctgatgcatgcagacagtactgtcatgcttcacctttggaaatgggccattacttctggtgacagattatgaattgtggaatatggctggcacgtggccagacaatggagagttcataaatcagactcaaaatggaaatacctgagtaaaattcttgagttatttgaggggttggaaaaggatatgtaatgagagaattcgttaaacccatgtgcgtggatgtgtaggtgggcacgctgtgtatgtgtatgtgtgtatggggcaggtgttgatttttaaaagtcctttgttaaggttctacaaagaagtattttttgttttgttattttctggttggctgaagaattttgcttcagcatggaatagagtggtagttggggatcagggtaaaggatggttgggataaagattttggtttttaacaggaaattggtttgagccttccaaaaaaaagagagaatcaatcaactctgaacaaaaggagtaaatagttggtctacagggattaatgtttctttattttacaaataatctgaaaaacaggcccatagatctggaaaacagccacaactgcgtagataatactacacaaattggtaaacggatgagagtaaattaaaatacaggtttataagcatgtgaaaatagccagaaaaatatcaactaaaataaagtgttgatgcataaatgcccttgaggaaaaataacctaaactccttgtaagaagacgggctctaaagttttgttttgtgatgaaggaatgaaacctaaaagtgatttttaaaactactatctgaaaatatgctccaatgtgtccccaaagaccagcacaggtaggtaatcctctagaaaggtactagtaacacacaaaaggtaggattccaatattggcaactcatgctaggttgattaagtgcttatgaccaaggagttgagagtggttgtttagttttcctcgtactcaacctcagacaacagccatcaggctgagggtaattcttcatcaggataggaccacaagagcttgttctttcttgagaagaaaaacaaggataggtaaatatatagatcattactataatgtcaccagcaaatttttaagtagttctatttgaaaaaaaaatcactatttaggcatttaaaaaatgtaatatataataccatgtacaaaaagtagagaaaacttttataagaataaaagctataatcaagacttttagtaccatctctaattatatacttagtaccacctctaatattatactttgtaccatctctaataatatatactctgtttatctaaaggctacctcatggatttttagagttctgataaatgtatcaattattttcagctacgaagtactatcctttttttttttttttttctgtttattacgaatatcaacgacttaagttctctggccaaattagtttctccagtgtggaactaacttctatagaaaccctctagtctttttgtacagttgtgacattgactaacatttttacatcagtggccagactaatcctcaggcctggagtcccacattttaggccaccagcaaactccctgtcaggtgctgcctttgcttgttgctggcaggagagtccagtgcaaccggtaggaaaagatccttcattagcaggtgctaaaatgacgggaagccccttacagagataacacatcctacctttctactttctttttctgcttaaaatgtgccttcaatcttccttttaaatggatttcctcagtttagagatgtgtaatacgaaggcatgcatcttacctatgtggcttctgatccctctgggcacctgtgtctggatacagacctgtgcccacctgcatcccaacccctgacgaggcacatctctgctggtgggggcctgtgtcaaccctgaacagctccccaaggaagctgcttttctgggtgtctgtctagccagctaacctatcatgttcatttttctggcccttagttaaaaatgctctattaggcagggcacagtaagtcacacctgtaatcccagaactttaggagacaggcaggtggatcacttgaaaccaggagttcgagaccagcctggccaacatggcaaaaccctgtctctactaaaaatacaaaaaattaggcgtggtggcacctgcctgtaatcccagctacttggaagacagaggcaccagaattgcttgaactcaggaagtggaggtttcagtgagccaagatcacaccaccgtactccagcctgggtagcagagtgaaactctgtctcaaacaaaacaaaacaaaacaaaacaaaaaaaaacaaaaaaacaaaactgctttattatccaagtgttaaaaaaaggtataggctttctttgtcaagatactttctcgaagtcaaagtcttttatcagtcttctactgtttttcagtagggtcccggtttattcctctgtcaggagcaatatacattccagtatcacacacaccaaaactttaaatacgttggtcaattttaggttatatacattatctatgtgaagtgaataatgtgcattttttctatgtttcattgcacctggtacaagtttaaagcataataatacatttccaggccgggcgtggtggctcatgcctgtaatcccagcactttgggaggccgaggtgggccgatcacgaggtcaggagattgagaccatcctggctaacacggtgaaacccagtctctacttaaaaaaaaaaaaaaaaaaaaaaaaattagccgggcgcgatgatgggcgcctgtagtcccagctacctgggaggctgaggctggagaatggcgtgaacccgggagacggagcttgcagtgagccgggattgcgccactgcactccagcctgggcgacagagcgagactacgtctcgaaaataataataataatacatttcgggctactttgtatttattctgttgaaagagaatgttaacagtctgtcttgccctgatttttcattctgatattatttcactatttccttctaacatgtctccaaaagaaattactgccagacatgtgtcttagagaaatagtgattcaataattatcagtaaattgccagataatctttaaactagccaggagtattacaagcaatatttatgctaaaaatcaatttccctacctcagaagaataattgtattttaaggtttctgatggaaaccagtctttgaacatccaagcattagacccagttccttaccctctgcataaggcatcctgttaggggctctaaagaaaatcctcaagaggtatgaaatttatatagaaggtgacacaagcttaacttcatagtaagtttaactgcattcaataagtaattcaatataaatatataaagaatggtaggagttagcatgctttccaaatgaattatagaaagaataattgctacaaaatttactacactggcactgtatagaaaagttggatgtagaaagagagataaaagttgcctttcaaataaatgggtagcctttgattaagaagtaaggaggaaagcattttgagtacaaaagctccatttgttaattcctctaaatcttcaacaaacagagtacaaagacagagaaaatgctcttcaattactttttttgatgtgagctaatacagcattaataacaaagcctgtaaaacctggttatttaagataactttaataaatacgaagtaactggtgataaatttgacaaaagatgtgcaggagctataaactaagaattataaaacatcgctgaaagaaattaagtcccagggaaatggaacaatattgtgttcatgggccagaagattcaatattgtgaaaaagatcaaaactagaggatttacactatctgatgtcaagacttattataaagctacagtaaccaagacgccgtggtattaggatatgaatagtcatacaacaatggcacagaaagtctagaaatacacatacacatatatgaacaattttaacaaaaatttcaaggcaattcggtaggcaagggaaaaaatttcaacaaatgctgttgcaactataatatatccacatgcaaaaacatggacttcaaaccttaactcatcatttataaaaataaattcaagatgtatcatggatctacatgtaagagcaaaaactataacatttccagaagaaacataagaaaaaaagggctggccacagtggctcaagcctgtaatctcagcactttgagaggctgaggcaagaggattgcttgagtccagaagtttgagaccagcttgggcaacacagtgagaacccatctcttaaaaaaaaaaaaaaaaaaaagtaaaaatacataaaaaaggaatatacaagatgatgttttagagaccttgtgttagacaaagatttctgaaataacacacaaaaagcatgaattatgaaagaagaaagtcagcaaattaaatttgatcaaaattgaaaccttttgctctttaaaggaaactattaagaaaatgaaaaggtagcctgggaaaaatatttgcaaaacatattttaaaaggcacttgtatccagagtatataaagaactcttacaactcatcaacaatccaataaaaatgggcaaaatatttgaaccatggtttttcaactatgctatcagagacactggggatggataattttttcattgtggggaggctgtcctgtgaactgcaggttgtttagcagcctcccaacatccacccagagatgccagtaggatctgaagtagtgacatcaaaaaatgccttgagatatttgccaaaggtcccatgggaagcaaaattgcctcagatgagaactactgatttggataacatgttaatcagagaggaggtacagatgacaaacctacagaacctatgataatcaactagaaactatggaaaacaacacagtttgataaagttatttaatatgcaaatattagcaagatgaaaatgcaatactgtttttatgcctgtactgtgccgtttaaattactagagctttgtagtaaatgttttcaaatcagtaattgtgatgcctctagctttgttctttttgctcaacattattttggttattcagggtcttttgtggttccatatgaattttaggaatgttttttctatttctgtgggaaaaaaaagtcattgcatttcgatagggactgcattgtttctgtagattgctttgggtgggatggaccttttagcaatattaattcttccaatacgttaacatgaatatctttccatttatttgtgttgtatccaatttctttaatcagtgtcttatatttttcagtgtatagatctttcctccttggttaaatttgttcctaaatattttattatttttttgtagctattgtaaatgggattgtttccttgatttctttttcaaacactttgttattagggtgcagaaatgctactgattttcatatgttgattttgtatcctgcaactttactgaattcatttattttaacagttttttggaggagtttttatgttttctatttataaaaaacataaaacattaaattgtctatacagatgacatggtcttataatgagatcaatttaatttcagagacaatttaatttcttctcttctgatttggatgtcatttatttcattctcttgcctaactacactggctaggacttccagtactatgctgaacagaagtgttaagagtgggcaaccttgtattgttcctgatcttagaggaagcttttagcttttcaccactgagtatgatgttagttgtgggtttttcatatatggcctttattgtgttgaggtacatactttctatacctaatttgttgagagtttttataatgaaaggatgtcaaattttgtgaaataccttttctgcatctattgacaggattacatggtttttgtccttcattctgttaatgtggcatatcataattactgatttacttagcttgaattatctttgcatcccagggatagatcccacttgatcatggtgaataatccttttaatgtgctggtgaaatcagtttgctatgttttttcatggaggatttttgtatctatgctcattggtgatattggcctgtagttttcttttcttgaagtgtccttatctggctttggtatcaatgtattacatgtttcatttatttaagttaaataaaaggactagaaacaaaaacaagaaattgctaactctgaatgatagaaatataaatgagaactatattatttttctaaacttggcatttcaagaaattatcaaaagaattcaaagtttctagaaggtaaaataaataagcacgtgtttaccatgtcagaagacaaagtacaaattcatttacaatacatacagttcaataaatgatagaaaagaatttgttcaataaatgggaagatgaatgagcctactgaaaaatgagcaaagacaaagagtggtcaattgaaaaacacaaatttacaaagcctataacaattaagtaattatattaacaattaaattgcaaggaaattttctacactagattgaccaaaaaaactaagtttgaggatatatatatatcttcacctccaccccatgatccagctgtcctacatctggacattgggtcctcttgactatttatattaaatacaagtacaagtgcaaggattttgattgcaacactgtaataaaaaacctagataatccatatagaaatcatattggaactagttaaataagtcaccgtagctctatacaacataattctatgcacatattaaatgaattagttagatctcatttgtaagataagactgtatatttaaaagacagaaaatatgttcttaagtggaaaaagcaagtgtggaagattatgttcattattactttttggttaaaaatatacatatatagacataggaaaagttctaggaagaaaaatgtcaaatgttagaagtggtaacctatgtggttagattgtgataggacctccattttgtatgttttatgtgtctgtactgtttcattacctcaacaatgtaatttttatacaaattgataaatttttattttaaaatgtatttagttttcaagcagctctttatcaaagacatggttctataagtggcttgggatcctcagtagaatttctgaagattttatttaaagggagtgagaaagtaatagaatagtatgtgtttctttaggcaatgtgctgtataatattttattgtaatctagagactttgtggtaattactaaagttaaagcagtattaccttaagctgttgactcccctcctaagtaaaaataattttaaagaaacaaaataatctatgcttttccacatgaatacagtgtttgaaatatttatatatacataaagtaggtcatatttcaccctagttgtcatcaattcatctaattcttgacatgatatataatttttaatgacttgcaaaaaattctggaagaactctctccaaaatcatctaagcattaagatcaaaagttttagtgacactaaacagaggcaaaacttaagacaatacttcctccttttctatcataaaatagataagtttagctcacaaaaacacagtacaggcagcaatggagattttccatagcatcttttgatacatagtaccgctgcaaacttcaacaaattcctaagacattttaaaattagcaattcagttactagctccaaaataaatcattgtatttatgcaatggctgagacagtcttaggaacatggtaggaagtctctctgtgtctgagtgactcaacagtctgacagccaccccaagtaatccccttgaaggtccaaagtcagaatcatttctaagatttgtcatctctagtagagtagctaatgtgctctcttggtcccttttacttaagtgaattcaataaatgatgctggaagtacttcactaggtagagtctgttaatttactaagaaaggtgtttgacttcccatagaatgtacaaactgagtttgtactgaagatttctctaagaactgtcgtaatgcttggtatttaaagaataacaaccaaaaagaatacattcagctgagagaatggttcattttaggtggcttaatgaagaaataattggatacaatttgacatttacaatttgataatgataggtagactgtacttgtccctttaccaggagaacaactatagaacagcttaggttcatatgcagaagacaccttattttttttctgcctttttttatttttttgagatgcagtgtcactctgtcattgcccaggctggagtgcagtggtgccatctcggctcactgcaacctccacctcccgggttcaagtgattctcctgcctcagcctcctgagtagctgggattacaggtatgcaccaccatggccggctaatttttgtatttgtagtagagacgggatttcaccacgttggtcaggctggtctcgatctgacctcaggtgatccacccgcctcagcctcccaaagtgcagggattacaggcacgatccatcgtgcctggcctgttctgcatttttattattacataaacagtattctggaaaggctggaaaatttaaaaatcgcctctcatcttattatgttttcccactttctgcctttatgcacataagtgattattttacacagtttaatcacaacatatgcaattttatatgatttttgaattcattttcctaatgaaaaagtgtttctcaataagcaactttcttcttaaaaatgacacagccatttcaagagggaagggtagaaaaatattttaattgaatcagctacttatgaatatagtattttatattcctttttgtaatattttggaatctcagcaaagtcgtagatcttttcctaattctgctctcattaagttactctgaatcaaacccataagtctgagtctactccgtagtgcagtattcctgctgaaatacttagagattgaagtgcatttgttagacacttgcaaattatcattcgcttaatctgtaatgtaaatgttcgctctttttcatttctaattttacttgcttgtgatttctccttttttttgtttcttgatggctcactgtccagtagtgtctctttttaacaaatgttttttgactgcttaacaattttgtgatttacaatttctcctttgatcatctttgtgtctttcatttgacttccttatattcactgtattattccatttatgccttcttgacttaaaaactgatcctttttcttttaaaaatataagtattaaaagctacatatactgtatccggaggtgtgcggggattatttttcaattcttaaaatgtgcaaatatgccttttgatttaaaagttgcttaaaggtacattttttaattttgaggatatgttagttatgaatttgttaatgattatattttgtattttattgcattgggtcagactgtagaatgtatttatatttcagggctaaaacaatgtttttgtcacttagtagtccattttgtaaatttctaagcaagtttaaaaatggtttctgttatacaggttttaatcatatgcatatatatgttgtatttatgtatatttcacatatacatatatgtataaacatatatatgtatatatatatttatccatattatgtaatccttactaataattcacatctttcatatctttttgtttacttacttttcttcctttcacatcttttggttacttactttttttttttttttttttttgagacggagtcttgctctgtcacccaggctggagtgcagtggcactatcacggctcactgcaacctctgcctcccggattaatgccattctcctgcctcagcctcccgaacacgcctggctaatttttttgtatttttagtagagatggggtttcaccatgttagccaggatggtctcgatctcctgacctcgtaatctgcctgcttcggcctcccaaagtgctgggattacaggtgtgagctaccatgctcagccaaggttacttactttcttaatctgtcttgggcggggggttgacagaggttaattaaagcctataatcaccattgtgtttgtcagtttctttttttaaccttcctttaatttatgctatatgggtttttgtgcaatagaatttgggtatacatacttataccctcattatgacctttaatatttactacaaatttcttatttatagctctgttgacatagtttatcttgaatctagctttgtacaataaaaatcaacagcagctttgttcttgttagtacttctagtatatttaacctttctaaatctaagttagaacgtttctaattcttattctaattcttctaaattagaatcttctaattctaataagaacctgttcttatgtttggtttgaagaaatcacacaacatacattcttatacacgaaagtgtctgtccatcatctagattcaaacttcctggagagctccatatttattaatttttgaatcctttaaaattcccagggccacgcataaagattggatttaaaatatatttgttagctgacttgaaatgtcaaaaagagtgaatcatcagcaatagagctgaaaaataatcgacaatccagtggtgataaatttggggcaggaattttcctggcctccctggaagcacaaaacctcagttgctacatccttcaacaatgtgcacctgctatttctgtacttggcacagactaatcggacagacacacttctagtcaataagaaagaaagcacagtcccttttcagtcaccttgcctttactaccaatcaatccacaggcagttctactttggaacgagagtttaactgccctgcttgcttctccgagatc

SEQ ID NO: 721 - DNA, 2168 bp, Homo sapiens
ggcgcgcgtgaacgcggtccccgggaccatgctgcggccacagcggcccggagacttgcagctcggggcctccctctacgagctggtgggctacaggcagccgccctcctcctcctcctcctccacctcctccacctcctccacttcctcctcctccacgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgccgcgcctgctgctggccgggctgcccctgctcgccgccgcgcccggctccgtgttgctggcgcccggcgccgtaggaccccccgacgcgctgcgccccgccaagtacctgtcgctggcgctggacgagccgccgtgcggccagttcgctctccccggcggcggcgcaggcggccccggcctctgcacctgcgccgtgtgcaagttcccgcacctggtcccggccagcctgggcctggccgccgtgcaggcgcaattctccaagtgagggcgggcctgggcctggggcgcgacctcggcccggcctcccttcgctcagcttctccgcgcccctgctccctgcgtctgggagagcgaggccgagcaaggaaagcatttcgaaccttccagtccagaggaagggactgtcgggcacccccttccccgcccccacccctgggacgttaaagtgaccagagcggatgttcgatggcgcctcggggcagtttggggttctgggtcggttccagcggctttaggcagaaagtgctcgctctcacccagcacatctctctccttgtccctggagttgcgcgcttcgcggggccgatgtagaacttagggcgccttgccgtggttggcgcgccccgggtgcagcgagaggccatccccgagcgctatctccccggagcggagcacgccggctcccagtactaggggctgcgctcgagcagtggcgggggcggaggggtggttcttttccttctcctccgccagaggccacgggcgcccttgttcccgccggccaggtcctatcaaaggaggctgccggaactcaagaggcagaaaaagaccagttaggcggtgcagacggtctgggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttagaaagcaacttagaactcgagattcacctttcgtttccctttccccaaaagtagcgtaaccaacatttaagcttgcttaaaaacgaaaaccaaccgccttgcatccagtgttcccgatttactaaaataggtaaccaggcgtctcacagtcgccgtcctgtcaagagcgctaatgaacgttctcattaacacgcaggagtaccgggagccctgaaccgcccgctgctcggcggatcccagctgcggtggcgacggcgggaaggcgctttccgctgttcctcagcgggccgggcccttgaccagcgcggcccgcaggtcttccttctcgccgtcttgcagttgaagagctacatacgtagtcagtttcgatttgttacagacgttaacaaattcctttacccaaggttatgctatgacctttccgcagtttactttgattttctatgtttaaggttttggttgttggtagtagccgaatttaactggcactttattttacttctaaccttgtttcctgacggtgtacagaatcaacaaaataaaacatttaaagtctgattttttaaaaaaaaaaaaaaa

SEQ ID NO: 722 - DNA, 2505 bp, Homo sapiens
gtgcggatgcttattatagatcgacgcgacaccagcgcccggtgccaggttctcccctgaggcttttcggagcgagctcctcaaatcgcatccagattttcgggtccgagggaaggaggaccctgcgaaagctgcgacgactatcttcccctggggccatggactcggacgccagcctggtgtccagccgcccgtcgtcgccagagcccgatgacctttttctgccggcccggagtaagggcagcagcggcagcgccttcactgggggcaccgtgtcctcgtccaccccgagtgactgcccgccggagctgagcgccgagctgcgcggcgctatgggctctgcgggcgcgcatcctggggacaagctaggaggcagtggcttcaagtcatcctcgtccagcacctcgtcgtctacgtcgtcggcggctgcgtcgtccaccaagaaggacaagaagcaaatgacagagccggagctgcagcagctgcgtctcaagatcaacagccgcgagcgcaagcgcatgcacgacctcaacatcgccatggatggcctccgcgaggtcatgccgtacgcacacggcccttcggtgcgcaagctttccaagatcgccacgctgctgctggcgcgcaactacatcctcatgctcaccaactcgctggaggagatgaagcgactggtgagcgagatctacgggggccaccacgctggcttccacccgtcggcctgcggcggcctggcgcactccgcgcccctgcccgccgccaccgcgcacccggcagcagcagcgcacgccgcacatcaccccgcggtgcaccaccccatcctgccgcccgccgccgcagcggctgctgccgccgctgcagccgcggctgtgtccagcgcctctctgcccggatccgggctgccgtcggtcggctccatccgtccaccgcacggcctactcaagtctccgtctgctgccgcggccgccccgctggggggcgggggcggcggcagtggggcgagcgggggcttccagcactggggcggcatgccctgcccctgcagcatgtgccaggtgccgccgccgcaccaccacgtgtcggctatgggcgccggcagcctgccgcgcctcacctccgacgccaagtgagccgactggcgccggcgcgttctggcgacaggggagccaggggccgcggggaagcgaggactggcctgcgctgggctcgggagctctgtcgcgaggaggggcgcaggaccatggactgggggtggggcatggtggggattccagcatctgcgaacccaagcaatgggggcgcccacagagcagtggggagtgaggggatgttctctccgggacctgatcgagcgctgtctggctttaacctgagctggtccagtagacatcgttttatgaaaaggtaccgctgtgtgcattcctcactagaactcatccgacccccgacccccacctccgggaaaagattctaaaaacttctttccctgagagcgtggcctgacttgcagactcggcttgggcagcacttcggggggggagggggtgttatgggagggggacacattggggccttgctcctcttcctcctttcttggcgggtgggagactccgggtagccgcactgcagaagcaacagcccgaccgcgccctccagggtcgtccctggcccaaggccaggggccacaagttagttggaagccggcgttcggtatcagaagcgctgatggtcatatccaatctcaatatctgggtcaatccacaccctcttagaactgtggccgttcctccctgtctctcgttgatttgggagaatatggttttctaataaatctgtggatgttccttcttcaacagtatgagcaagtttatagacattcagagtagaaccacttgtggattggaataacccaaaactgccgatttcaggggcgggtgcattgtagttattattttaaaatagaaactaccccaccgactcatctttccttctctaagcacaaagtgatttggttattttggtacctgagaacgtaacagaattaaaaggcagttgctgtggaaacagtttgggttatttgggggttctgttggctttttaaaattttcttttttggatgtgtaaatttatcaatgatgaggtaagtgcgcaatgctaagctgtttgctcacgtgactgccagccccatcggagtctaagccggctttcctctattttggtttatttttgccacgtttaacacaaatggtaaactcctccacgtgcttcctgcgttccgtgcaagccgcctcggcgctgcctgcgttgcaaactgggctttgtagcgtctgccgtgtaacacccttcctctgatcgcaccgcccctcgcagagagtgtatcatctgttttatttttgtaaaaacaaagtgctaaataatatttattacttgtttggttgcaaaaacggaataaatgactgagtgttgagattttaaataaaatttaaagcaaaaaaaaaaaaaaaa

SEQ ID NO: 723 - DNA, 2196 bp, Homo sapiens
agttcaagcacacaccaactagctgtccaggaagcagcctaaccagagagaggggcgtgggagggagagaggcggggaaaagcagcgtctccgcttttcttctcacgtcttgccgcggagaagtgggttcctgggcagtgcagattttttttttttaattcaagattttctttaatttcccgcctaaagcctccccacggtagggccgcatcccctgtaataaaatgaattctgattcgagctctgtctccagcagagcttcatctccggacatggatgagatgtacctgagggaccaccaccaccgccaccaccaccaccaggagagccgtctcaactcggtctcgtccacgcagggcgatatgatgcagaagatgcccggggaaagcctctcgcgggctggcgccaaggccgcgggagagagcagcaagtacaaaatcaagaagcagctgtcggagcaggacctacagcagttgaggctgaagatcaacggacgcgaacgcaagcggatgcacgacctgaacctagccatggacgggctgcgcgaagtcatgccctacgcgcatgggccgtcggtgcgcaagctctccaagatcgccacactcctgctcgccagaaactacatcctcatgctcaccagctccctggaggagatgaagaggctggttggcgagatctatgggggccaccactcggcctttcactgcgggaccgtgggccactcggccggccaccccgcgcacgcggccaactccgtgcacccggtgcaccccatcttgggcggcgcgctctcatctggcaacgcctcgtcaccgctgtccgccgcctcacttcccgccatcggcaccatccggcctccccactcgctactcaaggcgccctccacgccgcccgcgctgcagctgggcagcggcttccagcactgggctggtctgccctgcccctgcaccatctgccagatgccgccgccgccgcacctgtccgctctctccacagccaacatggcccggctgtcggccgagtccaaggacttgctcaagtgagcagcgggcgggcccggctgccaaggaggagggagagcggcgggaggggccgcggtgccgggccgggagggaagagggaggctgcacgctcggcccacgggagggcaggctccggggcccgcagcctcccacgctgtctgagagatctcagactccacttgacccccggagggaaaggaccaaaatcaaaccgcaatttctaggtggtagcaaagggggactcgaaccagatgtcgtgtgttttgcatgcatgcttcttttccccatgccgcgccagtatttttcactgccatatgctcttgtcaaaactgcatttgttgtataaagatgggatcggtgtagttaaaaacttgcgaagggacttttgagttggctttctctgactctgtgttctcgctttggaaaaagacggccatcccttttgtgcaaaacaaatgtaaatattttcttgagatggatgcgattatgattgtctctgtccttgccacagtttttctagagacaatggagagagaaagagagagagagcgcgagagagatcaagacccaagttttgaatctcaaccgaggtccagggcatgacacctcctatgtgggttttcctttcgacgcagtgtaggtcaaaagaatgcatgcacgcttctaaatgaatcttgtctgaatatgtcgtgcaggctgtggtgccgttttccttgtaacaaggatttattagtgaattatcccaagtactccatatatctgtctgtggttgtatgaaatgaaaaaaggggcagagtgcaaagacccacactcacgcacacgcgcttcttctcccacccccacccccttcaaactttattcggaaccttcctttgctgttctggggccgctattgtaaaagcctgggctccctctagtagcttgcgccaccccccctcgctcagttattctgcatgcggggttggctctctctattatcagctttgaaaacttatcctggttttgggaggggtgccgtttttattttcctgaacatttgcttgaaatattttgttagggcctcaaagacgatacctgtctttattttttatatattcttgataactatgatatatttattaataaccagtgtttctggatgagatttcaaataaaaaagaacctttaaatcgtg

SEQ ID NO: 724 - DNA, 1925 bp, Homo sapiens
ccccacagtgagaggaaggaaggcaacagtcgccagcagccgatgtgaagaccggactccgtgcgcccctcgccgcctctgcctggccacatcgatgttgtgtccgccgcctgctcgcccggatcacgatgaacgcgcagctgaccatggaagcgatcggcgagctgcacggggtgagccatgagccggtgcccgcccctgccgacctgctgggcggcagcccccacgcgcgcagctccgtggcgcaccgcggcagccacctgccccccgcgcacccgcgctccatgggcatggcgtccctgctggacggcggcagcggcggcggagattaccaccaccaccaccgggcccctgagcacagcctggccggccccctgcatcccaccatgaccatggcctgcgagactcccccaggtatgagcatgcccaccacctacaccaccttgacccctctgcagccgctgcctcccatctccacagtctcggacaagttcccccaccatcaccaccaccaccatcaccaccaccacccgcaccaccaccagcgcctggcgggcaacgtgagcggtagcttcacgctcatgcgggatgagcgcgggctggcctccatgaataacctctataccccctaccacaaggacgtggccggcatgggccagagcctctcgcccctctccagctccggtctgggcagcatccacaactcccagcaagggctcccccactatgcccacccgggggccgccatgcccaccgacaagatgctcacccccaacggcttcgaagcccaccacccggccatgctcggccgccacggggagcagcacctcacgcccacctcggccggcatggtgcccatcaacggccttcctccgcaccatccccacgcccacctgaacgcccagggccacgggcaactcctgggcacagcccgggagcccaacccttcggtgaccggcgcgcaggtcagcaatggaagtaattcagggcagatggaagagatcaataccaaagaggtggcgcagcgtatcaccaccgagctcaagcgctacagcatcccacaggccatcttcgcgcagagggtgctctgccgctcccaggggaccctctcggacctgctgcgcaaccccaaaccctggagcaaactcaaatccggccgggagaccttccggaggatgtggaagtggctgcaggagccggagttccagcgcatgtccgcgctccgcttagcagcatgcaaaaggaaagaacaagaacatgggaaggatagaggcaacacacccaaaaagcccaggttggtcttcacagatgtccagcgtcgaactctacatgcaatattcaaggaaaataagcgtccatccaaagaattgcaaatcaccatttcccagcagctggggttggagctgagcactgtcagcaacttcttcatgaacgcaagaaggaggagtctggacaagtggcaggacgagggcagctccaattcaggcaactcatcttcttcatcaagcacttgtaccaaagcatgaaggaagaaccacaaactaaaacctcggtggaaaagctttaaattaaaaaaaatttttaaaagaccaggacctcaagatagcaggtttatacttagaaatatttgaagaaaaaaaagcgttatttatagtccaaagaaaccaaagacttagctcacctgcattctgactttgtttggagacacacacttcagcagggcggcgacttggcaagacaaatgatgagcaggaaaacaccactggatctcacaccttcaatccatgaccatcctcgctgtgcttggctgtttagtggtttggagcatagtgattttgagccattgagcggacatcttttaagatcgaactttctcatctgttctaccatgccacgaaggtgtatggtgtctcagtactaccacc

SEQ ID NO: 725 - DNA, 16142 bp, Homo sapiens
gcccccgccgcccccgggccctgatggactgaatgaaggctgcctacaccgcctatcgatgcctcaccaaagacctagaaggctgcgccatgaacccggagctgacaatggaaagtctgggcactttgcacgggccggccggcggcggcagtggcgggggcggcggcgggggcggcgggggcggcggcgggggcccgggccatgagcaggagctgctggccagccccagcccccaccacgcgggccgcggcgccgctggctcgctgcggggccctccgccgcctccaaccgcgcaccaggagctgggcacggcggcagcggcggcagcggcggcgtcgcgctcggccatggtcaccagcatggcctcgatcctggacggcggcgactaccggcccgagctctccatcccgctgcaccacgccatgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgccatgctgacccgcggtgagcaacacctgtcccgcggcctgggcaccccacctgcggccatgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcagcgtgcaaacgcaaagagcaagaaccaaacaaagacaggaacaattcccagaagaagtcccgcctggtgttcactgacctccaacgccgaacactcttcgccatcttcaaggagaacaaacgcccgtcaaaggagatgcagatcaccatttcccagcagctgggcctggagctcacaaccgtcagcaacttcttcatgaacgcccggcgccgcagcctggagaagtggcaagacgatctgagcacagggggctcctcgtccacctccagcacgtgtaccaaagcatgatggaaggactctcacttgggcacaagtcacctccaaatgaggacaacagataccaaaagaaaacaaaggaaaaagacaccggattcctagctggggcccttcactggtgatttgaaagcacaattctcttgcaaagaaacttatattctagctgtaatcataggccaggtgttcttcttttgtttttaatggctatggagtccaagtgcaagctgaaaaattaatctcttagaaccagacactgttctctgagcatgctaagcatcccagaaacccaaatggggccttcctggagcgagttaattccagtatggtgtcaaccaagctcgggattgcttaaaatatcatccatcccacttcaggtcctgtcagcttcttgcagtcagagttcctatgagtaacaataggagtttggcctatgtaaggactctgagtttaggcttccaagatacaacaataagagaagaatctagcaacgagaatgacctcatttgctttccacatgcttagcctcattataccatgttatgtccaagttcacagccacaacatcagaatggtaattactgagcacaagttttaaatatggacgttaaaaaaaaaaatccaaggacctgtttttccaacccagacatcttttcattgaatgatttagaaagctttaagttgatccagcttacaattttttttttctttacctcctggaaatctcatatggtcttggatccgtcaaaaaaaccagtcagttcacttgcgctcaaagtatcaagcacaacaaagataaacagaagtgaggaaggttctgggttcactacatctggattttcaagacacctattgtgaagtcattagggaattgatgagaatatggcttcaagcacattttgcagtttgctacaaattctgttgtacataatgcagacgcacactcaggaggccaatttaactgttaacagtgcatggagcgaatgcagcattttaaaagatctaggtttttttaggtcattaatgtgtccttggttgatcagtcatctggtccctcctactgtgtgttatgaccaccacgtaatccattctcgctctttctgatttggggtttttcctcatccatcccattagtagggatgttttctgtgttttctagcaagaaaaaaaaatcaatcaatcaaacctgcatacatgttactcatgactgtcatctagtcctaaatctcttctgttgttgaatcatccttgcaaaacagctgaatacatctggagaaaacacagcacaccaaagaagcagaatactgcaaaccaaagacatttatgacttgtcattttctagcctaaaaatactgtgattacttttagaaatcagaaaacctctgcaactccgaatggcattcagctcttgcatttggcgcatcatcgggctgagcggaccagctacaccaaggacattagccaagccacccagaggggtggctttgccacaccagttgtcaccttcccatagcaagtggaagagcgcccacagaactctgggagattgcaaaggtcacaatgtgcatatttaccagtgaatggccccgggtggggccacgtgggggtgttcaaagcaagccaaacgctgcaatcattctttacagacacttgagactgacttttttatgaattacttagtcgaaaccaaagaaactttttctgcacctacttctgcaacaaacaaaactgtcccattaaaatgaataaataaatccgtaaatcaatggaaatcaccaccaataagaaggaagcacgccagaaaataaacgaaaacaaaaacagggagacacactgtgttcaaacagacctcttgggacattttttggaagcagattttaaagaaagggttgagacaaagatagaaataaggaagagcctcagtggctgctgcttcatttgacaactcacacggtaatcttaaagctgaagattgtctttaatttgtgcctatgcagtttttcaaaagaacacggaacagagcaacagaaacctcaacagctacaataccaaagatgaggatttctcacaccttttgtttcagttcattatctcctcttgcctggctaaaatactaatagcgccattgaactgtataaaggtaatcaattatgtttctctgagcaacaaaaggaaagggccatttatttgattttattgtttcatttcaattttgtcttatggttttttgccccaacatggaatctctcaaaagtttccatggactccaagtttaagatgttgggatattgaacagttctctctgctcagcagagggtagggaataacattatcacttgaatgttctttgcttaacccttagacttggttccttctatgttcagagtctcatcatcaggggaaggaaagggagtgagggtcagggataggggtcttggtgatgcatcctctcccgagccacagaaccaaagagtttatagaggaatttacagcctcgttttcatgtgattgctacatcctaacagggcttcatttgggggtggggggaaacatgtaaaaataattgccagtttctacttttctattagctttttaaaaatcagctgtaaagttgcatttctaaagaaagatatatataatatataaaatacatatatagatcaacttgacattggtgataaccaaaattattgctgtccaaattcatgtcttgttttggtccagtgcttcatttgctaagtattcggttcagaatttttctcatttctcatgccattccagagttaatttgccactgtggatgatttgaagtattcagatctctatggaagtttctgggacaggtttaaagtcaagatcaagcattttagcatttaacctgttgataaatggatccatggtgtacatgagttttatttgtattcggagtcatctctattctatccctcagcctcgattaaggtggtgagtgaagtgcatccaacagactcggcccagaactgggtcctgacagtggggtgctcatcttctgtaactgttgggaaggctcggtggtccattttcaccagttaaagaatatgaggccagcccagaaatctgttctccaggagctgccctgtcccatctgggtgtgccagaccccctcagtgagcaggtccaccaaagggacttctcacaggggaagcccaactcctgttgcaatgggttgatagatttcctcagggtggtaattaccaattcgtattttgacaagcctatgtgcaaccacagctggcactggggtgggcagtggtgttgggtgggatgggggagagtgtctcaatcctgaagagaaaatataaagcaggttttggggagacttctggagtcctgcccctagagagccccattgttgttctttgtgccccctcctcattccccctatgtgggtctccctatgcaggagctgtgagagaatgtgactctccacaatttttataattcatccttcctaggagattgttcattggctcttcccttgtgtccctttgtcccttgctcatactccatgtttcctttgtcaaaggactaagaaaagagcatatttcagcagaggagtgttcccatgtgggttgatttcaacttgggtatttctaaaagagtccttgtgacatgtgtccagtggaaatggttgctcttttccagactggattgaggaatggagcctgtttgatttggttagtgattctttgacatactaatctcagcgtttgggtctccagcatcctctgaagatgtctagactagtagaggctgcctttgtgacctgacattacaacattggtcaaaccagtcctctgataatcagaagaacatgtcataattgtttaaaaaaaaaaaaaaggcaagaatttctctccaaggagctttaataaatgtctcattccagataatgtcataccagagaaaagtgcttgcttttagaaaattatttacatacatatataaatatatatgtgtatctatacagttatgtatcaaaattttaagccctgcagaatttcaatttgttagaaatctaacagaaaaaaatttctatattgaaaggtaatagaatttaacccagtgagtttactcaaggatttttaaatttaagttaataatttcagagaaaataaccatttgggtgtggttatagtttagtatccattacctcaatccaaggaaaattccaggcattcctcaaccatcaggaaaaggtacagtgtgaaggaacagttctcagccaaatttcacattcttgaggcaacagaaatcaaaacactcagagccattgagtggaaaaacaatttactttattcctttacacaaataggcttgcattgtttttgttttaatgtgattttggtactagggatataattatttcattccaggaaataataaaaaaaaacagacagagccaatacatttctttttttaaaggaaacagcaacaacaataaaaactcagcaccaatatttaaaagcttttccaaaatgtaaaagaagtgtttagcttgcaccatgcataaaggtgcaggctagttgaaccaggaagcatggcacttcctctggagaaatccagaaagagttgcttctaagctcccttttccccctgcaggctcttggcaattgtaggctttagcaaatccagaataattttcaattcaagctaaaataaaatcaacatttggaatgtaaatctgatacacacacacttttctaagtcaaacaacatatttcaaaaccaaaaataaataccttttagataatcagttattttctttgtctatactgggcacccacctactagtgccagtaaattcaagttgaacagatttttaaaatcactattatctgggtatgggggaaacttccccacttttgaaaatgttggtagaattataggaatgtctgtttgattatcattaccaaagtgtcatgacagtatgcctttgtagtgaactcggattttcaggagtttgaatagttggatattttaaaatctaagaagaaaaggcctgtttccaatgttgttgaagaataatgaactctattaaaaagtggagaaaaagataatacatgtggtcaaggttgaccacaaggcccaggcacaactaccttggcgataatcttctagattcgtaacaggttagagctgactttttgtttttgttgttgctgatgctgtgtgattcagacttctcagcctaaccaggaagagtaagtggaaatggtagatgaagaaggggtagagctggtgtatctataactttctgatatttgtctgccaaacttgatatattagtaatttttttatctttagctaagatcaagtcacccctgaaacaacaggagattctagttttaaaataaggccacaaaaatccttacggaatgaagaatggcaccccagttggttgtataagtctcataagataatgatgttgattttaaatatggatgtctcaatgcctgttttctatcaatgatttgtttgtttccaaggtcggggagggaaagaggggagggtttatctgttttagaaagtctcagaatacttataaaatacagaagtagttattaaaatatataggacctcacataggtagatacagaacttaccattgaggctgatgggctgttgtgtgaatcacacaggaccttaaatgaggctcattattctcacacaccaaaatgactctgacagcctgaagcagttattgctagagcccaagctttccttggaggttttggagttaggttgattggaagtaaccagctaataccttttctagtggagaaaaagacattgctaccagcttgttcatcccatagaagtcttccactctgctccatttttagcagcaagcatttcatgtagcataaaccttggcagataagtgtgcctaaggtttatacagtctgtccgcttggatgtatacaaatttagatacatattttaacatgtgttctcatagatgactttataacaacacacattacctataggtgtctagactgtgtacatacaagtgtgtacagacaagcttcatacgtatatactgtaatccgttacaacaaataaattttaaatcatcgtttaacatgtatgtggtacttctacagtgtacattgttttcattatttattgtaacattgaaaaccacagtgcagggaaaacaaaagtatcccagcatcttcatcctgtacacttggaattaatttcatttgggcatatccaagataaactcaactttcaagaaatcttgtatattatttaatcatctgtgttaggatgacacctatgattgatgacttcggttgaatagctttattctggatttttcataactaaagctaaatccaaagacctgaaaaaggacaaaaagaaaaaaaaaaaaagaaaaaacaaagaaaaagaagaaaaaataataaagtcaagcgcaaactgatggggagacagtgggctctggtttccaggattgagacaatggtactgcggtcttggggagactgcgttagctagtggggagtggtgatttttttcatgcttgtcacatctaaatggtctttaacatgagaaagttttagaggttataatttcctgctttgtttttatttagactatcaaatgaagttatacatgttgtcagtcaaaaaatgaagacaccctctgccccaccccacagaatgctttttatcttgtctctttgggttatgacccaacaagctaagtaccattaatgtaattaacttatttaaattagttcctagtacataaatgtataggatttgggtaattatttaatcatccttccttagtttgattctactccttgtacttatttatcaaaacctagaccaatggtgcatcagagatgcaaaattctacttggaatactcttgaagtttagtttgctttataaagcagtgaaattctgttacagacagggaagaaatacaggttacaaaaagagaatttgggatattcttccctcttaaattaacttttaaaatagtctaagtaacaatttttaaattatttaacttaagttcgcagccccacctggtaccaggcgaacttcacctcttaattattgtggccctcggagccttcatattgtaacttatttatttaacttattcagcatctgtgaaaggtgcactgtatagtttatatttttaatttaaaacaacagagagcactgcagtttgtttgctgtcagaacaacagagcaaattttgtggacaagcaatgactattcagcctgaacctgtgcattcagaaaacataagctgagaccctgcttcaccagcctggatttcggggcttctatacagaaactggaaaaataaattttaaaaaaatcgtaaacaaaaagagagaaacccttacactagctgcttccaagaatgaactctgtgtgtatgtaaagcaacaaaacaaaaaaggaaaaaaacaaaaagcagaaaaaagaaaaaaaaaatgaaaaactttctatttctagtgagaaccaaagaaggctacctcactgactttttccatttgtaattttaatcgtgttgatgacaccaaagataccaaagatttctttctctgtgcggtctgcattttgcttgtgctcttttataatttgaacgattttctctgacatatggtatgtacagccacagctcagataccccaaagaaataattatctatgcgacggcggctgctaatttggaaagggatattttctgtgtttctcttatatgtttgctgtctgctcgacatgttcaagatgcgagttcagatgctgctgtaattggattccttaaattctgattacaaattgaggaaggaaactggttggaaatggccttcagtcctagccatggcctctatccccgctgggacctgtcacagtaaagactgccaattactgaaccacagaagctctgaccattgagtagttgagctggaagagaccttaggaatcatttagtccaagccccggtggcccagaggaatgaaatagttatccaaatcaaataactcttgagagtgaaagcccacacatgcctcctggttcctgccccagtgctccgcttattgtacagtgctacctctgcatgagagcggtcccacattgacaaataggatggtggcaatcctttagcaatgagcagggactggggtttatctcttaacattttcagctgtaaaattagtcacaagcattttcagtgtcccattagtacatagtcacatatggtcggttgcttcgtgaaggtggcctgtcttgaaatactagggctcatacgggatttttgccctaggaaaaacatgttgatcccaatgatgtgatcacttttgaacctttccattacaaagcattgtatagataactttttaattcagtaggaggagaaagttcattcttggcctgttggctttgattattatgggtactttaaagtcagtatttatcaagaaagggaacttgaccaccattggcacatgtgacatttaagctcttcagccttttcctttttagttgtaggtgtttacatttcatttctaagccaactctgtatttatgagagaagtttaagccttacatcatttgatactaaagggttatttgtggtaaatgaaaaatgaccccaaaattacagaggaatatgccagtttaagaaatggctacttaaagttgcttctctctttccttcttactcatgaaattaattggtcttcttcaagtttctttagattccattaaatgattaaatcactattaagagccattcatcaacgtgatttgtgtgttagccaatgaatctgtctcagcttttgaccaaatgggttttagacaaatgcaaagatctgcctctagtccatatggctctttttgagtgctagtattttgcatttcacataatgtagttattttgagcttttaaagagagcatttagacaaagaagcaaagagaggaagggaccaatcaactcatcagttccatgcatcaacaaagcatagctagtagaggaatataaatgacagattgacaaactgtaggaaacactgttactctctttctgaagttttcaagcaccatcctatgtgaaagttccctcctgtccaaacaagctcaaggcccatcttctccctatacaaggcaaacctgtaaggccttccttccaaagagtacattgctttggttttcttcctaaattcctattggaattagaactctcagaatccctgggagacagagcaaagatgacttaattcattgagcagcagagctccctataagtgaacatcaccttccccatctttcctactgccacacccatacgagagaggatctagaaagagcgatggcagcctgaacacagaaaacatccccacttggcagacctctcctcagcaatccccccagcctcatgcttcacttgcaaagtgtgacataaccacgggacgagtgccttgcttgaaccaaagcaacgatttagccagtctggacctctctgtgctttttttaattcttcctgtgaatacctcagcttcaactgggcctccatacagtcagttggtgggcttattgtactgtggtgctttgcaatgcaaccctgcaaagaacaagatttgtactaataccaaaggttctttctctatgtctcctcctctgcctccctcgttcttcccttttttctagttcttcacggttccaaagctttactatgaacctgggcatgttggcaatgcagaccgcgcaattccttaccgaattttctcagatatacctcatagacaatagtgtttagagtaatgttattatagcgtatgtaataaattattcactgtttcttttggtaactgtgatttaaaaaaagaaaaaagaaaaaaaagctttatacgttttaggttgtgcttttgtaatagatgaaaaaaggtgcgcttaaaaagaaaatgtatgtttttttccccctttggattttatttatgctggattggggaaagttgcagaatgagcccaaagtttacagtttcatattttgctgaagaaacaatctgtgttcatttgctctgttgaaaagaataattattttctacatttgtgccacttggtctgaacaattaattgttccgtgttaacagtgtagtattatgattagcaactgccaatcagtgctataattttatgcatgaggctaaaaatttagcagtgtgatgcattgtggtcttaatagcaacatttttcattttgaactagatcttcccctttggttcaatggactttatttatgcatgggcgcctattgtttgttagcagttgtggaacagttgtgtatacattaaactgtgaaaatgtacacagttcagcctcagacggtggtaatattggttttattgggagatgtgtcacctcgaaaataccctttacatctgttgggatctgaaaatgagtcacattgaattgggttccagctttataatgagaaacgttattcctaatttttgagttagccaatttgcattccacaaattgggatcctcataacccaaatatatcaccgtatgtgagagggatttgaaagcgagtattgaaaaactcacctttgcatatttaatttccaccaaaaggagttattttggctttatgctcatgaacttagacctaactggccatgtatatgtagatgcaaattcatctagctgtggccctctttgatctctgcttgggaatggctatttttgactatgcgtggtttcttctcgtattttgtgatcaggtcagctcccagtagaaactcaaatggcatcaatattactaactcttctctgcccacttctcttttgtccactctcctagacattcccaccaactgttccagtgatttgggcaaaaatacgcagccatttcccaaaacttcacatgtgcagctatcatggctgtccctccctagacttggaggtgactctcacttaatttttacctgcccaacaatgttccatctaccatctaaaaggtaatataagaagaagttttgaaacccactttaggaaaaccatcttctttaaatccttcaattatctgaggcctctatatgtcaaaactatttttcagttgcaggggattgggcaaacttgttctttcttatacttgggttcaaagacccattctccagtttcatatttcccaaaccaaaatgcttgacataaagccaaatcaactgccaagcacactttattttgcataggagtatgcagcctagggaaccttggttgaaaagcagcagtctgctatgcaaaatattggaaatcactgacagtgtagcattcatattatctgtcaatgagggtatattgggaacgtgctctcgtgaataataaaaagcaacatatttttatttggccttataaattaggttgtggtaatgtaaactttgatatatagtctttttatttttctcttattaatctgccaaagatgggaacagatacaagaatttttcaaattggcttttgtaagacaattgatgattgtaatagtgtttaatcttccagaaagctttatatgttgttccacaataaaattgatatttgtttcagcaaagttttcctgacactcacaaacccacaaactgttcctcttaatgcagatattgtagaatctacaaagttcaaatccatttttgatccaaagaaagtagaggagtatttgagacatgagtgtacccagccctttttttaatcacaggcaatgcatgggtctggctggttacactttgccaagaagacttgtcttatgaaacccaaggtatattttgttatgccattttatgtccttttcttttaacattgtggaaagtggtatgttgaatcaagtgtaagctgagttttccagacaactgaagtagctacatcatgaatgttattttgttattaaagggtttttactcagtgctttgtgccaatggatgtccttttccttggagacacataactacaaaattacctcagcttggcctggttttctctcctgccctcttggggaaacatgggcctggcctgggaaaaggcaggtcatgggctggaaggtaggttttggtactaggaagaaatctctgtatctgtcagctttaaagagaactgggccaaaaatctctaacctcactctctctggactccaacacttccctgcaatcctttggtcttgagcatgtgccagcatgaaggcagactccagttcatacatgaaaggcaagaaaaagaaaatagtaaccttgaatcttctgtgggccaccaggcactcacctttccccaccttgcacactatccagtcaaggctattgcagcccatctggtggctttacatgggacattaccaaaggcttcttcctccatcctggggttgcaaaggatccaggtcccctccatccagtggggctcttccacatcagaagtccccctcccaccatcctctgcatcctgtttagctatcccatctataccttttggagatgattatttagaaaacaaagaaaggtatggaatggggtttcctattgtttgctaggttatattttagcaattctcaattctttgatctggaaaaatacaagagggaaaaggagaccccactatctccctgtgctttgctcccatctcagggggcaggggcagtgcacattgcctatgctgttgatctgtcttgggcgacaggctgaatcacagctattgccccagccaaaaacatggcccatcaatgcctactttatctctgcttgaaaatcctattcaaaaagttgtagagtttgaggtttttatccccccatatcctttgctttggtccagtttggcctttagcataagagtcagctttatctctaggaaagttttttcagattatgacaaggaacctgccacctgggaagaaaagagtccgaagactagcaatcggataggtagtcataccattaacagatacttccttgaaggtagaatattatttcctttctttacagttttgtgttacacaagtccaagtggtgccagcaaacttcttaccgtgaaatgttgtaaaacacctggcatactgaaatttctgaaacaaaaacacaagctccacattgataacttgataaataaccactaaagtttagatgcagggactgagatgatacaggcaaaatcttggtgttggtttctcttttaattcgtatcttcgatcacctaacctttctcaatccaagagcagttcagtcttttctccccaagtctaggatgccaaagagcatcataggaaaagataattagggattgaccagcatttcaattagttctcttcttcatctttgcatttctcaaaagtgttctcctggaccagagggaaagagctggtccattttttttcattctttctattcaaatttttccacccagacaatactttattaacacagatactgtagatccttccttggtcagtgaattattacaagaggagctatccttccaccaaagtgagtgaaaacaagttccagtatcttttcttccatccagttttgttctcagaatccaagtcagtcctgggtcttttctcactttagaccctggcctcagatgtgtttattcttgctatttaaaaatacctttaaatttcacatgctggcctgcagaacttgcatcctttgttctatactgttgactgcttgatggtattgaaaggtgactataatgagggaagaaaggaggaggtaaagagagaagaatttgtcccagatctgtttaaagtttcaaaatttaaaaagggacccattaaattatgggaaaatggctatagagtgtgagcctccgttgaccatatgctcaaagaccgtactctgccacctgccttccaggtagctattctagaaactcagtcctttgtggaaacccaactaccttttaaaagtctctttccagattccaaaaggacaagagatcagagagtcacatatacgcctcttgttttattttcttgctttcacgggtattattgccaagaaaatcgtagggaaaaactttaaacttttcttttcagttgatccctttgacatcacctctcatgtttaaaatcaggaaaacacacccctaaaatttgcactctcttccgttttgaaaaagaaaacccacacacaaatgcacactattaccgtctttcaccctgcgctatatttccaaagtgtattataatccagatattgccccatctcaaacatgttaagtcagactgtgctgaaagactttccagggacggtcaacagggtatatgttcagtggctgccctgaaatcctggtggggatgaggatcacgcttcatcatcaaggggatgcccatcccctgataagctcccagtccttttggaagatttctttgaatgttaattgcattttcagttttgctcatttcccaccccaatgttttgtctgcaacatcgcttacactggattctttctatttttattcctatcattaaatggtagtgctgtaaattctgcaattaatgttaaataaactgctttaattcattgaaaaaaaaaaaaaaaaaaaaa

SEQ ID NO: 726 - DNA, 3376 bp, Homo sapiens
ggcgcgggcagggagcggctggctgtcagctgagccgcgctgggcggggtcgccaggccgcgcatcagccctaggcaccccagtcccggctgccccctccgccaccgccgccgcccgccggcaggttccctggtcagcgtcccatcccggtcgggagttctctccaggcggcacgatgccgaggaaacagtgaccctgagcgaagccaagccgggcggcaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggcccacgagaacagtctccactggcacggcattgtctaaatataggagcagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatactaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccaagagttgtgcttttgtgttatttgttttcactcaaatattttgcctcattattcttgttttaaaagaaagaaaacaggccgggcacagtggctcatgcctgtaatcccagcactttgggaggtcgaggtgggtggatcacttggggtcagggtttgagaccagcctggccaacatggcggaaccctgtctctaccaaaattacaaaaattagccgagcatggtggcgcatgcctgtagtcgcagctactcgcgaggttgaggcaggagaattgcttgaacccaggaagtggcagttgcagtgagccgagacgacaccactgcactccagcctgggtgacagagggagactctgtctcgaaagaaagaaagaaaaaaaggaaggaaggagaaggaaggaaggagaagaaaaggtacctgttctacgtagaacacctttggtggagttccatcaactcgcaaagtagaatccttacctactactcttctgataataattttaatattttttatgtttggttgatgcgagcagctgcactgctcatgcagttagctagcatgtgacatcatgtgacaaagttcatgtaattagatggaagaaacctcactgattaattttaagaaccttttagggatgcaggaacaatgaagtggccacagtatgtgctgtttttgaagcatttttaaaaacgaattgtagttgtttttcttcatttaaaatggatctgttggaggttatgtgtgtatgttgtagttttattgcagccacaataattttaccaaagttttcacataggcagttagcctttacttaatatcaagacaagtgaaaaaatattggcatcgatgaaaccgataacattggcctcattggatttctttacccattcacagtgtaaagaagttaccttcatgctttcattgtacctgcaggcctgtgggcttgtacagtagataattaatttctaaaaagaacagctgcctattttcttcctaggttaggttatatcttcataatcacaagaattagtgatggcaaaataaaattttgcttatgaatcttttacattgtttatatatgattaatatcatcatatatattttctgtattaagctcatttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgtaaaagtaaacagtgtgtttatgcattgagatactaaagcattt

SEQ ID NO: 727 - DNA, 1911 bp, Homo sapiens
gctcggcctctccccggcacgttctcagctgctcctggttcagacccagcgagggagccgcgagcgaggctcaccgtccccggcgtgcaggatccggggctgctgagcgctcgctcccgcgtgtccggcgcttggagtccccgcggcaggagaggagtcgggacactagagctccaggggcgcctgtgggctccagggcctccggcttccccagtccccttcagctaaagccccagagacgtgctcagccccaggacctctgcggaacaagatccggattgagaagccactgcaactaccgaaatgggcagcaaaaccttgccggcgccggtgcctatccacccttccctgcagctcaccaactactccttccttcaggcagtgaacggcctgcccacagtgccttcggaccatctgcccaacctgtatggtttcagcgcgttgcacgctgtgcacctgcatcagtggacgctgggctacccggccatgcacttgccgcgctcttctttctccaaagtgccgggcacggtgtccagcttggtggatgcgcgcttccagctgcccgcctttccctggttccctcatgtcattcaacccaagcccgagatcaccgctggaggcagcgttccagcgctcaagaccaagccgcgctttgattttgccaacctggccttggcagcaacgcaagaagatccggccaagctcggtcgcggggagggcccaggctcccctgcaggtgggctgggtgccctcctcgacgtgaccaagctgtctccagaaaagaagcccacaaggggacgtctgccttccaagaccaagaaggaattcgtctgcaagttctgtggccgccacttcaccaagtcctacaacctacttatccatgagcggacgcacaccgacgagcggccctacacctgtgacatctgccacaaagccttccggaggcaagaccacctgcgagaccacagatatattcactccaaagagaagcccttcaagtgtcaagagtgtgggaaaggattctgccagtccaggactctcgctgtccacaagacgctacactcacaggtgaaggagctcaaaacctccaagatcaaatgctaaatagaacctgtgggtcacaaggaccctaggcccagcggccctctcctccatagggaccagaagcctgactctggcgggcagcgggagaggcgctcgctcgggaccttccacctctccaacattgtcccctgggtccctggcgcacgcggcacttcagagccccgcccggggccgcgaccccgaccgtccctgctgctcccctaggacgcggctaaactcttggccaaaaggcggtactcacgtggcggaagggaaactgcattaaaaaaagaacgaaagctccgcggagccgcagcggcgcctctcccagaagtattactttttctattgttattttatacgttttcttttttatttttgtctttgaccatataagcttgtaactctgactgcggagagtgagtggagagaggagaggcaacgaagtccttagcactggcagctcccacctcctcctcccgcccctgcccccacccccggagcctgcaaaagtgtaatccctgtatctgcttcagcctcctgccctagggaccgcggggcagccccctcccagctcttgcagctcagctggcggccgtgggctccgggactaggagagcgggacggggacctcgggcctggggtctgcagggggcccggcctccgctgccgcgacactgcgagggagcagccagccaagagccgggcgttatattgcgattggcactttatgctgaccatcggtaacggacatttatcactggagttttttttttttttaactattaaataaacggttattttacaggcaaaaaaaaaaaaaaaaaa

SEQ ID NO: 728 - DNA, 1825 bp, Homo sapiens
cggggccgctactaaagcccaagactcccggcctggggcagcctggggagggacgcgggcggggacggagctcggcgtgcttgctgctggagggtgatggccctgcaaggctgtgggctccgacctcaccgggagtcgacagcgagaggttcgccgaagagcgaggttctgggcgagcgctgaacgccggccccaagcaccccgggtctttacacagtccgcgtccacagactctgacgaagacgtggatctgctctcgctttagctgctcgcggtcctccagatcatgtccgcgactcctgcgactccgcgcggaaaaaaaagtttgccaggcgtggactcaatgacctttccaagctgtgcgcctcgctgcctggaccgggtctgagcgcggctgcccaggttgacctttctgcgggagggctttctctacgtgctgttgtctcactgggtttttgtcggagccccacgccctccggcctctgattcctggaagaaagggttggtcccctcagcacccccagcatcccggaaaatggggagcaaggctctgccagcgcccatcccgctccacccgtcgctgcagctcaccaattactccttcctgcaggccgtgaacaccttcccggccacggtggaccacctgcagggcctgtacggtctcagcgcggtacagaccatgcacatgaaccactggacgctggggtatcccaatgtgcacgagatcacccgctccaccatcacggagatggcggcggcgcagggcctcgtggacgcgcgcttccccttcccggccctgccttttaccacccacctattccaccccaagcagggggccattgcccacgtcctcccagccctgcacaaggaccggccccgttttgactttgccaatttggcggtggctgccacgcaagaggatccgcctaagatgggagacctgagcaagctgagcccaggactgggtagccccatctcgggcctcagtaaattgactccggacagaaagccctctcgaggaaggttgccctccaaaacgaaaaaagagtttatctgcaagttttgcggcagacactttaccaaatcctacaatttgctcatccatgagaggacccacacggacgagaggccgtacacgtgtgacatctgccacaaggccttccggaggcaagatcacctgcgggatcacagatacatccattccaaagaaaaacccttcaaatgtcaggagtgtgggaaaggattttgtcagtctagaactctagcagttcacaaaactttacacatgcagacatcaagccctacagctgcgagcagtgcggcaaagtgttcaggcgaaactgtgatctgcggcggcacagcctgactcacaccccgcggcaggacttctagagaagcccaggatctgtcccgtgccgccgctgctcccctccccagacacctctccacgtctcctacccagggggtcgcatccctagcccttcactgaccccagctcttcccttgctgcagccgcacctgcagctccagggagttaactcttcttctgggggactgagaactgtagaaagccacacactactacatcccttcacaaagagtatatgctagtttcttgtagatattcacagctcattttagagctctgtacataatgttgtgggtctttgttttgttgttttgtttgctttgggatcttgttggatgcacttagatatggaaaatggaagccaaattttatctttaaagactgtattttcaaaataaaactttttcttgtttgtttcaaaaaaaaaaaaaaaaaaaaaaaaaaaaaaaaaaaaaa

SEQ ID NO: 729 - DNA, 755 bp, Homo sapiens
aactagctccaccctctaacccccactccagctgcagacgccacggagtttgtgcaggggcgcagcgctccagccatggcgcgttcgctcgtccacgacaccgtgttctactgcctgagtgtataccaggtaaaaataagccccacacctcagctgggggcagcatcaagcgcagaaggccatgttggccaaggagctccaggcctcatgggtaatatgaaccctgagggcggtgtgaaccacgagaacggcatgaaccgcgatggcggcatgatccccgagggcggcggtggaaaccaggagcctcggcagcagccgcagcccccgccggaggagccggcccaggcggccatggagggtccgcagcccgagaacatgcagccacgaactcggcgcacgaagttcacgctgttgcaggtggaggagctggaaagtgttttccgacacactcaataccctgatgtgcccacaagaagggaacttgccgaaaacttaggtgtgactgaagacaaagtgcgggtttggtttaagaataaaagggccagatgtaggcgacatcagagagaattaatgctcgccaatgaactacgtgctgacccagacgactgtgtctacatcgtcgtggactagccctagaatgccatccttcttcaggagctagtttggagatgggtttttctggtgccactgacacctgggctgcccatgccgctcaggctacccttatctcctctgcacttatgttatcaataaag

SEQ ID NO: 730 - DNA, 2702 bp, Homo sapiens
ccccctttttaaccacaaaccgaattttctttcatttaggtgatctatatatatctatatcgtatagcttatagcttatatctattttaaataacttaaagccgctaaaatttgggggggaacagctttcgccctggagcggtgcgcgatgctgtctcatgccgacctcctggacgccaggctaggtatgaaagatgccgccgagcttctgggccaccgggaggcggtgaagtgtaggctgggcgtggggggctccgaccccgggggccatccgggggacctggcgcccaactctgacccagtggagggagccactctgctgcccggggaggacatcaccacagtgggctctactccggcctcgctggcggtgagcgccaaagacccggacaagcagcccgggccccagggcggcccgaaccccagccaagccggccagcagcagggccaacagaagcagaagcgccaccggacgcgcttcacccccgcacagctcaacgagttggagaggagcttcgccaagactcactaccccgacatctttatgcgtgaggagctggcactgcgtatcgggctgaccgagtcccgagtgcaggtctggttccagaaccgacgcgccaagtggaagaagcgcaaaaagacgaccaacgtgttccgtgcgcccggcacactgctgcccacgccaggcctgcctcagttcccgtcggctgccgccgccgctgccgccgccatgggcgacagcctgtgctctttccacgccaacgacacccgctgggcggcggccgccatgcctggcgtgtcacagctgcctctgccgccggcgctgggcaggcagcaggccatggcgcagtcgctgtcccagtgcagcctggcggccggtccgccgcccaactccatgggcctgtccaacagcctggcgggttccaacggcgcggggctgcagtcgcacctctaccagcccgccttccccggcatggtgcccgcctccctccccggccccagcaacgtctccggttcgccccagctctgcagctccccggacagcagcgacgtgtggcggggcaccagcatcgcctccctccgccgcaaggcgctagagcacacagtctctatgagcttcacttaatgcagccgcgccccggcccgctccgcccccagcaccgccccgggggccgccccgaggcccttccggcgcgcacccggaccccggcgccctgccccgtcccgccccggccttcgccccgtctcgtttcgtcctcgcctctctcctccactcgctcgggctcaccccaagccccagcccgcgaggcctcccctccgcctgatttcgatcgcccgcggtcccccgtctcccggccgcccctcttcccttcccacccagctgcgccctcggctcggtctccagcgcctcagcccacccttcccgccaccctggcctccctgcttgcgctggccgtgctcgcgccctcctcctggccttctgacgggcggcgttcccacccacaccttcgacgcgacgcctacgacccccctcgcccgccgcctcccctccggtcccctctttccccacacttcgcgaccctcctcccgcgcccggcaaaaagtatccttcccgccattttacgtaccagggagtcgactcaggatctgaaatcagacaccaatggactggtttgtgggcagaaacacacacactcgcactctcgctcacgctcagacgctacacacgcgcgcgcacagacacggtgcacctaggtcacacacggacgtgttcaagggacagcacaatgttagggatttttgtcttaaaggaggacaagcattgctaccaaccgcctcatctgagggcccaactgatatgatttgatttatccttgtactctccaagctcctgtctttctttcctctcccaccacgctacccttgcccagtccacccagtcacatccgtgcagccctctcttggcttgcaagataacgcttttatttttattttatcttattttcattttcttaagcacaactgtgtgagagtgtagaagggaaggcttctcaggaggaacgtgacagtggattgggtggctggagtagactaaagcagtcatgtgacgaggaagaggtgatctgacccattttgataagtctttataaggaagaataaaataaacgtgtaagcaaaattttcttttgtaaaagcaaaagccacatctcttttctggatccttcaggactggggtttgtttgcttccttttctgtttctgtcttctcgctgctctgtgcccttggttgttttgtggtggtcctgtcgtccctcgtgcccctcggccacctgctggcagccgatgggggcactcggacatctacaaccctgcaactttgtacagagaaacacaatcagctctttctgcatgtgctggtcaaatccaaacccagagaacagaagcgctttctaagaatgaacaaatatgtgaaataggatgttttgtgtagataaagcattcttgttacatactggtcaatttgtgatatgttttaacttaatgtctgtgtttatttatggaattcggttttcttaataaatgtttgagctaatataaagcatattatttgacttttccggacaagtttatatcaagttaaatgtaaatggataaaataaaatcattttcagtatgtgaaaaaaaaaaaaaaaaaaaaaaaaa

SEQ ID NO: 731 - DNA, 2176 bp, Homo sapiens
gatcaatcttcatcaggctacatttccaatcacctaaacaaccgagcaagacaagccactccgacaaggttggctgcccggcgggtctctgtgagagatccaggtagatggtgaacggccccggcagctgagggcaggccaggcccccagacgcatcagaccctgaaggactgcgtggtgggagccctgcaccgctcctggccccgggccccctggatccgtcggggcgcctccacccagctgttagcatgatgtcttacctcaaacaacccccatacggcatgaacgggctgggcctggccgggcccgccatggacctcctgcacccatccgtgggctatccggccactccgcggaagcagcggcgggagcgcaccaccttcacgcgttcacagctggacgtgctcgaggcgctcttcgccaagactcgctaccctgacatcttcatgcgggaggaggtggcgctcaagatcaacctgccggagtctagagtccaggtctggttcaagaaccgccgcgccaaatgccgccagcagcagcagagcgggagcggaaccaagagccgcccagccaagaagaagtcctctccagtgcgggagagctcgggctccgaaagcagtggccaattcacgccgccagctgtgtccagctctgcctcgtcctctagctcggcgtccagctcttccgccaacccagcggctgcagcggctgcgggactaggtgggaacccggtggcggccgcgtcgtcgctgagtacaccagctgcctcatctatctggagcccggcctccatctcgccaggctcagcgcccgcgtccgtgtcggtgccggagccattggccgcgcctagcaacacctcgtgtatgcagcgctccgtagctgcaggcgccgccaccgcagcagcctcttatcccatgtcctacggccagggcggcagctacggccaaggctaccctacgccctcctcttcctactttggcggcgtggactgcagctcatacctagcgcccatgcactcacatcaccacccgcaccagctcagccccatggcaccctcctccatggcgggccaccatcatcaccacccacatgcgcaccacccgttgagccagtcctcaggccaccaccaccaccatcaccaccaccaccaccaaggctacggtggctctgggcttgccttcaactctgccgactgcttggattacaaggagcctggcgccgctgctgcttcctccgcctggaaactcaacttcaactcccccgactgtctggactataaggaccaagcctcatggcggttccaggtcttgtgagcccaggaatgaaagaggagaagaaacgcaactacctgcgccctccgtggtcccgatcctgttgctgctgctgcaccgcccgcctttgcctcgtcttctccaaaactgaattttcaccccccaaaaagatgtccattgcctgcactgccgcccccatttttgtgccacttgcttggggggatgtgcaaacccaccctgccccttggatggggggaccggtgcttcggcttggcctacacattctatacaggagagatgtattatttccccccttcagcccctactaaactcttaagcctccccttccagtctttctggacagctattaagcacttgcagccttcggaggctctgcgctctgatccgctgtttgagcccaacactttaatttattctttctggacactggagtcactaactggcgtgtttctgcccattggagcacccgcacactactccaaatcaaaaccactaagagttcctcccgcgcagactgctgccccttcagctgccctcgattttgctccacgcctgccggccagagcctcccggcgtttcttccgccccagcggagtgcgctggggcgcgccagggctaggcccgccggaggagcgcgtccccagccttccgcgcacagagccgcatcccgccccgccctgcgctggactggttcaagcttccgcctcggcgggaacgctgtacatagtcaggtccgttccagggaccacttaaactttttagttgctgttggttggttgaactgaacatatcttgtcttagcacccaggaaacagaactttaagatatatacagcacatatatatatatatacatatatatatacacatatataaaaaacaaaa

SEQ ID NO: 732 - DNA, 2209 bp, Homo sapiens
gagagcgggaccggcctcagctccaacacagcctccactgtgattaaaaataaaaattgctagagcagccctcactcgccacatctactttgatagctggctatttggaatttaaaggatatttgactttttctaacctcccatgaggctgtaagttccactgctccaaacccacccaccaaggactctgaacctgtccaccccgggcgcatcaagatcttccagctgggtacccccgatttgggccgactttgcacctccaaacaaccttagcatgatgtcttatcttaagcaaccgccttacgcagtcaatgggctgagtctgaccacttcgggtatggacttgctgcacccctccgtgggctacccggggccctgggcttcttgtcccgcagccaccccccggaaacagcgccgggagaggacgacgttcactcgggcgcagctagatgtgctggaagcactgtttgccaagacccggtacccagacatcttcatgcgagaggaggtggcactgaaaatcaacttgcccgagtcgagggtgcaggtatggtttaagaatcgaagagctaagtgccgccaacaacagcaacaacagcagaatggaggtcaaaacaaagtgagacctgccaaaaagaagacatctccagctcgggaagtgagttcagagagtggaacaagtggccaattcactcccccctctagcacctcagtcccgaccattgccagcagcagtgctcctgtgtctatctggagcccagcttccatctccccactgtcagatcccttgtccacctcctcttcctgcatgcagaggtcctatcccatgacctatactcaggcttcaggttatagtcaaggatatgctggctcaacttcctactttgggggcatggactgtggatcatatttgacccctatgcatcaccagcttcccggaccaggggccacactcagtcccatgggtaccaatgcagtcaccagccatctcaatcagtccccagcttctctttccacccagggatatggagcttcaagcttgggttttaactcaaccactgattgcttggattataaggaccaaactgcctcctggaagcttaacttcaatgctgactgcttggattataaagatcagacatcctcgtggaaattccaggttttgtgaagacctgtagaacctctttttgtgggtgatttttaaatatactgggctggacattccagttttagccaggcattggttaaaagagttagatgggatgatgctcagactcatctgatcaaagttccgagaggcatagaaggaaaaacgaagggccttagaggggcctacaaaccagcaacatgaaatggacaaaccaatctgcttaagatcctgtcatagttttagatcattggttatcctgatttgcaaagtgatcaaaagcattctagccatgtgcaaccaaacaccaccaaaaataaaatcaaacaaaactaagttgtgaaggaagggagggaaggtcatagccttcttaagcagaggtgttccattgttttagccaatccttggttgaatcttaggaatgaacagtgtctcaagctcattcacgtttcatgaccaactggtagttggcactgaaaaaacttttcagggctgtgtgaattgtgtgactgattgtcctagatgcactactttatttaaaaaataatgttcataaggagtcaatatgtagtttaagagacaatcagtgtgtgtcttataaatggtacatctgtggtttttaatctgtgctagacttcaaaactgtgatctcctgttattgtatgcaaccttgaactccacctctgcaggggttcttctgtgattaaataggttataattataagcaaaattcagagcaactgagtactgatctaaaaagattacctttggctggaggtgagctgcactgaaactttacgacaaaatgtctctggacaaagagagtcagagaagagaagcaaaaggacactaattcatctgtaatttactgttggtaagcctagcagtaaagagacattggtcaattgctctgaccctgatgaattattaaactgagatcattgtcgtttatgcttgcagatgttaaatggaaaagttatatatgcataaaccttttcttcctggatttggcagatatgtataattatattaaaatggttctagcacaaaaaaaaaaaaaaa

SEQ ID NO: 733 - DNA, 2896 bp, Homo sapiens
taggcggatgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctggctgtacatttcaagacatcatcttggaggcccgttatggttcccagcaccgcaaacaacgtcgcagccgcacagcgttcacggctcagcagctcgaggccctggaaaagaccttccagaagactcactacccagatgtggtgatgcgtgagaggctggccatgtgcaccaacctgcctgaggcccgggtgcaggtgtggttcaagaaccgccgggccaagttccggaagaagcagcgtagcctgcagaaggaacagctccagaagcagaaggaggctgagggctcccatggggaaggcaaggccgaggcccccactccagatacccagctggacactgagcagcccccacgtctgcctggcagcgacccccctgctgagcttcacctgagtctgtctgagcagtcagccagtgagtcagcccccgaggatcagccggaccgtgaggaggaccccagggcaggggctgaggaccccaaagctgagaagagccctggggctgacagcaaggggctgggctgcaagaggggcagccccaaggcagattccccaggcagcctgaccatcactcctgtggccccagggggtggcctcctgggcccctcccactcctattcctcgtccccgctgagcctcttccgtctgcaggagcaattccgccagcacatggcggccaccaacaacctggtgcactactcgtccttcgaagtagggggtccggcccctgctgctgcagcggcggctgctgctgtgccctacctgggcgtcaacatggccccgctgggctcactgcactgccagtcctactaccagtccctgtcagcagccgctgctgcccaccagggtgtgtgggggtctcctctgctgcctgcacccccagcaggcctggctcctgcatcagctaccctgaacagtaaaaccacaagcatcgagaacctgcggctccgggccaagcagcacgcggcctccctgggactcgatacgctgcccaactgactgtctggcttccaacccagccaggggtcttaggtgtcccctcctagccctgtggttatccctaggtggctctcgaggagttaactccatgagcccagggatcctagggcctggggtcctgttccctgctccgcttccccataccccagcccgaggtgaagcccacacctacacaccctctgcatggccctgcctggaccccatggaggccgaatagggaggaggtgagaggctggggtgccccaagcttccctcggagaagtgagaggctctccctggctagatcctcatctcaatagcacctcctcccttttctccctatccttctgccccctagtaagtctacgtgtggaatgtgagatataaatataaatatataaagctatattttcaggctcctgcctgccccaggccccctgccccactcccatctcttcttccctgccacccctccctgcagcctccgcggctcactccagccatcccttctgtttctccttctctctccttccttcttcccttgatctccctcttcctgtctctgtcctggtccctgcccccgtctcggcccagcctctgtattctccacccttgatctttctccttgtctctcccgctgcccctggtttcttcctttggtgttggctgtgttggtatcatcagttcttgagctatattttgtttggggttgtggctggttttggttttagtaattttgcgacttcccgttgctctccttctattcccttccttctgccctgcctgcctccctgcacctgcggcctctctaggaagctgttcctttctatgcccaatagaagcaacaaggccctagctggagactctggggatctggagctgcaggcaggaggtggcactggctcccactcccacccctgcccaggctggcatctagaaggcgtcatgaattactttctcttctctcttctcaattttgaggtcctcattcccaagattgaggaggcagtagttaatctgggaaggcagtagaatggccagcattcctgcctgtaagtcttcccaagacagaggcccggtgacacagttcagccaggactgaccacagggctctagagctctctttggtgagacttccctggatggagagcagcagcaggggaagaggtgctctcagagacagcagggctggtgctcttctcccacaagctgagcctccacgttcagcagatactgtccaaggcaggggtacggctgaccaggaatgaaggttgaactctgctcctgagcacggtgcgtgcaaagcatatagcagcacataggctcaggcttctgtaggcttcctgtcccagagccaattatggaagtaagggcttccctccagctagtcactggaatggaaaagtgtgttcctgttcatagccaggaaacccagctcagcaaactccctttcaaagctgtgtgaccggctgggcatggtggctcacacctgtaatcccagcactttgggaggccaaggcaggcaatcacctgaggtcaggagttcaagaccagcctggctaacatgtgaaactaataataatacaaaaattagctgggcgtggtggcacatgcctgtaatcccagctacttgggaggctgagttgggaggattgctgcaatctgggaggtggaagttgcagtgagccgagatcatgccactgcactccagcctgggcgacggagtgagactccatctcaaaaaaaaaaaaaa

SEQ ID NO: 734 - DNA, 3007 bp, Homo sapiens
ggctcgcactttaagacttcccgagcggcggcggggacgccagtcgagccgggagacgcttacctgccgcttccccgcgccgcccggtgcacctggccgcaagggacctcgttctcagggaagacggcgacattccgcggaggtggaaccgccgcgcgccgtccgggctcggaccttccccggaacgtgggggcgccttagcgactccttccctgttgtgcccccgttcccggcgttcagcccggccccgcaaaggtgggacggctcccggcttcagttacggaagcggcccgtgtccagcgacgagggttcgaaaatgccccgcgcgttcctggtgaagaagccgtgcgtctccacgtgcaagaggaactggagcgagctccccgacgaggagcgcggcgagatctacgtgccagtcagcctgggcttctgcccaccacagccctaccgggagccggaaccctctgtggccgaacccccttcctgcccgctggctttgaacatgagccttcgagactctagctacagcatggcccccgggccctgtgtggtggcccagctgccctctgaagacatgggccacttgacagacccccagagcagagaccatggcttcctgcgcaccaagatgaaggtgacccttggggacagtcccagtggagacctgttcacctgccgtgtctgccagaaggccttcacctaccagcgcatgctgaaccgccacatgaagtgtcacaacgacgtcaagaggcacctctgcacgtactgcgggaagggcttcaatgacaccttcgacctcaagagacacgtccgaactcacactggcgtgcggccctacaagtgcagcctgtgtgacaaggccttcacgcagcgctgctctctggagtctcacctcaagaagatccatggtgtgcagcagaagtacgcgtacaaggagcggcgggccaagctgtacgtgtgtgaggagtgcggctgcacatctgagagccaggagggccacgtcctgcacctgaaggagcaccaccctgacagcccgctgctgcgcaagacctccaagaaggtggccgtggcactacagaacactgtcacttccctgctgcagggcagcccccacctgtgagtggctcgagccctgggggtgctcctggaagccccaagagcatccaggattgcctcccagctgcctggccagcccaccctcctgcaacctctcacccgaacaccagtgatcaggactggagcccccgtgccttggtctcccccctgggcacacgtgctcactcaggcccagcaatgacctctgctcatttttgcatttttgacttatgggccgaggctgttctgagcctgggaagatgtacctatgtcaagagaagggatgaggccaaggctgccttcaattagaagcagccgcccacagagacaggcactgtgtgcctggcagcaggacttcctacccagaggaggttcgagctaggatcccactgcccccgcctctcagcacagggcaggggctgcaggtccccagtggacatcagagtcaaaagcactggcaaagggtacccctgcaaacaactgtggtgggggctggcagcagaccccccacctggcagggcttctaatgctcagggttctggagggctctgtccttccggcaaggagaggcacacatgtgtgcccagccgtgtgtgtgcgtgtgcttgtgtgtgtgcactgctgtgtgtgtgtgcacgcacaggaagcctttccacatatcacctcatttctaagaaataaactacaaggtgccaagaaggttttatttccttttattttttaaagatgacaaatgtacagatgttaatatatttttggtgccaatggcgatgtttttaagagtgggatggagctggcttttctccattcccgtgcgcttctatttatcctggacatttcaaacctcctctgtgccttggctctgggcgggggctgccccaacccacccccgttctttgtacgtgctgagacagccactagaagatcttcctccagcggcgccctggacggctgctcctgcgaacagcccatggcatcttctgctcttccctcccggctctgccctgcacatcctgttgagccaagccccagtgacccggagagctggcctgatgctgagagtgtgtcctcctggggctttagggggcaggaaggtgggacgaatgacgatgcccatccactacctgaagcactaggacactcttgcagggccaggctggaagaccggcccttttcttggttgagtcaaaagccttagcacagtggcaaaaaatgggacagaatgatgaccagcacctcagaaacttccagagggaggagaggatttgatggctaccaaattgtatctgttgccttttttctgactttttcacctgaccaggctggggtttggagtggctgtggggagacccgtcctggctggctggctggctcccttgctcccttgctgcagctgggaaaggggttctgggtgtaaagaggtgtgcgtcttgtgggccaaagggaaaaacaggcaggggtcagagccagcctgccagaggcaaatgcaaaagaggtccccagaacacagccagctgggcagccccttaaagccaaaccccacctgaagcagaaccactttggcctcccctgcccaaaatgggtagtgtctacacgtccccgggctcaggctcaggcccagccctgggctgacctgagaggaaggctccttcctggactgccctctgaaatgtgtatagattgattctaaaatctcttgtttcacttgactttagagtgtctgggacgctgctgtattctgaaagtcacatagcacacagtaatgttatctggaagctctgtttttgtttacatttctgtatccctgggttgactgccaatccgaggccgtcatgaagctctgtgttgtctgttttattttataaccttcctctcaactattaaaattagagatctaaaaaaaaaaaaaaaa

SEQ ID NO: 735 - DNA, 41369 bp, Homo sapiens
gatcacgccattgcactccagcctgggcaacgagcaaaactccgcctcaaaaaaaaaaaattaaaaaacagagcttggattgcttcttagtcttctggctaagaatcaagtgtaaaacagcttggccagtgtgccggggtagggtcctgggagcccctggctgtgtcaagagaccccctttgggccaggtgcggtggctcatgcctgtaatcccagcactttgggaggccaaggcaggcggatcacttgacgtcaggagttcaagactagcctggccaacatggtgaaactctgtctctaccaaaaatacaaaaattagcccggtgtggtggtgcatgcctgtagtcccagctactcaggaggctgaggcaggagaatcgtttgaacccgggaggtggaggttccagtgagccaagatggtgccactgcactccagcctgggcaacaagagtgaaactccgtctcaaaaaaagaaaaaaaaataggagacccccttttactttccagactgtgggagggaggaagagtgttgtcccaggcagtaactaggggctagattattaacaaactagtattttagtgcctgctacacctgaacagtgcttctggctgaatgttagccctgggaatctgaagatcagagaggtggggcatcctacctgaggatgcacagcctggatcctcattttgccctgatttatccagatctgctgtcctccctgcaccctacagagcagggcaatcacagcagggggccccttcagtgtcctcagacagctgctgtgatttgaataaccaggcaggctgctggatgtcccctggtgactgatttgcctggcaaacagaccctcaacccctgggagacagtccccctggggccttgtttcttcttcctatcctcaaaagctccccaggcccatctccccttgcctggctctgcttggtggtcctagtgcttgtccacccctggaggctggatggttccctccaaaacctgggagaagatgggcaggtccccaggcaggggtaacctgagccagcttagtccactcccagggccagccaggaaatttgcatgaagagaatgaggttcctcagaggcttcccctcctttcccaccagggatagtcatcctggggctgaggtctgacagcaggtggaagcagcccctgtgtgtggagagccttccggagggcatgccccgcgccttcctggtcaggagtcggcgtccacagccccccaactggggccatctgcctgaccagctccggggagatgcctatatcccaggtgggcccctcactgtgcctggaggtaaggggcaggagagacgcagtgtcaccatctggcttttctcctcagactgcagcagcctgggggggccaccggcacaacagtcgtccagtgtcagggatccgtggacagcggtgagtgtgtaactggctagcaaagccagctgtttcgctcctgcctgctctcagccttaatgaagctgacagccccttgctcccccgacccatctgcacacgccctccagcctcgggacctgtccgcccctacttctctgtgttgggaatgcctctcctttcctagtagtgagctctctactgttaggtctcaccccaggcaccagggccggcagccacagggatctcttccagcggggcacaagattcatccccacatgtggatgatccgctttatgtcagaacatgggacaaggcaacaggagtgcgatgggagataagggctttttcagctgtgcatgcattggaggaaggaaagcgccagccggaatgtaatatattcatgaaagcaaggcactgttctaggcatgggctgttatattcagcgggaataagacaaaaatccacaattttatggagcttatattctggttggggctgcatgtatagacaataaaattagtcagcctgtaattccagcactttgggaggccgaggcgggtgaatcacttgaggtcatgagttcgagaccaggctggccaacatgttgaaaccttgtctctactaaaattacaaacattagccagacatggtggcacgtgcctgtaatcccagctcctcaggaggctgaggcaggagaatcagttgaacctaggaggcagggcagaggatgcagtgagccgagtctgcgccactgcactccagcctgggaaacagatctagactccatcccccctcaaaaaaaacaataaaattagaaaaatagaccgggcatagtggctcatgcctgtaatcccagcactttgtgaggccaaggtgggtggattgcttgaggtcaggaattcaagaccagcctggccaacatggtgaaaccccatctctacaaaaaataaaaaaattaactgggcatgtggcgcatgcctacaatcgtgtaatcgtggggaggctgaggcactagaatcgcttgaacccgggaggcggaggttgcagtgacctgacatcataccacttcactcctgcctgggcgacagagcaagactctgtctttaaaaaaaaaaaatgtgtatgtcacatcagaagatgggacttggcatagagaaagtaaggaccatgggatagtgagggaaggccctggagagtgacaggcacacacactaatcactgtctcccacctgccttcctaatcctccgtggtggctcaggacactctgtaaatactcatttgcagagtaacaaagggtggatggggtccagccagagaggctaataactcctgcatccctccagcagcccacacagggcaacctgacctctgctcccaggggccctgggacgctgggctgcccgctctgccctaaggccttccctctgcagcgcatgctgacaaggcacctcaagtgccacagccccgtgcgccgccacctgtgccgctgttgtggcaagggctttcatgacgccttcgatctcaagcgccacatgaggactcacactggtgagcagtggcagggacagggaaaagttgctgggccccaggtggggatggaaggaaatggagagaggtgctgggctgtggagtgtccatggtttgtgtatgtggggtatggagaatcaagacatgatgtctctcggaccccagtgggtgggtgtaaggtggcaccaaaataggggcctgtcacggaatgcagagtgcagacggatgccggttatacgattcaggctccagatcgaaaggcaagggaaggcctccctctccatcccccaggggagggagcatcctggtgagggagagtggagacacaggtgtctggcccatgtctgcactgggtgacggtagcagatggtgggtcatgggcggaagagtctgaagagcttggaataggtaccagaaatgctcaacactggaaagcagggtgggggcgctttagtccagagcccattgccctctctgtccagccctcccctctgcgcccatctgtgcagggatccggcccttccgctgcagtgcttgcgggaaagcgtttacgcagcgctgctccctggaagctcaccttgctaaggtgcatggacagccggccagctacgcttaccgtgagcgccgcgagaagctgcacgtgtgcgaggactgcggcttcaccagctcccggcccgacacctacgcacagcaccgcgccctgcaccgcgcagcctgatacggtgtgccagcgtcctccccacgaggcaaataaacacagaaaactcacgcatggaatctggtgtttattacactcgggggagagaggaggtcactcggtccagcggtggccgcagtgtggggctgtgcacacgtagtaaaggcgcatggcgtcctggcagaaatgatgcatggttaggaaggatttggacccagcagcgccttaccccaaaagaacaggcaagagaacttcaccaataggtaagggcccggcagagttccaagaagcgcagggtcacccacattgatatccccgcccccagaaaggaccaaacaagccccagatacttagaaagccctcgcgccacttacctcggcccgcgcactgtgtgactggaagaacacagcctccttgtggccgcacctgagagggtaggggctcggtcaccggaggcttcacacccttccctcctcccttcgcccagtgaggagacgagcctcactttacctccccagtaccagctgaacgctcacttttggcacgggtggtcctcggtccgcggcaacgtggggtcctgggacacgtcggcgataatctgggtcagttcgctgcagggacgcgggggtgcaaaattacgctcagacccagcctccagagccaacacccccgcccccagctcagggcccgccactcactccacttcgtgcgtgatcttgttgacatagatgcagctgttgtcggcctcctgctggtaatcacagttccggcactacgagagggcgagtgtgggggaaagggggtcacggaaggattccagacaagattgggaggagagggcagggtgatcccggaggatatgacgacaggactctctttggggatgggcaggacatgagagtcaggatcacttgaggtgcagcggagggcgaacagggagtccgatcacagaggcagggggcagggcggggccacgctgggaacaggtggacctgccggggaagaccccggcgctcaccgcgtagagcagaatgcggttctccttgtcttccttggggtacagcatgttgttactgtggggagggggaggtgccaggggttagttctggagccattcctcgcccgccttctaacatcacccgctccctccgcctcaccattcctggcagaagcgaatacccacgaagcccggctcgtaagtcccgtcgggctccatggcgacgcgcagcccgcgcagccctcccagccttccgcgcttgctccgccgcgctacaggtcgcgggaggggccaggcctaggtgcttcgccaaaagagggcggagctgcgcacacgtgctggctccccgccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcgagctcttgccactcctacctccgggcttcagtcttcgccgcctgttctggtcctttcccgggccgctattggaagaaccgtgaactatggaaggcccctctggattggctgggctggcccaagagtaaggagagccctcttcctggcggtggggaagggacggcggcgattggcggacgctcctggcaggagagcgcggattggtcaggcacggagcaggaggcggggctgatagcccagcagcagcagcggcggcggcggctgcggagcgggtgtgaggcggctggaccgcgctgcaggcatccgcagggcgcggcaagatggaggtgacgggggtgtcggcacccacggtgaccgttttcatcagcagctccctcaacaccttccgctccgagaagcgatacagccgcagcctcaccatcgctgagttcaaggtgtggccatgggggcggggtccggaggggcggggcgaagaaattggggggttcccggaagggggaggctgggaggggccggggagtgactgggcgggcccggaggtgatcccaggctgcggaggctggggacccggtcgcggcggggcgggtccggagagaactcgagagtgcagagatgagggccgggtccagcgaaaaatccgacggtccagagggcgggggcaagaggcgaggggctggattgcggccccgtgcgtcctgactggggggtcttttggaggaaaagggacgtggcgatggtcattgatgcaaggggcggggcctccgtggcctccttcttctcaccctgcctcctcctcacagtgtaaactggagttgctggtgggcagccctgcttcctgcatggaactggagctgtatggagttgacgacaagttctacagcaagctggatcaagaggatgcgctcctgggctcctaccctgtagatgacggctgccgcatccacgtgaggactctctatctgggacactcccccaccccacctttcatttggttattcaacagacacttgctgggctttgccctcagtcatacccgagataggtcctgccttcgtggagcctccagtgcagcctgacgagagacagacccatcattagacagggacagcctagagtggtctgggctgggatcaggaaatcccaggggactggagccaccaagaagaggtgcctgactccacctgggagaatcagagagggcttcctggaggaagggatgtctgagctgagggatgaggaaagggtgacttaagagaaagaggtggaaaggagggagcagggtgtacagaggcctagaatgtgaggtaggtcacagtgagcgaccaggctggacagcttgggagaaaccagaacacaggatctctttgtgcatccactcagtacatcctttctgtctttttttgagacagagtctcactctgtcacccaacctggaatggagtgcagtggcactatcgggctcactgcagccttcacctcctgggttcaagtgatccttgtgccccagcctcccgagtagctgggattacaggtgcccacccagctaatttttgtatttttagtagagatgggtttttgccatgttggccaggctggtctggaactcctgacctcaagtgatcagctcaccttggcctactaaagtgctgggattacaggcgtgagccaccaagcccagcccctttctgtccttattccctcccgacctcactcagtctgtagcagccacattgctccttgcacagtccaggtgagctcggcctctggatcctgggcctgaatggttcttttgtcatatgcctgcgtgcctcacccttccttcctgtcttaatttaaagtgtcagtattctagtgaagtcttcaccggcctcagtgttaacgtttacctcattcctttccccttctttgctttattttagatttttgtgtttacaagtaattctcctctgacacactctggatttctctcatctggtttatttactctctgtctccctggattcgagtgccctgagggtggaaattttgatcactataattcactactgtgtccccagtacttggaatagtgcctgggacagggaggatagtccgtgaatcgttttttgttttgttttgttcgagacagagttttgcccttgttccccaggccggaatgcagtggtgtgatctcagctcactgcaacctctgtctcctgggttcaagctattctcctgcctcagcctcccaagtagctgggattacaggtgtgcaccaccacgcctggctaattttgtaattttgtattttaagtagagttggggtttcaccatgttggccaggctggtcttgaactcctgacctcaagtgatctgcccacctcagcctcgcaaagtgctgggattacaggcatgagccaccacgcccagccctgtgaatcattgttgaatgatgaattgaatccataaagtaagaccacaaggataatgtaattatccccattttgcagaagagaaaatttagcttcagggtggagtttatttatttattttttattttttttgagacagagtcttgctctgtctcccaggctggcgtgcagtggcatgatctcggctcactgcaacctccgcctccccggttcaagcgattctcctgcctcagcctcccgagtaggtgggattacagatgcccgccactacaccagggtaatttttgtatttttagtagagacggggtttcaccatgttagtcagactggtctcgaactcctgacctcaggtaatccgcccacctcggcctcccaaagtgctgggattacaggcatgagccaccgcacccggcccagaatctactttcttaaggatgaactgtcagtagcattttggccccagtctacatgactctagagagaactgcttcttttttctctcgttgattaactgttcattccccatctgtgttgtgccaggggtttcattatgactgcatctgagaagttctagtgtatgaggcagatgttggctaaatggccagaggactgaatgtgaagggtcaggggagacaagggttgtgtaggagatcatgaagctgggagaccctatcctggggtacctgatgcatcagtgacgtctgggaggacatcctggaggtggtgctgctggagcagagacgagaagaataaaaagaattggtcgggcatggtggttcacgcctgtaatcccagtgccttgggaggctgaggtggacagatcacttaaggtcaggagttcgagacggtgaaaccccgtctctcctaaaaatacagaaattagctgggcgtggtggcagatgcctgtaatcctagctactcaggaggctgaggcaggaggatcacttgaacccaggagctggaagttgcagtgagctgagatcacaccactgcactccagtttggatgatagagtgagatcctatctttaaaaaaaaaaaaaaaaaaaaggttaactgaagatggggaaggggtgccctaggagtggggcacaacccagcaaacactccaaggtgggagggagcgcggtggggattaagacaggccacttctgtggccaaacactgtggaagctggggaggaccctgacctggctcaggtgttcacaggccccctctggctgtgtgtggggaacaggtggtggaggacaggaagagtagggagaccaggaaggggctgctgtgagagtcctgatgaggggacgaggtctggagctgtgggtcaggcctctgctgggtgcacaggactgagcctttgggccaccctgggcagctgaagctaaggggtgcgggtgttcataggcacctcataggcagtggcatctttgagcaggtttcataacaggcggttcaggtacacacagacctcccaggccactcaaggaaggtgttccagagtggagccactggggaatttttacattttctaaaattctttttctctttataaatatcacccatattcattgtttaaaataacagaacttcaaatttgtgaaaattctcaacagaaattctcagtgacgcttcatccggaggtaaaggccattcctattttgccatgttagcccagtggcttaggccagacacctcagggtgttccttgggcccgctctctccctcacccccacatccactctcatcaaatcctctcggctccacctacaaaaacttccctgaccctggtccagcctccatccttcccccaacctcgccatcccggcagcttcctccctggcctccccgctccccatctcagccagagggagcctgggaccacctgagtcaggccagggccctcctagctcagagccctgccctggtggcacttcgctccagataaaaaccaaagtctaggccaggtgcggtggatcgtgcctgtaatcccacccagtacattgggaggctgaggtgggaagatcacttgaggtcaggagttctagaccagcctgaccagcatggcaaaatgtcgtctctacttaaaaatacaaaaattagccgggtgtggtggtgtgtgcctatagtttcagctgcccgggaggctgaggcaggagaatcacttgaatttgcagtgaggcagaggtttccgtgagctgagatcacaccaccacactccagcctgggtgacagagcgagactccgtcaaaaaaaaaaaaaaaacccaaagtctccagcagtcccttgtgtcttccactctccctctggctcgctccaccccacccgcaccacccactctagagcgtgaaggacatttctacctctggccgtctgcacctgccgttcttgctcatctttccagccttggctgaaacatcccctcttttgggaagcctaccctcccatgctccttaagcctcttccctgtcatatttttctccatagccatcctccagtgtttcataggtacctgttcctttgtttgtggttggccttctccctgcacaatgagcacagcctgagggcagagtgcgtctgtgtttacactgagtccccagcatgaggcccagctgggcccctgggagctcggaaaccaatgaatgaatgaatagtgggggcagaacaggaagagatgctctggggcctgaggttggggccagcttaggagagtcccagaggcccatcgaggagatgcgctgtgcacagggctgtgggcaaggcctgagctctgccggttggactctgtgactttggggcccttggcgatgttgatgccagcaagcggggaacttctggggacagaggcagcctctgggagcttggatgggggtgaggaaggggaggtggccagtgtacgtagctacttctcccttccgctgggctcaggagagaagagaaggctgcagtacaggcgagggagggagatgcgtttttcccagatggagacactgaagtccctgcacccagcacccaggcctccctggccagaccctgatccccacggagcccctcccctcacacaggtcattgaccacagtggcgcccgccttggtgagtatgaggacgtgtcccgggtggagaagtacacgatctcacaagaagcctacgaccagaggcaaggtacgggcaggtgggcgtcgaggggtgcgtgggggccagagggagtatgtgcaggtatgagggcgggcaggttagacagggcccctgcagggaggccagtggtgtagacggggggccgagagcttgggaggatataggggtgaggctgggagtggggacagacggaggcctggggtgggaatgagggccgggaggtgtcaggggtatgggcagtcagacgtggtcgggggagggctgggaaagtggagggagttgaggggtaggtgtgggggctgggtgttgtcagggtcagatgggggcatggggcggtcggacggggtgtggagggcaggacaggtggaatgcgagtggacagggtggcggtcagtgagggcgcctgggacggatcgagtgttgggggagaccgggggcctcagggccggaggagggcggaggaggaaggcggatgatgaaggcagatgtgcgctgaaggggtgagagaccatgggtcctgtagtgaggggtgcaggcggcaccccttccatttacgattgtggagttggggggcctaggagtcctgggagaggctaaggctgtggtgggagacctggggcttgggtgacagccctttgtcacctggaagagagagttcctccgtgaacgtgggcccctcgtgggtggagcgtcatcctgttaggcccggccgacaccccaactgaccccagccccctctgcccacagacacggtccgctctttcctgaagcgcagcaagctcggccggtacaacgaggaggagcgggctcagcaggaggccgaggccgcccagcgcctggccgaggagaaggcccaggccagctccatccccgtgggcagccgctgtgaggtgcgggcggcgggacaatcccctcgccggggcaccgtcatgtatgtaggtgcgtggctcgcgggcccggtcccgggctccagggctccaaggccgggaggaaatgttgggggcacagtggagcctcggagaccacgctctgcctaggggcgcggggttgggggggactcgaaacgatctcagtccctggaggtgacggaaccatctgccgacactgacggcccagagtgtttgtggagggaagtgggaggcgcaggcggagtgatctgtccagcgagggaggaagcagaagccagaggcacgcggcctgtgcgcttcgaagcgtggggcagtgtcagtcgcggtggggaaacgggcggcgtgaccaaggcaggagtgagggaacacagggggctgtgtgagcccagaggaagcacctggaggctgggagcatctgaaggaaaggaggcagcagccaggtgaaaagggaggaagagttcccgccagaaggagtagcgggtgcaggtgagcagagcgcaggaggtccacctggggaaggggagcgggaggagaggggagaagtgtagtcaggggcatgggcagggcggcgtcacagtggagagcagtgtggatttttttaaaaagaacaggctaggcatgatggctcacgcctgtaaactcagcactttgggagaacaaggtgggaggcttgcttgagccccggagttggaggttacagtgagctatgattgtgtcattgcaccctagcctgggcagcagagaaagacccagtctcaaaaaaaaggctgggtgcagtggctcacacctgtaatcccagcactttgggaggctgagacaggaggatcacttgaacccaggaatttgagaccagcctgggcaacataatgagaccctgtctctacaaaaaaaaaaaaaaaaaaatcccacaaaacttttgtcagttgtggtggtgagcacctataggtgccccagctacttgggaggctgaggtgggaggatggcttgagcccgggagttgaggctgcagtgagctatgatcgcaccactgcactgcagcctgggtgacagagggagaccctgtctccaaaaaaaaaaaaaaaaaaagatacacggggtacatatatgtattgttacatgggtgtgttgcctgctagtgggtggggaccgggcttctagtgtacccatgacccaaattgtgaacatcgtacccaacagataatttttcaaccctcaccaccctcctgtttctggcatccccactgtctggtatttccgtctttatgcctgtgtgtacccatcccccagtcgtcttcagccactaatttacgtctgtctctaatttgccgattctggatgtttcataggaataggatcatgcagtctgtggccttttgtaactggcgccttccactgagcagaatgctttcaagtttcatccgtggcatgcctgtgtcagtgccacactgttgccaaatagtcctgcattgagcgcctagaccacagtgtatccagtcaccagttagtggacattagggtcatttccactttttggctattatgaataatgctgctatgaaccttcttcttttttttttttttttttttctaatttgagacagcatctggctattgcccaggctggaatgcagtggcacaatctcggccatttcagccttaacctcttgggctcaagccatcctcccacctcggcctcctgagtagctgggaatacaggtactcatcaccacccccggctaaagttttgtggttttttttgtaggatgggatttcgccatgtggcccaggctggtctcaaactcttcccgctcaagtgatcgtcctgcttcagcctcccaaagtgctgggattacaggtgtgagccaccatgctaggcctgaacattcttttataaatttctgtgtggctgggcatggtggctcatgcctgtaattccagcactttgggaggccaaggtgggcagatcacctgagatcaggaattttgagaccagcctggccaacatggtgaaaccccatctctactaaaaattcaaaaattaactgggcgtggtggcgggtgcctgtgatcgcagctacccggaaggctgaggcaggagaatcgcttgagcctgggaggcggaggttgcagtgagccaagatcacaccactgcactccagcctgggcaaccatgcaagactccatctcaaaaaataaaaaatacatttttatgtggacatttgttttcatttctctgtgcctaggagtggaatccctgggccacatggtaacactgtgcttgacttttttgaggacctgccacactgcttcccacagccgctgcagcagttttcattcccgccagcagtgcagaagggtcccattttgtcctcatcctcaccagcactttagtctgtcttttgcttacagtcatccactgggtgtgaagtggaacatcatcatggttttgatttgcacttctttggcagctaatgatgttgagcatctttgcatggccatttgtgtatcttctttggagaaatgtctattcagatcctttgccttttgttttttgacacacagtctcactccgtcacccaggctggagtgcagtggtgctctcagctcactgcatcctctgcctcccgggttcaagcaattctcatgcctcagcctcccgagtagctgggattataggtgagcgctacaacacctggctaatttctgtatttttagtagagacagggttttgccatgttggccaggctggtctcaaactcctggcctcaagtgatccacctgagctggtggatctcccaaagtgctaggattacaaacatgagccactgcgcccatcggtatgtcggggtttggttttgttttttttcttttgagacgtaatctcgctttgtgcccaggctggaatacagtggcatgatctcagctcgctcgttccaacctccgcctcccgggttcaaacggttctcctgcctcagcctcccgagtagctggaactacaggcgcccgccaccacacccggctaattttttgtatttttagtagagacggggcttcaccgtgttagccaggatggtctcgatctcctgacctcgtgatccaccctcctcagcctactaaagtgctgggattacaggcgtgagccaccgcacccggccagtatgtcatcttttgagaagtgtgtgttcatgtcctttggccatgatcgtggctcactgcagcctcaacttcctgttgcccactttgtaatgggattttttttttgcaaagtgggtgttctttgagttccttgtatattcttctgctcagtttttcattgggatgctgtcttttgtcgctgagttgtgtattagtttgctaacaaagtaccactcactgagcaacttaaagttatttctcacagtaatggaggctagaagttcaagatcaagctgtcagcaggttggatttattctgaagcctctctctctggcaaggcagtagtgccatcccccttaggtttttacaaagccctcactggctggtgtcttcacccagtgaatgggggacaggggtggaagcagggacaccagtgaagtggctaccatattagtcccggcaggagctggaggtggtcctagtggtagcaatagaggtagcaagaaatggttttcaccaagacaggcttctactcaatgggtaggcatggatccagggtgatcctgaaatttcatggggatttcttctatgtccagaagcttcacagggatttctcttctgttggcaggtctcacagatttcaagcctggctactggattggtgtccgctatgatgagccactggggaaaaatgatggcaggtaacaagaattcccactcaggtgtctgtgtgtgcatttgtgtgtaagtccatgcgtgctgcttgctgagctgcccatgccagcttctagagtggagccatgtgagggtcctctgaccacacccacccctatcctttcctgcagtgtgaatgggaaacgctacttcgaatgccaggccaagtatggcgcctttgtcaagccagcagtcgtgacggtgggggacttcccggaggaggactacgggttggacgagatatgacacctaaggaattcccctgcttcagctcctagctcagccactgactgcccctcctgtgtgtgcccatggcccttttctcctgaccccattttaattttattcattttttcctttgccattgatttttgagactcatgcattaaattcactagaaacccagaaagtatttagaggacttcatgatttggggacccactgggtaaatagtggcccttcggtatcaggggccagcctctgtctcctcatatcttgctgttcccccatcttctcatcattcccacctcatctgctgtagctaccaggaagaaagggaagggaagggaggggatatcctttgcctttaaaaatgatgtacagccagctgggcacggtggctcacgcctgtaatcccacactttgggaggccagggcgggtggatcacgaggtcaggagatcgagaccatcctggctaacacggtgaaaccctttctctactaaaaatacaaaaaaattagccgggcatggtggtgggtgctgtagtcccagctgctggggaggctgaggcaggagaatggcgagaacctgggaggcggagcttgcagtgagccaagatcatgccactgcactccagcctgggcgacagagcgagactgtctcaaaaaaaaagatgtacaactctggctggatgtggtggctcacacctataatcccagcactttgggaggccgaggcaggcggatcatgaggtcaggagatcgagaccatcctggctaacatggtgaaaccccatctctacaaaaaataaaaataaaaaaattagccaagcatggtggcgggcgcctgtagtcccagctactcaggaggctgaggcaggagaatggcgtgaacccgggaggcagagcttgcagtgagctgagatcacgccactgtactccagcctgggcaacagagcgagactccgtctcaaaaaaaaaaaaaaaaaaaaaaaaaaaagatgtacaactcagccaggcacagtggctcatgcctgtaatcccagcactttgggaggccgagctggcaggtcgcttaagcccaggagtttgagatcagcctggacaacatggtaaaacttcatctctacaaaaatgcaaaaaatgagtcaggtatggtggcgcatgcctgtagccccagctacttgggaggctgaggtgggagaatcacttaagcccagaaggtcaaggctacagcgagttatggcaccactgcattccagcctggatgacagagcaagaccctgtctcaaaaccaaaaaaaaagaaaagaggccaagcacggtggcccacgcctgtaatcccagcattttgggaggccgaggcgggagatcgagatcatcctggccaacatggtgaaaccctgactctactaaaaatacaaaaattagctgggtgtggtggcgcgtgcctgtaatcccagctactcaggaggctgaggcaggagaatggcttgaacccaggaggtggagattgcagtgagctgagatcgtgccacttcactccagcctggggacaagagtgagactccgtctcaaaaaaaagaaaaaaagccaggcatggtggcttatgcccataatcccagcactccgggaggccgaggagggcagaccacttgagttcaggagttcaagaccagcctgggcaacatggcaaaaaccctgtctctacaaaaaatacaacaacaacaaaaattagccgggtgtggtggcacgcacctgtagtcccagctacttggaaggctaggtggtaggatcacttgagccttgggaggtagaagctgcagtgagctgtgttcacaccactgcactccagcctgggtgacacagcgagactccatgccgtgacaccagcacgtggcgtgtcacattattaaggattatacagccaacagttactgggctggtttcctttaatcctcacagcaggccctgtccgcaagtctttcaccgtttcccgtcaacactccacctttcctgcccaaagtttggggttgggagggaattcccaggggttcccaggacttgggctcgcctcccagatcccgcaacctttgcgtgcctagcctcggcaatgaccgcccatctgccacgagggggcggcagcgcaccgttcagacgctgcgcccctggtgcattatgggtcgcgtagtctcaaaggtggcataagcatcctggaacgcaaacggcatttcccagaaaactacgcgacaatctgagcctggtcttgcccagagctggaagctgaggtctcgcccctgccggcgttgcgggggattgtgggatgtaggcatttggctccgcgctccgcgaagggcggtgcagcgcaggcgcgggcatccggtacagacagccgagcttaatctgaggcggggaaccagcgtcccgggggaggcgccgaagctgactttctggccgcagtggaagtgaggcgagcgagctcccttagtggctggagccggctgggcctccttcctgtcctcctgctttcctgcatctctacttgtccctttccccgggctcctggtccgctcccaagcctgttcaagcacgaggcgtttccatctaaaaaaagaaaagaaatctcttttgccgggcgagatgtcagagccccgggagcgaaagtgttggtaatgttagacagaatgagttcctcttcaaaaatctaacttccttgtcctttgctctatgaactgtccttcctgcagaaactgcccttaccggggaaactgcccctccccgccgctgcaacccataccccgcctctattagaaataggcaatcggaatcagcttagattgtgaggtccaaccctagccaacgggggttaaaaacccctgctctcctttattaggtgtgcttttggtacaggtctgggcagcacgcttctgcagaagtaaactttgccttgctaagaaacttttctccgagtgctggtctctctctgtggcaccaagaacttatttctaacagtaagaagaatttactgaggacagcgtaggcttgaaaaagaaaagttttactagaaagaatgctgccgggcactcacgcctgtaatcccagcactttgggaggccgaggcaggtggattgcctgagctcaggagttcgagaccaacctgggcaatacagtgaaaccccatctctactaaaatacaaaaaactaactgggcatgccagcatgtgcctgtagtcccagctacttgggaggctgaggcaggagaattgcttgaacccaggaggtggaggttgcagtgagctgacatcatgccactgcattccagcttgggtgacagaatgagactccatctcaaaaaaaaaaaaaaaaaaaaaaaatgaaggaaagaatgctgcaggccaggcagggtggctcacacctgtaatcccagcactttgggaggccgaggcaggcgaatcacctgaggttgggagttcaagaccagcctgaccaacatggagaaactactaaaaatacaaaattaggcgggcatggtggcccatacctataatcccagctacttgggaggctgagataggagaatcgcttgaacccaggaggcggaggttgtggcaagccaagatcacaccattgcactccagcctgggcaacaaaagcgaaactccatttcaaaaaaaaagagctgatttttttgtttgttttttagacagcgtcttgctctgttatccagcctgtgtgtgatcccggcggtgtgatctgagctcactgtagcctcaacttcccgggctcaagtgctcctcccacctcagtaggccccatgaatagctgagactacaggcacatgccaccacacccagctaatttctgtattatttgtagaggtggggtttcgccatgttgctcaggctggagtgcagtggcacaatctcggctcactgcagcctcaggctcctgggctcaagcaatcctcccacctcagtctcccaaagtgctgggattccaggtgtgagccactgcgcacggccaagaataaagattttaataaagtaatgtgaaattaacatgaaaagccaataaggaaactgggcaaatatttgaaaagacaatacataaaagaaacaccaatagccaaaaaaccatgaaagccaagttcacccccattcatatttgaagaatgttacataaaatattgagacaccaccttttgcctgtcaaatcaggaaagatgtttatttttattttttatttttgagacagggtctctctgtcatccaggctggagtatggggcacaatttcgtctcattgcaacctcaaactcctgggctccagcgatcctcccaccccagcctcccaagtagctaggagcacgggcacaccactatgcctggctaattttttcaaaacacttttttgtagagatggagtcttgctatgttgcccaaactggtctcaaactcctgagctcaagtgattctcccacttcagcctcccaaagtgctgggattataggcataagccgccatgccacaaaattttacaagaaaatttcagccagcatttgacaagattccaggggacatgaatgaaatacctaaagataaaagagttccttgaggccagttaaggtggctcatgcctgtaatcccaccactttgggaggccaaggcagtggatcacaaggtcaggagttcaagaccagcctggccaatatagtgaaaccctgttttactaaaaatacaaaaattagcctggcatagtggcgggcacctgtaatcccagctactcaggaggctgaggcaggagaatcgcttgaacttgggaggtagatgttgcagtgagctgagatcacagcaatgcactccagcctacagagcgagagacccctctcaaaaaaaaaaaaaaaaaaaaaggagttccttgacaaaagaaatgtggaatttgctgccttgaactaagttaaattagctgctttgttgcaggaattttcattaatatgctagtccatgataacctgtataaaaggatcctcttgggcattactttctgggttttttgtttgttttcagaaacagggtcttgctctgtcatccaggctggagtgtcatggtgtgatcatatatcatatctcactgcagcctcgaatttctgggctcaagctatcttccagcctgaacctcctgagtagctaggactgcaggtgtgtgccaccatgcccagctaattaaaaaacttatttttgtacagatgaggtctcattatgttgcctagagtggtctctattcctgggctcaagaaatcctcccctctcagcctcccaaagcactgagataacgtgtgtgccactgtgcttggcctgaattttttattttaaaatacattttgtgagctgtgcttagtaatgcacacctgtagtcctagctacttaagaggctgaggcaggggcatcgcttgagcctaggagtttgagaccagcctggacaacacaggaaaaccccatctttacaaataatcaaaaaattagccattactcgggaggctgaggcatgagaatcgcttgagcctgagaagttgagctgcagtgagctgtgattgcaccactgcactccagtctggctgggtgacagagcatgaccctgtctcaaaaaaaaaaaaaaaaggaaaaaaaattattcaacaacagttgttaaagcacaggaagggctgggcacggtggcttccgcctgtaatcccagcactttgggtggctgaggcaggcagatcacatgaggtcaggagttcaagaccagcctggccaaaatggtgaaaccccgtctctactaaaaacacaaaaattagctgggcgtggtggcccacacctgtaatcctagccactggagaggctgaagcatgagaatctcttgaactcgagaggcagaggttgcagtgagccaagatcacgccactgcactccagcctaggcaacagaacgagactccatctcaaaaaattaaaaaaattaaaaatagaataaggcacaggaaaggaaggctttattcagagccattacgatagagagaggggccacagtggcagggccttgcagtgagggagacaggttgggctcaactccaaatactgcatggggaagtgggaattcatagcccaggatcgggtggggcgcagtggattgaaagttactaagaggaaacatcaggggtaaggggggattctggctaaaccagcctaacaggattcttgctgaagacaggcccaggtgatcagacatcacataggggctggtggaggatgaggaacctaatcagatgttgaagatgggagagggttctcgataaactgacttagcagggttctttgctaaaactggatttgacaagggagtacacagatgagcctagcagaagattcagagacttgactagtttggccatgcaagaatttcttttttgttttgtttttttctgtttgttttgttcggctcactgcaacctccacctcctgggttcaagcgattctcttccctcagcctgtggagtagctggaattacaggtgcctgccaccacacccggtttgtgtgtgggtgtgtgtatttttagtagagatggggttttgccatgttggccaggctggtctcgaactcctgacctcaagagatccacccacctcagcctcccaaagtgctgggattacaggtgttgagccacctcgcccggcccaagcaaataatttttatcagggaattgactccaaagaaaaacaataggagaggaggtcctgcagggtcacagcccatacaagagtctggccgcaaggaagcctggtaagaggagagggaacagagcggtgctgacctgctgaagggaaggcagaggtcggacaggtacccggattagtcatcacataacaacttggcatcagccatgctctgccatctactgtgtggcctcaggcaagtgactcactctctctgaacatccacttcctctcatgttggtttctttctcagaggcttgtgagaggccttggcaagccatggccataaagcaatcactggctgggcatggtccctcacgcctgtaatcccagcacttttggggcaccgaggtgggaggatcacttgaggccaggagttcaagaccagcctgggcaacatagtgagacctggtccttacaaaaaataaaaaaatgattcaggtgtggtggtgcacacctgtagtcccagctactctggaggctaaggtgggaggatcccttgagcctaggattttgaggttgcagtgagctataattgtgccactgccctccagcctgggtaatgaagtgagaccctgtctcacttttttttttttttttttttgacatggagtcttgctctgtcaccaggctggagtccagtggtacgatcttggctcactgcaacctctgcctcccgggttcaagtgattctcgtgccacagtctcccgagtagctgggattacaggcactcaccaccacacccagctaatttttgtatttttagtagagacggggtttcaccatattggccaggctggtctccatctcctgacctagtgatccacccgccttggcctcccaaagtgctggaattacaggtgtgagccactgcacctggccaagaaaaaaatttcttgcttatacaaagtcagctgtgggtctgggtgactatcaagagcagaagtgctcgatgccagggctcggccctcttccttcatgtggcacctccaggtttgctcagctcctagtgtgacccgggcaggagaaaacagagcatggagcattctgcactgccttcccctgcgcccgccataaacacaaggtcttgctctgtccactgggctggagtgcaatggttgcactggtttttaaatgcttctacaaggagcatttaaagtgttctacatccaacacttctacttacattttattggccaaagtaagtcagataactcctgagttcagcagatcctgggagatggcggagggcattagtaatgcttgccctactgtctcactgctggtgctgaaaatccaatgagaaaatacacacaaaacatattcattcattcaacaaatgtttactgggcacctatgatgtgccaaccactgttctaggaactggatacatacctctgagtgagtacatagcagtgaacaagacatatagaaatcccagtccagccgggtgcagtggctcacacatgtaatcccagcactttgggaggccaagcggatggatcacctgaggtcaggagttcaagacaagcttggccaagatggtgaaacaccatctctactaaaaatacaaaaattagctgggcgtggtggcgggtgcctgtaatcccagctactcgagaggctgaggcagagaattgcttgaacccaggaggtggaggttgcagtgagccgagatcgagccactgcactccagcctaggcaacagagtgagactccgtctcaaaaaaaaaaaaaaatagaagtcccagtccgtggcaagctcacatactagcggaggagacagaaatctggatcaatatgtaaagtacacagggctgggcgtggtggctcatgcctgtaatctaagcactttgggaggctgaggtgggtggatcacctgaggtcaggagttcgagaccagcctggccaacatgatgaaaccttgtctctactaaaaatacaaacaaattagccgggtgtggtggtggacacctgtcatcccagctacttgggaggctgaggcaggagaatcgcttgaacccaggaggtggaggttgtagtgagctaagaccgtgccattgccctccagcctgagcaacaaaaatgaaactccatctcaataataataataataataataaaacaaaaaaaaaagtacacagtacgtgagcgggtgataaaagacaggaccttcccgtgatcactagatgtgtagacatgaaagatctgcttcccagacctggggctggagaaggtcttggtaagggagtggtggcctcatgtcttcatgtctgccctgagagaggctgtttggatgttgctgtgcttgcagggcctccatgctgagttttgtctctgttcagctgggaacatgcaggtgaccttgccaggcaggcatcttctcactttctccagggcgaagagatgagggcagggaggtgacaggacagatcactaggggtggctgtcatgagaactttaggctggagtgcagtggtgcaatcaaggctcactgcagcctctacctcctgggctcaagtgatcctcccacctcagcctcccgagtagctgggactacaggcacatgccaccatgcctggctagtttttggtattttttgtagagatggggtcttgccatgttgcccaggctggtctcaaactcctaggttcaagcgatcctcctgcctcagtctcccaaagtgctgggattccaggcatgagccaccgcacctggccctgttgtgagaacttctgactctttcctggagtggggtgcagccagggcagggctctgagcctacagggccctgacctgactcaggtggtctcaggcttcctctggctccacaagaggagcagacagcagggagcagacagaagggagcaggctgtggggtgtccaggtgggaaaggatggaggctgtggcagggtggggacagtggaggggaagagtttagtttctgtaggtggagccaataatatctgctgacaggttggagtgggtgtgaaggagagaggtgaaggaccaccccggagtgtttggcctcagtcactggaaggacagagctgccactgacctaggtggggaaggtagtgagggagcaggttctggaggaaggtcagaagctcagtttaggatatgtaaagcttaaaatgcctctaagggccaggtgcattggctcacacctgcaatcccagcactttgggaggctgaggcgggtggatcacgaggtcaagggattgggaccatcctggccaacatggtgaaaccccgtctctactaaaaaatacaaaaattagctgggcatggttgcgcatgcctgtagtcccagctactcgggaggctgaggcaggagaactgcttgaacctcagaggtggaggatgcagtgagccgagatcgcgccactgcactccagcctggtgacagagcaagactccgtctcaaaaaaagaaaagaaaaagaaaaaggaaaaaaaaagcctctgagatcttccatcctttcccatggaaatggtgaatatgatgcaggatgtaggagcctggagttcgcaggaggtgtctgggctggagatagaaatttgggggttagggttagggccaggtgcagtggctcacgcctgtaatcctagcactttgggaggctgaggtgggaggatcacttgagctcagagttcaagaccagcctgggcaacacagtaagacctcatctctacaaataattaaaaaagaaaaaagataaaggaaatttggatgtttgccgggcgtggtagcttgtgcctgtagcagtagctattcaggaggttgaggcaggaggaggattccttgaggccgggagttacaggctgcagtgagctacatcacatcactgcattccagtctgggtgacagaacccctgtctctaagaacaacacaaaaaactgggcgttggccgggtgctgtggctcatgcctgtaatcccagcactttgggaggccaaggcgggtggatcacaaggtcaggagatcgagaacatcctggttaacacggtgaaaccccgtctctactaaaaatacaaaaaattagccagcgtggtggcaggtgcctgtagtcccagctactctggaggctgaggcaggagaatggcgtgaacccgggaggcggagcttgcagcgagcagagatcgcgccactgcactccagcctgggcgacagagtgagactccatctcgaaagcaaaacaaaacaaaaaactgggcgttgatagcctagagacaggatttaagctgtgcatgtaggggaggcaccccatggcatgagtggtacagagaggaggatagagacctaacacctggggctgccgggaataaggggttgggggccagaactagatgacaatatggttacgattggcagtgagtgccatgagaaagtacaagtcattttgaaagcatataactggaagcctcacctagtctcaggttgggtggagacagggaggtctttctggaagagatgactcctgaggtgacacctgcagcctgagtagctacacaatcaggccagaaaaaaaaaggcagcaggggagttcctggccgagggcatgagggctggcagcaagtgagcctcgggagagggcagagagctggagcagtcagtctggcagggaggggtgtggtgagaagggaatctggattagtcatcaccaaaagatctgtgccaagcccgggttcagatctggttctgccaccctccgtgaccctgcctttcagaatctccattctctctcctgccctgcagacaaggcttgtgtagcagttaccttggcctggccccagcaaggcctcaggaaacatcagctgcaactagttttgtctgttgtgatgttgttatttgacctattatattaattatattattaacgcataagggtagtggttaaggatacaggctagggagagtgactgcttgggtttaacctcagagtcggtttacttatctgtaaaatggggataataaatagcatctatgtcacagggctgttaggagaacaagggaactgatggacgtcaagcacttggaggagtggttgatggttacttgtttttgtatcttttttttttttttgagacagtttcgctcttgttgcccaagctagagtgcaatggcacgatctcgagtcactgcaacctctgcctcccgggttcaagcgattctcctgcctcagcctcccgagtagctgggattacaggcacacgccaccacgcctggctgattttttgtatttttagtagaaacaggatttcaccatgttagtcagggtggtcccaaactcctgacctcagtgatctgcccacctcggcctcccaaagtgctgggattacaggcgtgagccaccacacctggcctgtttttgtactatttaaggaagactaagagtctaccagctgaggaatacagctggcctcgaggctgagggaacagcatgagcacagacacagagctaatgggggcatttacaaagcatttatcaccaatttatttatttatttattggagacggagtttcactcttgttgcccaggctggagtgcaatggtgcaatcttggctcactgaaacctctgcctactgggttcaagcgattctcctgtctcagcctcccgagtagctgggattacaggtatgcaccaccacatccggctaattttgtattttttagtagagacagggtttctccatgttagtcagactggtctcgaactcccgacctcaggtgatctgcccgcctcagcatcccaaagtcctggggttattggcatgagccactgtgcccagtatttatttgagacagagtctcgctctgtcacccagattgtagtgcagtggcatgatctcggctcactgcaacccccgcctcctgggctctggtgatccccccacctcagtctctagagtagctgggactaggcgcatgccaccacattcagctaatttctgtattatttgtagagacaaggtctcactatattgcccaggctggagtcaaactcctgggctcaagagatcctcctgcctcagcctcccaaaatgcagggaatacaggcatgaaccacttcacccagccaccacttaagttttttttttaataatcagtattgctgcagatatcatttaattttgatagggggcctagtggtatggagcaacccatgttcccattttacagatgagaaaatcgctgctcaggaatatcaagccactcttttggggttgtgcagttattacagggcacagccaggattcaactcaagcctagccagcctgcagggtaggggataagagccagccagcctgcctgggggccagatttagctccccccgatgagtcctgaaaaagtactggactcccgtggctcatgcctgtaatcctagcactttggcaggccgaggcaggtggatcacctaagatcaggagtttgagaccagcctggccaacatggtgaaaccccgtctctactaaaaatacaaaaattagctgggtgtggtggtgcatgcctgtaatcccagctactcgggaggctgaggcaggagaatcgcttgaacctgggaggcagagactgcagtgagctgagatggcgccactgcaccccagcctgggcaacagagcaagacgctgtctcaaaacaaaaaaaaaaaaaaagaaaagaaaagaaaagaaaccaggctatgtaaaaatattattgtaaaaaattaaattaaatcaaaaaaaggccggtagcccatacctgtaatcccagtacctcacagtactttgggaggctgaggcaggaggacggcttgaggcccggagttcaagagcagcctgggcaacatagcgagacctccgtctctattatgtaaaaacaataatattttttaagtaaataaagaaaccaggccgtggccaaaggaatcttcctgtgtctggggccttctttagaggctagcatactgaggacactctttgggccagtccaggaaggaatgattctggtggcccctgactggggcgggggcgtggtaaggttcgcctgggaggcggcgcaggcgctgcctgcggtttgactgccatccgggctgctgcaggcactgggaaaggcaatccagcctcaatcctcgccacagacacgggcgactgtcccccagcgtgtgagtcaaaccatactccaggcctccaggaggtgtttgtcgcgacaacacctgcagagggcccgtgcggagtcccttagtgagcggaccgaaaaccgccaccctggaaggatattggcatgccctagggtgaaaattcacactacgacactcggggggtgggtcccctccgagttctcgtccgcgggtgcctccacccagacctgaggggtgtcgggaagacccccgcctaccgagtcagggcgggattaagacctccggcgctggaaacgcgtagggcggggcccagacctggatccagctagccgggcggtgtggggtgcgcatgcgcaatgtccgcttcggctctaggaccgcgcgggcgacagcagggccgcggtgcagtgtccgacccgagagttgcggcctgagtcaccggccccgccctccggagccggacgctgcgggaggcccgggagcggcagtggaaccgactcccagaactccggacgtgtgcggcggtaagcgcccggcccgtaccccctccgcaccccgcaactccgactttggcggcccccagacccggcgaaaccgtgaagtctcggcctcaggagccccccagatccatggtctcagattcgaaccctcagacctgttcgatctccttttatgccgtcccggggacccttctccaccctctgtctcatgatccaaaatacaggcccataggtttcagagataccctgtgaattcttccttggggtgtcctgaaccgcgatcgtagatctgtgcccccagttccagcggggaaccccattgtccgggaacccagagctcacagccacgatcttagacccgagcccacagagccagaggtgacactggaatcctgccgctgggaatacctaaattctcaagcccacatttgggatttcctaaaccccgccctggggccctttaggccgtggatgtttgctccgcgcccatgacctgccaaggacctctacattcaggctgggctctggatctcacattctagcgcccagacatgtcgggaacgccttacgccaacttggggtccccaccaagagaacccccaccagatctgcaccctccccttcacgcgtgcacccagtccaggctccctcaagccccacgggtgccttttagacctgaggaggttgcaaacctgatcccccatacctgccccacccatccgcggacaacccgccctcgcaaactcagacccccacccggaggcttcagattcctcccaggtccagctgccggaaatgcgtgtttgaagggagggtgtgggctcaggggcgaagcacccactggtccccttttttccccccagcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcaggtaaggcggagactatcagaggggcggggcctgggaatgggaggagcctcagtgaggcgtggtctgggaggggcgtggtctaaaaatagaataggattaacctggaggctaacctgggtacatgaattaggccggggaggcctggtttgagagttctgctgtaagggggtggaccccagtgaggcggatatcagtcattgggggcggtgcttgatatgggagtagtctgattgtgtgggaccaggacaatgtggtcctgaggggactgatgtggagttttggcgggtggggcttatgggtctgggctcagcctgcattggctaacctggagatgaacgttaaaggtgcggagccaatgcgtctgagtgacattttacggaaggggcttgacttatgagtgtggtcagaggttttaggtgggttaatgaggaggtgagcccaggaggaagcaagacctaatggggtagggtaaatggcccagaatgggctgggcttgctgggaactggctggattaatggagaaaaatgccctggtagggatagggcaggttggcttaattagccacggccacttagcagtgatcccttgaaggggcggggaccaatggctggggtaggatgttgggaagacgggcatttaggaagcgggccatggagtagggtcttgggcagatggcacctgaggaggataaggccttgggaagctggggcagagcctctatgaagtgagccctccaaggggcggggtcttttgattctacgtgggattttttaggtttagggtggccaagatgactgaaatctgccactgggtaggtgtgcctggcaggaggggagcctcccaggggaccggtctctgggtttcctcgagggtggggttggcctgaggaagggagaagaggggcacgaccagggcagtgtggattgggacagatgaggacaagaacaaatgaaaggcacagcaaccaagtaaggaagataacggctggggtctggagcgttggggctgatggttctgtagtgctgcccgttggaggccccgcccctggcactaacccctcccccttatctcttcgcagcgaggcggctgcgcagtacaacccggagcccccggtaagccccctctgcaaccagacccccttctcctgccaaggcctcttcgaggtcccatccctgttcctgtagagaagccccaccttcctccccttcttgtgaaattcctctgccagttcctcccatgccgtgtctgcagcttcgccatgggtcttagccatgccccacatacgtgcaccccattcactaccacccctcattcttttcctcatcaagctgcccagcccactctgacttccccacccagggtacctgggtttggggagccgtcctggccgggttcccctccccctgctctgagctctcctccctttgcagcccccacgcacacattactccaacattgaggccaacgagagtgaggaggtccggcagttccggagactctttgcccagctggctggagatgtaagtaacctggggtccctggccccgtcctaaccgttccatcccttcccttgtggctgcccttgcacacacacccttgaccatgacaatcccagtgttcccattctccatgacattctcagacccctttcagtcacccctgacctgcccctaacttccgcccgcaggacatggaggtcagcgccacagaactcatgaacattctcaataaggttgtgacacgacgtaagtgaccggggttaaggaatagggtagattcagaggcagaggggtcagagaggatttgacctctggcctctgactttcaacctgttacccacagaccctgatctgaagactgatggttttggcattgacacatgtcgcagcatggtggccgtgatggatgtatccttgggggcagtgtgggagaggccctgggtggacagagagttttttgagagtatgtttgggaagccaacatgtagctttcatatccacagatgtggaaatgcattcatcagaacacagtcacctgcagacatgtggcggtaaatcataacaatgccagctgtcacagctggcactttaattatataaagtgaccgaaccgtcataaccaccctgttggacaggcacaattattatattccattttacagaagaggaaactgaggctcagtttcctgaaagaagcagtcatttgtctcaagttatagataaaggtcaggcatggtggctcatgcctgtaatcccaacactttgggaggctaaggtgggcagatcacctgaggtcaggagtttgagaccagcctggccaacatggtgaaaccccatctctattaaaaatacaaaaattggccaggcacggtggctcacacctgtaatcccagcactttgggaggccgaggcgggcggatcacgagatcaggagattgagaccatcctggctaacacagtgaaaccctgtctctaccaaaaaaaaaaaaaaaattagccgggcgtagtggcgggcgcctgtagtcccagctattcgggaggctgaagcaggagaatggcgtgaacccgagaggaggagcttgcagtgagccgagatcgcgccactgcactccagcctgggcgacagagccagactctgtctcaaaaaataaaataaaaataaaaataaaaataggccgggcgccgtggctcacgcctgtaatcccagcactttgggaggccgaggcgggcggatcacgaggtcaggagatcgagaccatcctggctaacacggtgaaaccctgtctctactaaaaatacaaaaaaattagccgggtgcagtggtgagcgcctgtagtcccagctactcgggaggctgaggcaggagaatggcgtgaacctgggaggcggagctttgcagtgagccgagatcgcgccactgcactccagcctaggcgacagagagagactccgtctcaaaaaaaaaaaaaaagaaaaaaaaagaaaaataacaataacaaaaattagctgggcgtggtggtgcacgcctgtagtcccagctactcgggagtcccagctactcaagcaggagaattgcttgaacccgggaggcggaggttgcagtgagcagaggtttcgtcactgcactccagtctgtggactcaggtcttttgggcttgagaacccacgtttataacagccacatgcgcatatacacacacacacacctaagagcacacccacatacgtgaaggtgtatgaggcagtgtgcacagggacacacgtgttatctgtacatgggccagccattagctgatcttggatacatgcatatttttatttatttttgttttaaaaaatattttatagagaaaagctttcactatattgacctggcaagtctcaaactccagaccttaagcaatccttccgccttggcctcccaaagtgttgggattacaagcttgagacactgcgcctggcctcatgcacatttaacacatagggcaaacagacacatacataatatacatgtcatgtaatcacagacatattgcatagagcaaagcaatcccaactctacctcttaaccaggttattgaaccgctctgtgcctcagtttctctctctgtaaaatgggtgagtgataatggtgataccgaatcggaactacatccaaaaggtttagcacagtgtatagcgcatagtatgtggtctgtacacattagctcttaactatgatcttgggtagagttttcagctttgaatgttttcttctctggaaatagtcctggtagaactggtgtcccaaggatttagtgagaaagtgatgttcctgagtggacatcaggtggatcctgagttcaagcgatccacctgccttggcttcccaaagtgctgggattacaggcatgaaccaccatgcctggtcacacacttgtttttcacatatcctaacatttttatgaaattgagttactgtcaagaattttcttttctttctctttttttttttttttttttgagacagagtctcactctgtttcccaggctgaagtgcggtggtgccatcttggctcactgctaactccacctcctaggttcaagcagttctcctccctcagcctcctgaatagctgggattacaggtgtgcgctactacagctggccaatttttgtatttttagtagagacgggatttcatcatgttggccaggctggtctcgaactcctgacctcaagtgaaccgcctgcttcggcctcccaaagtgctggattgcaggcgggagccaccgtgcgtggcctattaagaattttctgaatgagcaattaacaactcttcaggcaaggaatttgtactttagagtagttgaatataattcctcatggttatgtttaaagagaatccctatttagaaatgtaagtgacaatatgtatggataaaatgaaaaataaaaccgcacaccaggtgatatgactaggaccaagcgggagctggagtttcagccctggctgccctgcttgctgtatcaccatcgtgtccacagtgcatgtgatgcatgcatctgggtgtagctgtcactcttcttaacaccctcccaccagagcgacaccacaggcaagctgggctttgaggaattcaagtacttgtggaacaacatcaaaaggtggcaggtgtgtagaaacctctgaaatccctggcacccagacccccaagccatggagacactatgccccacaatgctcacttggacccaatgtctctgtcctcacaggccatatacaaacagttcgacactgaccgatcagggaccatttgcagtagtgaactcccaggtgcctttgaggcagcaggtatggctggcagggacatgctggggctgggagtgggatgggtgagaaaacctctactcagctggtctgggcctgactcctgggcatgggagtgggttgggccatgtggcccccgcacctgaaggactacatccatcttagggttccacctgaatgagcatctctataacatgatcatccgacgctactcagatgaaagtgggaacatggattttgacaacttcatcagctgcttggtcaggctggacgccatgttccgtgagtgacaacccagctgtcttcctgggtggggattcctatgacctctatggaccaaggtctcctctaagcctgactttgaggtgggcgatgctaggggcacagtggtgattgaatcagttccagtttctgccctcatggagctcacagtctggtggaggagacacaagtccccagacagtgacagttcagactggtgatggctgggagaggggaagctcagggcagagtgatgggttgtgatgggggcagcacaggccgagggtctagggctctggtgaggggaagagtgagcagagcgtgctcagattgtgcttggggaagcctagagggcaaatccaatccaggaggaacctgatgcagcccaaggggtcagggagggctcactggagagggaacattgagacctgaggggatgaggagagaacttagtgagaaggtagggaatactgttgcaggctgagggaacagcctgtgcaaaggcctagaagggaaagaagatggggcttctgatgctttttgttagatttctttctttctatttttttgagacagagtctgctgctcttgttgcccaggctggagtgcagtggcatgatcatggctgactgcagcctcaactcctaggctccagcagtcctcctgcctcagcttaccgaatacctgggagtacaggcacacaccgccatgcctggctaatttttaaaattttttgtagagacagggtcttgctatgttgcccaggctggtcttgaactcctgggctccagcaatcctcctacctcagcctcccaaagctttggtgttacaggcatgagccattgcatgtggccttctgagtgttagtgtactgaatgctgaagacatggctgggaagtggggattactgtccttattttgtgaaggaggaacttaggattcaaggaggcaaattttcatgctcatagtcacccagctaggaagttgtaaagccagaatttgaacttggatctatctgagatctgagctaagtaagagaaggtaggagcagtgagcatgattaggtcatgcaggattgtgggtgccaagtttgggggtgctcaaactctaccagagacattggggagccatggcaggttctaggcagagggaggacagggtcaggtttggctttagaaagatcccttggcctcggctgggcacggtggctcacgcctgtaatcccagcactttgggaggccgaggagggcggatcacgaggtcaggagttcgagaccatcctggctaacacagtgaaaccccatctctactaaaaatacaaaaaattagccaggtgtggtggcgggcgcctgtagtcccagctacttgggaggctgaggcgggagaatggcatgaacccaggaggcggagcttgcagtgagctgagatctgccactgcactccagcctgggtgacagatcgagactccgtcttaaaaaaaaaaaatcccttggcctccaggccgggtgcagtggcttatgcctgtaatcccagcactctgggaggctgaggtgggcgtaaaacctgaggtcaggagttcaagaccagcctggccaacatggcgaaaccccgcatctactaacgatacaaaagttagccaggcgtgggggcgtgtctgtagtcccagctactcaggaggtttagggagggagaattgcttgaacccaggaagcggaggttgcagtgagcagaggtcatgccattgcactccagcctccaacctgggtgacaagagcgagattccatctcaaaaaaaaaaaaagaaaaaaagatcccttggcctccagagagcccacaatgcatgaaaagtaacagaggaaaagaagcaggtatgtgagatagcagggaggtgaagggagtggacagacaaggttgatgccacaagtcacataagaggggccaggaaatagccactggatctaccagcaagaaggctgatagtcgggaggatcatttgagtccaggagtttgagaccagcctgggcaatgtagtaggactccatctctacaaaaaaaaaaaaatatatgtatatagacatagccgggcatggtggcacatgcctgtggtctcagttgctcgggaggctgaggtaggagaatcacttgagcccgggagggtgaggctgcagtgagctatgatcttgccactggactccagcctgggccacagagacaccgtctaaaaaaaaaaaaaaaagggctgggcatggtggctcactcctgtaatcccagcactttgggaggccgaggtgggcggatcacctgatgtcaggagtttgagaccagcctggccaacatagtgaaaccccgtctctactaaaaatacaaaaaaattagccaggcgtggtggtgcacgcctgtagtcccagctactcaggaggctgaggcaggagaatcacttgaacctgggaggcaaaggttgcagtgagccaagatcgtgccactgcactccagcctgggcaacagagtgggactctgtctcaaaaaaaaaaagaaagaaaggcagccagggtgtgcaggacgctgtgggtatggacacctgagggtggtggtaactgagcggagatagtgtagtcatcatgtctagattccctgtgggtggggaacatggagtcaagtttcagggcaggcgtggggacctacctgtaagactctaggggcaggaagtagagtgtgcagagcctccctctagtagcctgttaggcttagaactggagaggatggagcatagatgtcagtaggaggctggggctgggcagaggtgatatcagtacacagaggccattattgaggagggtaacagattggattccaatcctgatttcttcactttcttgctatgtgacctggggcatggcccctcccttcctgcctcatttctttttttcctgtttttaatttttagtttttttaaaaagcagagatgaggtctctgttgcccaggttggtctcgaactcctgggcggctcaagtgatcctcccatcttggccttccaaagtgttgggattataggtgtgagccaccacgcccagcctgtgcctcattttaaaatgacacttatctcacagagttggattaaatcagccaatacctggaaagcactttaccccatgcttggcacacagtaaatactcagtgaagtgccagctgctatgattgtcatcccatgtatttgtgtaatgttattatgccaaaaaccagtctccttccttccctgccgccaaacctctgcatctcctcctccaggtgccttcaaatctcttgacaaagatggcactggacaaatccaggtgaacatccaggaggtaaggacccccatattggggtatgggtgcctgggaggaccccacccctcagcccttcataccagctctgagctgcagtccccttcctcctattttgccagccgtccctgggtgagggcaaaggggctggtgctcttggggttccctgtcctcactctccaccctcctctccccagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctctatgggatctgcctcctgatctgacccgagagaggaggggtggctcgggctctgggtcctggggagcaggggaggtagtagattcgtccccagggctggatccgtggatttcctcgtctttttctcgtcggcattttttgtctcatcctgagctgtggaggctgagacaggacccagaagccccagtgatctctgcttctgcttccagagtctgggctggagggaggtctcaatgccactcctggccctgtcccccaaggccatgtttgcccctcttgcagcttctccatccacacttggcctctgcctctgttgtgtcatggaccatgctcagtgtcttccttcccacttgaggacaccaccccacgtccccgggtcccgagggggagcctatgggtgctgtttggggtactcagcagagggctgagaggtagcaacatcctaggagtatccctggtccagcatgaggcaccgagggctgggggcagtgggcagtccacagggcagagatccctggctggtgggaggatgggcttggtggggaggggtggacacaaacacagacacacacagaggccagcgtttattgacacttgttcaagtctctcaggccccccaggcttcttggtcttaattcctggggaaggaggcccagccaagggagtacaagctgtagacagtgcctagaaaggggaagcgttggagacagaatgagacctaatcccctccctggacatcccaggcttttaaggccttcaggctccctggttcccagcctggaccccagctctagttcggactccagctcccttcccagattggactcctattgtaaagccccctggctttgatctagaccgggctgggagctttctccccgactcctccctgggcctcagccccaccactaacccagcccccgtcctgggacaagagcccaaaccctagttactcccctccctgcaggcctgactccagctcagtactcgacccccttcctaaacgccaacccccaacccagatc

SEQ ID NO: 736 - DNA, 3522 bp, Homo sapiens
acgcttgcgcggcgagtagaacgtgtggcggcggcggagatcgcgtctctttcgctccgtgtcccgctgctgctcctgtgagcgcccggcgagtccgtcccgtccaccgtccgcagctggtagccagcctgcccctcgcctcgactccctttcaccaacaccgacacccacattgacacctccagtccggccagccgctccactcgttgcctttgcatctccacacatggcgtcctccgcgcagagcggcggctcctccgggggacccgcggtccccaccgtgcagcggggcatcatcaagatggtcctctcagggtgcgccatcattgtccgaggtcagcctcgtggtgggcctcctcctgagcggcagatcaacctcagcaacattcgtgctggaaatcttgctcgccgggcagccgccacacaacctgatgcaaaggatacccctgatgagccctgggcatttccagctcgagagttccttcgaaagaagctgattgggaaggaagtctgtttcacgatagaaaacaagactccccaggggcgagagtatggcatgatctaccttggaaaagataccaatggggaaaacattgcagaatcactggttgcagagggcttagccacccggagagaaggcatgagagctaataatcctgagcagaaccggctttcagaatgtgaagaacaagcaaaggcagccaagaaagggatgtggagtgaggggaacggttcacatactatccgggatctcaagtataccattgaaaacccaaggcactttgtggactcacaccaccagaagcctgttaatgctatcatcgagcatgtgcgggacggcagtgtggtcagggccctgctcctcccagattactacctggttacagtcatgctgtcaggcatcaagtgcccaacttttcgacgggaagcagatggcagtgaaactccagagccttttgctgcagaagccaaatttttcactgagtcgcgactgcttcagagagatgttcagatcattctggagagctgccacaaccagaacattctgggtaccatccttcatccaaatggcaacatcacagagctcctcctgaaggaaggtttcgcacgctgtgtggactggtcgattgcagtttacacccggggcgcagaaaagctgagggcggcagagaggtttgccaaagagcgcaggctgagaatatggagagactatgtggctcccacagctaatttggaccaaaaggacaagcagtttgttgccaaggtgatgcaggttctgaatgctgatgccattgttgtgaagctgaactcaggcgattacaagacgattcacctgtccagcatccgaccaccgaggctggagggggagaacacccaggataagaacaagaaactgcgtcccctgtatgacattccttacatgtttgaggcccgggaatttcttcgaaaaaagcttattgggaagaaggtcaatgtgacggtggactacattagaccagccagcccagccacagagacagtgcctgccttttcagagcgtacctgtgccactgtcaccattggaggaataaacattgctgaggctcttgtcagcaaaggtctagccacagtgatcagataccggcaggatgatgaccagagatcatcacactacgatgaactgcttgctgcagaggccagagctattaagaatggcaaaggattgcatagcaagaaggaagtgcctatccaccgtgttgcagatatatctggggatacccaaaaagcaaagcagttcctgccttttcttcagcgggcaggtcgttctgaagctgtggtggaatacgtcttcagtggttctcgtctcaaactctatttgccaaaggaaacttgccttatcaccttcttgcttgcaggcattgaatgccccagaggagcccgaaacctcccaggcttggtgcaggaaggagagcccttcagcgaggaagctacacttttcaccaaggaactggtgctgcagcgagaggtggaggtggaggtggagagcatggacaaggccggcaactttatcggctggctgcacatcgacggtgccaacctgtccgtcctgctggtggagcacgcgctctccaaggtccacttcaccgccgaacgcagctcctactacaagtccctgctgtctgccgaggaggccgcaaagcagaagaaagagaaggtctgggcccactatgaggagcagcccgtggaggaggtgatgccagtgctggaggagaaggagcgatctgctagctacaagcccgtgtttgtgactgagatcactgatgacctgcacttctacgtgcaggatgtggagaccggcacccagttggagaagctgatggagaacatgcgcaatgacattgccagtcacccccctgtagagggctcctatgccccccgcaggggagagttctgcattgccaaatttgtagatggagaatggtaccgtgcccgagtagagaaagtcgagtctcctgccaaaatacatgtcttctacattgactacggcaacagagaggtcctgccatccacccgcctgggtaccctatcacctgccttcagcactcgggtgctgccagctcaagccacggagtatgccttcgccttcatccaggtgccccaagatgatgatgcccgcacggacgccgtggacagcgtagttcgggatatccagaacactcagtgcctgctcaacgtggaacacctgagtgccggctgcccccatgtcaccctgcagtttgcagattccaagggcgatgtggggctgggcttggtgaaggaagggctggtcatggtggaggtgcgcaaggagaaacagttccagaaagtgatcacagaatacctgaatgcccaagagtcagccaagagcgccaggctgaacctgtggcgctatggagactttcgagctgatgatgcagacgaatttggctacagccgctaaggaggggatcgggtttggcccccagccccgctcacgccagtccctcttcctctgccgggagggtgttttcaactccaaaccccagagaggggttgtagattgggtccagctttgcttcagtgtgtggaaatgtctcgtggggtggcatcggggctgcggggtggggaccccaaggctttctggggcagacccttgtcctctgggatgatgggcactgctatccacagtctctgccagttggttttatttggaggtttgtgggctttttttaaaaaaaaaaagtcctcaaatcaggaagaaacatcaaagactatgtcctagtggagggagtaatcctaacacccaggctggccgccagctggcacctgcctctatcccagactgccctcgtcccagctctctgtccaactgttgattatgtgatttttctgatacgtccattctcaaatgccagtgtgttcacatcttcgctctggccagcccattctgtatttaaagcttttgaggcccaataaaatagtacgtgctgtctgcagcccttattgatcaaaaaaaaaaaaaaa

SEQ ID NO: 737 - DNA, 2307 bp, Homo sapiens
ccaaagacatcctttggtgatacttactgtgggattcagagtggggtgcagaggacgaccctgcaaaggcacggactataagagagatctgtgcagctgcgcctcagggggtgtcctgggcccctgggcatgacaggagggggaccacttgcagttctactggaaaatttaccacccttccagaatcctctgaagatatacaggtcgcaactagagtgagacccgagtactgccttgggtcagaatggctagagaaccgagaaaaaacgcagccctggacgcccagtctgcagaagaccagacggggctcctgaccgtgaaggtggagaaggaggaagcctccgccttgacggcggaggtgagagcaccctgcagccctgctcggggccccgaacgctcccgccagcgcttccgaggcttccgctacccggaggctgcgggcccccgcgaggcgttgagccggctccgagaactctgcggacaatggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggttcccgttggtgaccaggggcaagaactgctctgttgcaagatggcactattgacacaaactcaagggtctcaaagtagccagtgccagccaatgaaggctctgttcaagcatgaatctctgggatcccagcccttacacgatagagttctccaggttcctgggcttgcccagggagggtgctgcagagaagatgcaatggtagcttccaggctcactccagggtcccagggtttgctgaaaatggaagatgtggccctgaccctcactcctgggtggacacagctggattcatctcaggtgaacctctacagagatgaaaagcaggagaaccatagcagcctggtctcccttggtggtgaaatacagactaagagcagggacttgcctccagtcaagaagcttccagaaaaggagcatgggaagatatgccacctgagggaagacattgcccagattcctacacatgcagaagctggtgaacaggagggcaggttacaaagaaagcagaaaaatgccatagggagtaggcgacattattgccatgaatgtggaaagagttttgctcaaagttcaggcctgactaaacacaggagaatccacactggtgagaaaccctatgaatgtgaagactgtggaaagaccttcattgggagctctgcccttgtcattcatcagagagtccacactggtgagaagccatatgagtgtgaagaatgtggtaaggtcttcagtcacagctcaaaccttatcaaacaccagagaacccacactggggagaagccctatgagtgtgatgactgtgggaagaccttcagccagagctgcagcctccttgaacatcacaaaattcatactggggagaagccataccagtgcaatatgtgtggcaaagcctttaggcggaattcacatctcctgagacatcagaggattcatggtgataaaaatgttcagaatcctgagcacggggagtcctgggaaagtcagggtaggacggaaagccagtgggaaaatactgaggctcccgtgtcttataaatgtaatgagtgtgagagaagtttcacacggaatagaagtcttattgaacatcagaaaatccacactggtgagaaaccctatcagtgtgacacatgtggaaaaggtttcactcgaacttcataccttgttcaacatcagagaagccatgtagggaaaaaaactctttcacagtgacccatggtattcatgccaacattggtgctcatttgtcactgaactgaagccaccctggagcccttaatggttacagaaattgtggaccagggctttatttaccactatacatcatcgggtattagaaaatgtagtctggctgagacgatgagttatcttctacattctagaaagtgattggaagaagtcatttgataagaggccatgggagagtggtctggaagttgtaggacctaaaatagtttgttctcacccagtgtatttaaatggccttctggacttgttaattgccctcagccagcactttaggacatctggttggatggctctgatgtggggggctgctgctctgaccattcattttgcctctaatgaatctttcacaaattggtcagatccatgagaaaaaaaaaaaaaaaaaaaaa

SEQ ID NO: 738 - DNA, 2981 bp, Homo sapiens
tccccgcccctcggcccagcctgccagtcggaagtgcggccgccggaactggctgttggtgggggtgcagcactgagccgccgacggggcgggtgggctttgctgccgagcaggcggcgccgtcttggggcctagcggcgaggcgacccgcacaggtgggcggtggcggtaggtgggtggccagcgactggcaacgcggtggcttagacgcgcgagatccggccagggtcagagtactgtaagattgatgttaaaggcatggtgttcaccccacttcatcagcgtacataagttatctcttcttttggacccttattttatgccataatgcaacaagctttagaactagctttggatcgtgcagagtatgtcattgaaagtgcccgacagagacctcctaaaaggaaatacctatcaagtggaagaaaatctgtatttcaaaaactttatgacttgtatattgaagaatgtgaaaaagaacctgaagttaagcagaaattaagaagaaatgtgaacttgttagagaagcttgttatgcaagagactttgtcatgtttagtggtcaatctatacccaggaaatgagggatattctctgatgctcaggggaaaaaacggatcagattccgagaccattcgactgccctatgaagaaggagagttgcttgaatatttggatgcagaagaattacctcctattttggttgatctcctagaaaaatctcaggttaatatttttcattgcggatgtgtcatagcagaaatacgtgactacaggcagtccagtaacatgaaatctcctggttaccaaagtcggcacattctcttacgtccaacaatgcagactttaatttgtgatgtacattcaataacaagtgataaccacaaatggacccaggaagacaaacttttgcttgagagccagctcatcctagctacagctgaaccactctgtcttgatccttctatagcagtcacctgcactgcaaacagactgctctataacaagcaaaagatgaacactcgcccaatgaaacggtgtttcaagaggtattccagatcctctctgaatcggcagcaagatctatctcattgtccacctcctcctcagctgaggttacttgatttcttacaaaaaagaaaggaaagaaaagcaggtcagcattatgacctcaaaatttctaaggcaggaaattgtgtagatatgtggaaacggagtccctgtaatttggccataccttctgaagtagatgtggagaaatatgctaaagtggaaaagtctatcaaatctgatgactcacagccaacagtctggccagcccatgatgtaaaagatgattatgtatttgaatgtgaagctggtactcagtatcagaaaacaaagctgaccatcttgcagtcgcttggagatccactttactatggtaaaatacagccatgtaaagcagatgaagaaagtgacagccagatgtctccatcacactcgtccacagatgatcattcaaattggttcattattggatcaaagaccgatgctgagagggtagtcaatcagtaccaagaattagtccagaatgaagccaaatgtccggtcaagatgtcacacagctccagtggctcagccagtctgagtcaggtttctccagggaaagaaacagatcaaactgaaaccgtgtcagttcagtcttcggtattggggaagggtgtaaaacatcgacccccaccaatcaaacttccctcaagctcaggaaatagttcctcaggtaactattttacaccacaacagacaagcagctttctcaaatctccaactcctcctccttcttctaagccatcaagtattcctcggaaatcatctgtggatctcaatcaagttagcatgctttctccagctgccctatcacctgccagctcatcacaaagaaccacggccacccaggtcatggcaaactctgctggacttaacttcatcaatgtagtgggctctgtttgtggggcccaggctttgatgagtggttcaaaccccatgctgggctgtaacactggtgccataactcctgcaggaataaacctgagcggccttctaccctcaggaggtctgctaccaaatgcactgcccagtgcaatgcaggcagcttctcaagcaggtgttccatttggtttaaaaaatacttcaagtctcaggcccttaaatctactccagcttccaggtggttcacttatttttaacactctgcagcagcagcaacagcagctctcccagtttacaccacaacaacctcagcagcccacaacttgtagtcctcaacagccaggggagcagggttctgagcaaggttcaaccagtcaagaacaggccttatctgctcagcaagctgctgttattaaccttactggagtaggaagttttatgcagtcacaggcagctgcagttgcgattcttgcagcatcaaatggctatggcagcagcagcagcacaaacagctcagctacatcatcatcggcatacaggcagccagtcaaaaagtaaaatgaagagaggcacgccaaccactccaaaattttgagtcttgcattactttttgttccttttttaaaaacacaagagcactgaatcaaaagaattgagtttctactttttgttttttttaatgtgtcagtattttacattgctagatgtacaaactttatacagaagcacaaccttatcatttttaaataaaaacagggaaatggtttaacaaactagggttggtttgcctaagtcattgctttttaaaaatggtttcactatacataatatatatggaagtgacctaagaaataatagaaacatctttcagaagaatgtagtttgatatttatttagtataaaacgtttgtgcacagtgttaacaaatacaatttttacaaatctgttttgaaaaaaaaaaaaaaaaaaaaaaaaaaaaaaaaaaaaaaaaaaaaaaaaaaaaaaaaaaa

SEQ ID NO: 739 - DNA, 1967 bp, Homo sapiens
ctgtcctgggattgcctggagctccgcaccgcgagtttgccgcggcactttccgcgcggcggaagagcgcgcgccagcttcggcacacctgggagccggatcccagccctacgcctcgtcccctacaagctcctccaagccccgccggctgctgtgggagcggcggccgtccctctcctggaggtcgtctcctggcatcctcggggccgcaggaaggaagaggaggcagcggccggagccctggtgggcggcctgaggtgagagcccgaccggcccctttgggaatatggcgaccggtggctaccggaccagcagcggcctcggcggcagcaccacagacttcctggaggagtggaaggcgaaacgcgagaagatgcgcgccaagcagaaccccccgggcccggcccccccgggagggggcagcagcgacgccgctgggaagccccccgcgggggctctgggcaccccggcggccgccgctgccaacgagctcaacaacaacctcccgggcggcgcgccggccgcacctgccgtccccggtcccgggggcgtgaactgcgcggtcggctccgccatgctgacgcgggcggcccccggcccgcggcggtcggaggacgagcccccagccgcctctgcctcggctgcaccgccgccccagcgtgacgaggaggagccggacggcgtcccagagaagggcaagagctcgggccccagtgccaggaaaggcaaggggcagatcgagaagaggaagctgcgggagaagcggcgctccaccggcgtggtcaacatccctgccgcagagtgcttagatgagtacgaagatgatgaagcagggcagaaagagcggaaacgagaagatgcaattacacaacagaacactattcagaatgaagctgtaaacttactagatccaggcagttcctatctgctacaggagccacctagaacagtttcaggcagatataaaagcacaaccagtgtctctgaagaagatgtctcaagtagatattctcgaacagatagaagtgggttccctagatataacagggatgcaaatgtttcaggtactctggtttcaagtagcacactggaaaagaaaattgaagatcttgaaaaggaagtagtaagagaaagacaagaaaacctaagacttgtgagactgatgcaagataaagaggaaatgattggaaaactcaaagaagaaattgatttattaaatagagacctagatgacatagaagatgaaaatgaacagctaaagcaggaaaataaaactcttttgaaagttgtgggtcagctgaccaggtagaggattcaagactcaatgtggaaaaaatattttaaactactgattgaatgttaatggtcaatgctagcacaatattcctatgctgcaatacattaaaataactaagcaagtatatttatttctagcaaacagatgtttgttttcaaaatacttctttttcattattggttttaaaaaagcattatccttttatctcacaaataagtaatatctttcagttattaaatgatagataatgcctttttggttttgtgtggtattcaactaatacatggtttaaagtcacagccgtttgaatatattttatcttggtagtacattttctcccttaggaatatacatagtctttgtttacatgagttcaaatacttttgggatgttaccttcacatgtcctattactgatgtgtgcaaccttttatgtgttgatgactcactcataaaggtttttgtctactgtcatttgttctttccacttattctaagcatttagagtaatagagtcatacttttttataacagcaaccttttaaaaggaaagctcttataaagtcactgtcatgttttagttgactaaatataaatttaagagaatacttgaattgtgctatagtaaataaaaatttactattttgtgtttgaaaaaaaaaaaaaaaaaa

SEQ ID NO: 740 - DNA, 2838 bp, Homo sapiens
aaattgattcccgcacgctgcagcctcccggtcagacgaatttctcccaatcggatgaagttcaccctgggcctggggtcgcgggcgtggagagtgtcctgggagggggcagcagcggcggcggcaggccctggagcgggcggcagcgcgctccgctgccgcgcacagcgcgtctccagcccgcggctgggccgccgcggctctcggctctcgggcgccctccctctatgcctctcacgcggcggcggcggcgcccaagctctcccggactgcgccgggcccagccccggccaccccggccaccccggcgccaggcagctggccggcccgctcgctatggagcagacgtatggcgaggtgaaccagctgggcggtgtgttcgtcaacggccgccccctgcccaacgccatccgcttgcgcattgtggagctggcgcagctgggcatccgaccctgtgacatcagtcggcagctccgcgtatcccacggctgcgtgagcaagatcctggcgcgctacaacgagaccggctccattctgcccggggccatcggggggagcaagccccgcgtcaccactcccaacgtggtcaagcacatccgggactacaagcaaggagaccctggcatctttgcctgggagatccgcgaccggctgctggccgacggcgtctgtgacaagtacaatgtgccttcggtgagctccatcagccgcatcctgcgcaacaagatcggcagcctggcgcagcccggaccgtacgaggcaagtaagcagccgccgtcgcagcctacgctgccctacaaccacatctaccagtacccctaccccagtcccgtgtcgcccacgggcgccaagatgggcagccaccccggggtcccgggcacggcgggccacgtcagcatcccgcgctcatggccctcggcacactcggtcagcaacatcctgggcatccggacgtttatggagcaaacaggggccctggctgggagcgaaggcaccgcttactctcccaagatggaagactgggccggcgtgaaccgcacggccttccccgccacccccgcagtgaatgggctagagaaacctgccttagaggcagacattaaatacactcagtcggcctccaccctctctgccgtgggcggctttctccccgcctgcgcctacccggcctccaaccagcacggcgtgtacagcgccccgggcggcggctacctcgccccgggcccgccgtggccgcctgcgcaaggtcctcctctggcgccccccggggccggcgtagctgtgcatggcggggaactcgcggcagcaatgaccttcaagcatcccagccgagaaggaagcctcccagctccggcagcaaggccccggacgccctcagtagcttacacggactgcccatcccggcctcgacctcctaggggcagctctccccggacccgagcccggagggaacggcaggcggacccgggcgcacaggtctgcgcggcggccccggcaatcggcacgggcaggatcggaggactcgcggaggaggaagccagtgccggcccgcggggtgcacgcccagccagcccccaggcccagccctgcctctggccggacccaccacacttcctttattggtctgggtttttaggcttctctgaacttgggttttagactgccgtaccctcctcacaatccttgctctgacgtggcctccttcgctctgccagcttcaaatttcttttttgtcactcccttgtccgtctccgtctcgcctctctccctgtttccttcccccctctttctttctcactctccctcccttccctttctctttcccttcctccctaccttccaccccggctttccccgaccttccagggctccctctgcccttccactctcttttccttgctccgacctctgctccagtcccgcttcttcccccgtctcctctttctagtcctctatatgctatcagccctttttcctggtccatccctgtcgttccttctctctctgtctctggttctactgtcaagggccctagttccctttgttttactgcttccccaaccctccctcagtccctgagagccctagagccatctcggtgacagtcccttctctggcacctgggactttgtagccttcactcctctgagcccaccagccctaatggaggggggctcaaacctaggaagtggacagaaaagccacagcctttattttgtattttttttgtaataacaaaccctaaaaaaccctccatgaactgtcctctcccgtcgatccccgcagcatattgtctggaaatctgttttctttctcagagcccagtggccgccgggcttctcttcccttctgagatgatgtcaccccaaagaagactggggtaggagtagggagcacaggggttgttggtgttttcagtgcttagaaaactgggttgtcctgcaggtgtctcctcccacccctccactcgcaacacttgctagggaatccgaccagtggtaaacacatcagcactttttggtgttcaggggtcagcacatttgttaatttaaaccacagactgcttccaggtacaaaggttcatttggacttctggtttgcaagggatgagggttaaaaaaaacaaaacaaaacaaacaacaacaacaacaaaaacaacccagaaagtatcttctagagccagccgcaagagctgtgagctgcttccaagttaggcgagctggtggtggtaccctggacataatgcaattctgtagtcagagcaatatccctggcgagagcctgacatcgcctgttaaaggtggctgcctctgaataaaggaaagcgtctgaaaggtg

SEQ ID NO: 741 - DNA, 4054 bp, Homo sapiens
cgggggcctggcccgcgcgctcccctcccgcaggcgccacctcggacatccccgggattgctacttctctgccaacttcgccaactcgccagcacttggagaggcccggctcccctcccggcgccctctgaccgcccccgccccgcgcgctctccgaccaccgcctctcggatgaccaggttccaggggagctgagcgagtcgcctcccccgcccagcttcagccctggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccagcggggagcgcagtgctgcgccccccgcccccgcgcgccccgcagcagccgggcgttcactcatcctccctcccccaccgtccctcccttttctcctcaagtcctgaagttgagtttgagaggcgacacggcggcggcggccgcgctgctcccgctcctctgcctccccatggatatgcactgcaaagcagaccccttctccgcgatgcacccagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtcagccacggctgtgtcagcaaaatcctgggcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacagaatcatccggaccaaagttcagcagcctttccacccaacgccggatggggctgggacaggagtgaccgcccctggccacaccattgttcccagcacggcctcccctcctgtttccagcgcctccaatgacccagtgggatcctactccatcaatgggatcctggggattcctcgctccaatggtgagaagaggaaacgtgatgaagatgtgtctgagggctcagtccccaatggagattcccagagtggtgtggacagtttgcggaagcacttgcgagctgacaccttcacccagcagcagctggaagctttggatcgggtctttgagcgtccttcctaccctgacgtcttccaggcatcagagcacatcaaatcagaacaggggaacgagtactccctcccagccctgacccctgggcttgatgaagtcaagtcgagtctatctgcatccaccaaccctgagctgggcagcaacgtgtcaggcacacagacatacccagttgtgactggtcgtgacatggcgagcaccactctgcctggttacccccctcacgtgccccccactggccagggaagctaccccacctccaccctggcaggaatggtgcctgggagcgagttctccggcaacccgtacagccacccccagtacacggcctacaacgaggcttggagattcagcaaccccgccttactaagttccccttattattatagtgccgccccccggtccgcccctgccgctgctgccgctgcctatgaccgccactagttaccgcggggaccacatcaagcttcaggccgacagcttcggcctccacatcgtccccgtctgaccccaccccggagggagggaggaccgacgcgacgcgatgcctcccggccaccgccccagcctcaccccatcccacgacccccgcaacccttcacatcacccccctcgaaggtcggacaggacgggtggagccgtgggcgggaccctcaggcccgggcccgccgcccccagccccgcctgccgcccctccccgcctgcctggactgcgcggcgccgtgagggggattcggcccagctcgtcccggcctccaccaagccagccccgaagcccgccagccaccctgccggactcgggcgcgacctgctggcgcgcgccggatgtttctgtgacacacaatcagcgcggaccgcagcgcggcccagccccgggcacccgcctcggacgctcgggcgccaggaggcttcgctggaggggctgggccaaggagattaagaagaaaacgactttctgcaggaggaagagcccgctgccgaatccctgggaaaaattcttttcccccagtgccagccggactgccctcgccttccgggtgtgccctgtcccagaagatggaatgggggtgtgggggtccggctctaggaacgggctttgggggcgtcaggtctttccaaggttgggacccaaggatcggggggcccagcagcccgcaccgatcgagccggactctcggctcttcactgctcctcctggcctgcctagttccccagggcccggcacctcctgctgcgagacccggctctcagccctgccttgcccctacctcagcgtctcttccacctgctggcctcccagtttcccctcctgccagtccttcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtca

SEQ ID NO: 742 - DNA, 1489 bp, Homo sapiens
aggaggagactcaggcaggccgcgctccagcctcaccaggctccccggctcgccgtggctctctgagcccccttttcagggaccccagtcgctggaacatttgcccagactcgtaccaaacttttccgccctgggctcgggatcctggactccggggcctccccgtcctcccctttcccgggttccagctccggcctctggactaggaaccgacagcccccctccccgcgtccctccctctctctccagccgttttggggaggggctctccacgctccggatagttcccgagggtcatccgcgccgcactcgcctttccgtttcgccttcacctggatataatttccgagcgaagctgcccccaggatgaccacgctggccggcgctgtgcccaggatgatgcggccgggcccggggcagaactacccgcgtagcgggttcccgctggaagtgtccactcccctcggccagggccgcgtcaaccagctcggcggtgtttttatcaacggcaggccgctgcccaaccacatccgccacaagatcgtggagatggcccaccacggcatccggccctgcgtcatctcgcgccagctgcgcgtgtcccacggctgcgtctccaagatcctgtgcaggtaccaggagactggctccatacgtcctggtgccatcggcggcagcaagcccaagcaggtgacaacgcctgacgtggagaagaaaattgaggaatacaaaagagagaacccgggcatgttcagctgggaaatccgagacaaattactcaaggacgcggtctgtgatcgaaacaccgtgccgtcagtgagttccatcagccgcatcctgagaagtaaattcgggaaaggtgaagaggaggaggccgacttggagaggaaggaggcagaggaaagcgagaagaaggccaaacacagcatcgacggcatcctgagcgagcgaggtaagcggtggcgccttgggcggcgcacttgctgggtgacttggagggcatcggctagctgacattggtgatctgacggcagccaagcccagctcggatcaaggtcccttcatgcgcggtgtctctgcgcctgagtaacgacatggaactgaaagaccagagggacactaggaatcaaaacaaacatttctattctgcttagtttttctgttttgtaaatctttctttcttaaccactttcagcccctgggattctagaactgtgaattgtgctctgttgtagggggcaggggaagctctcactctgttgccattaaatgtatgagactgggcatctctgagcaattgtagggccggggatagagggtacttgaatcttcagaagttgaagtagcttttatgccctcaggaaaggccctggtctccggagtttcctcgcattaaaggagagagagagagagtactcttttgggcaacggccctccaaaattgcccccacattggctgccttataaatatgtctgtgtgttgactggt

SEQ ID NO: 743 - DNA, 2010 bp, Homo sapiens
caaagactcacccgtgagccagctctcaaagaaagcagcttgcgttgacagcctgggggcagcaaggatgcagtctcccaggagaggatgcactcggtggtgggaagccaggctggaggggcctgagtgaccctctccacaggcgggcagggcagtgggagaggtggtgtgtggatacctctgtctcacgcccagggatcagcagcatgaaccagcttggggggctctttgtgaatggccggcccctgcctctggatacccggcagcagattgtgcggctagcagtcagtggaatgcggccctgtgacatctcacggatccttaaggtatctaatggctgtgtgagcaagatcctagggcgttactaccgcacaggtgtcttggagccaaagggcattgggggaagcaagccacggctggctacaccccctgtggtggctcgaattgcccagctgaagggtgagtgtccagccctctttgcctgggaaatccaacgccagctttgtgctgaagggctttgcacccaggacaagactcccagtgtctcctccatcaaccgagtcctgcgggcattacaggaggaccagggactaccgtgcacacggctcaggtcaccagctgttttggctccagctgtcctcactccccatagtggctctgagactccccggggtacccacccagggaccggccaccggaatcggactatcttctccccaagccaagcagaggcactggagaaagagttccagcgtgggcagtatcctgattcagtggcccgtggaaagctggctactgccacctctctgcctgaggacacggtgagggtctggttttccaacagaagagccaaatggcgtcggcaagagaagctcaagtgggaaatgcagctgccaggtgcttcccaggggctgactgtaccaagggttgccccaggaatcatctctgcacagcagtcccctggcagtgtgcccacagcagccctgcctgccctggaaccactgggtccctcctgctatcagctgtgctgggcaacagcaccagaaaggtgtctgagtgacaccccacctaaagcctgtctcaagccctgctggggccacttgcccccacagccgaattccctggactcaggactgctttgccttccttgcccttcctcccactgtcacctggccagtcttagtggctctcaggccctgctctggcctggctgcccactactgtatggcttggaatgaggcaggagtgggaaggagatggcatagagaagatctaataccatcctgcccattgtccttaccgtcctgcccatacagactgtggctccttcctccttcctgtgattgctccctcctgtgtggacgttgcctggccctgcctcgatgcctctctggcgcatcacctgattggaggggctggtaaagcaacacccacccacttctcacactagccttaagaggcctccactcagcagtaataaaagctgtttttattagcagtagttctgttgtccatcatgttttccctatgagcacccctatgcccactctaatattcaacaattatagacaatttgccctatcatttatttacatctatgtatctaccatctaatctatgcatgtatgtaggcaatacatgtatctaaacaatgtatttgtcaatgcatcaatttacctactctatgtatgcatctatatgtgtattatgtatgcgtgcatgcgtgcgcgcacacacacacacacacacacacactgacattatatcatggcattttattcctaaatcttccagcatgcatccccaaaaaacaagaaacttgtcttacataatcacaataatatatccacatctaagaaaatttactgtaacttcttaatctaagaaaattatgtatttttgtcatatgtattttgtcatatgtattttgtatttgcatatgtattttgtatttgcatatgtatttttgtcatagcagcaaacagagtgaaatgccatttttcatattct

SEQ ID NO: 744 - DNA, 3650 bp, Homo sapiens
agcactgctgctctcccggcttcccgctctactccggccgggccgggtccgccacgtctggcgcgctgagcaggcccggccgcgcagcgcctaccctttcctcgctccgggccggcagtgtggggcggcgcgctgggggcgcggcgtgtctggggacatcttgtgatgttggcgagaacaggacatgatctcacatggcgagaagctctttagttccttaatcatttcacggtgccttcggacgctttttttccacctaaaacgtttagtttcagctcagtgatcagctaccccagctcggcgggggagcggaaggcttgaattattccgacctgtgagcggcccctggcaccaaaaaaaaaaaaaaaaaaaaaaaaaaaagaaaaaaaaaggcacaaaaaagtggaaacttttccctgtccattccatcaagtcctgaaaaatcaaaatggatttagagaaaaattatccgactcctcggaccagcaggacaggacatggaggagtgaatcagcttgggggggtttttgtgaatggacggccactcccggatgtagtccgccagaggatagtggaacttgctcatcaaggtgtcaggccctgcgacatctccaggcagcttcgggtcagccatggttgtgtcagcaaaattcttggcaggtattatgagacaggaagcatcaagcctggggtaattggaggatccaaaccaaaggtcgccacacccaaagtggtggaaaaaatcgctgaatataaacgccaaaatcccaccatgtttgcctgggagatcagggaccggctgctggcagagcgggtgtgtgacaatgacaccgtgcctagcgtcagttccatcaacaggatcatccggacaaaagtacagcagccacccaaccaaccagtcccagcttccagtcacagcatagtgtccactggctccgtgacgcaggtgtcctcggtgagcacggattcggccggctcgtcgtactccatcagcggcatcctgggcatcacgtcccccagcgccgacaccaacaagcgcaagagagacgaaggtattcaggagtctccggtgccgaacggccactcgcttccgggcagagacttcctccggaagcagatgcggggagacttgttcacacagcagcagctggaggtgctggaccgcgtgtttgagaggcagcactactcagacatcttcaccaccacagagcccatcaagcccgagcagaccacagagtattcagccatggcctcgctggctggtgggctggacgacatgaaggccaatctggccagccccacccctgctgacatcgggagcagtgtgccaggcccgcagtcctaccccattgtgacaggccgtgacttggcgagcacgaccctccccgggtaccctccacacgtcccccccgctggacagggcagctactcagcaccgacgctgacagggatggtgcctgggagtgagttttccgggagtccctacagccaccctcagtattcctcgtacaacgactcctggaggttccccaacccggggctgcttggctccccctactattatagcgctgccgcccgaggagccgccccacctgcagccgccactgcctatgaccgtcactgacccttggagccaggcgggcaccaaacactgatggcacctattgagggtgacagccacccagccctcctgaagatagccagagagcccatgagaccgtcccccagcatcccccacttgcctgaagctcccctcttcctctcttcctccagggactctggggccctttggtggggccgttggacttctggatgcttgtctatttctaaaagccaatctatgagcttctcccgatggccactgggtctctgcaaaccaatagactgtcctgcaaataaccgcagccccagcccagcctgcctgtcctccagctgtctgactatccatccatcataaccaccccagcctgggaaggagagcttgcttttgttgcttcagcagcacccatgtaaataccttcttgcttttctgtgggcctgaaggtccgactgagaagactgctccacccatgatgcatctcgcactcttggtgcatcaccggacatcttagacctatggcagagcatcctctctgccctgggtgaccctggcaggtgcgctcagagctgtcctcaagatggaggatgctgcccttgggccccagcctcctgctcatccctccttctttagtatctttacgaggagtctcactgggctggttgtgctgcaggctccccctgaggcccctctccaagaggagcacactttggggagatgtcctggtttcctgcctccatttctctgggaccgatgcagtatcagcagctcttttccagatcaaagaactcaaagaaaactgtctgggagattcctcagctacttttccgaagcagaatgtcatccgaggtattgattacattgtggactttgaatgtgagggctggatgggacgcaggagatcatctgatcccagccaaggaggggcctgaggctctccctactccctcagcccctggaacggtgttttctgaggcatgcccaggttcaggtcacttcggacacctgccatggacacttcacccaccctccaggaccccagcaagtggattctgggcaagcctgttccggtgatgtagacaataattaacacagaggactttcccccacacccagatcacaaacagcctacagccagaacttctgagcatcctctcggggcagaccctccccgtcctcgtggagcttagcaggcagctgggcatggaggtgctggggctggggcagatgcctaatttcgcacaatgcatgcccacctgttgatctaaggggccgcgatggtcagggccacggccaagggccacgggaacttggagagggagcttggagaactcactgtgggctagggtggtcagaggaagccagcagggaagatctgggggacagaggaaggcctcctgagggaggggcaggagagcagtgaggagctgctgtgtgacctgggagtgattttgacatgggggtgccaggtgccatcatctctttacctggggccttaattccttgcatagtctctcttgtcaagtcagaacagccaggtagagcccttgtccaaacctgggctgaatgacagtgatgagagggggcttggccttcttaggtgacaatgtcccccatatctgtatgtcaccaggatggcagagagccagggcagagagagactggacttgggatcagcaggccaggcaggtcttgtcctggtcctggccacatgtctttgctgtgggacctcagacaaaaccctgcacctctttgagccttggctgccttggtgcagcagggtcatctgtagggccaccccacagctctttccttcccctcctctctccagggagccggggctgtgagaggatcatctggggcaggccctccacttccaagcaagcagatgggggtgggcacctgaggcccaataatatttggaccaagtgggaaacaagaacactcggaggggcgggaatcagaagagcctggaaaaagacctagcccaacttcccttgtgggaaactgaggcccagcttggggaaggccaggaccatgcagggagaaaaag

SEQ ID NO: 745 - DNA, 6947 bp, Homo sapiens
ggtgcatttgcatgttgcggagtgattagtgggtttgaaaagggaaccgtggctcggcctcatttcccgctctggttcaggcgcaggaggaagtgttttgctggaggatgatgacagaggtcaggcttcgctaatgggccagtgaggagcggtggaggcgaggccgggcgccggcacacacacattaacacacttgagccatcaccaatcagcataggaatctgagaattgctctcacacaccaacccagcaacatccgtggagaaaactctcaccagcaactcctttaaaacaccgtcatttcaaaccattgtggtcttcaagcaacaacagcagcacaaaaaaccccaaccaaacaaaactcttgacagaagctgtgacaaccagaaaggatgcctcataaagggggaagactttaactaggggcgcgcagatgtgtgaggccttttattgtgagagtggacagacatccgagatttcagagccccatattcgagccccgtggaatcccgcggcccccagccagagccagcatgcagaacagtcacagcggagtgaatcagctcggtggtgtctttgtcaacgggcggccactgccggactccacccggcagaagattgtagagctagctcacagcggggcccggccgtgcgacatttcccgaattctgcaggtgtccaacggatgtgtgagtaaaattctgggcaggtattacgagactggctccatcagacccagggcaatcggtggtagtaaaccgagagtagcgactccagaagttgtaagcaaaatagcccagtataagcgggagtgcccgtccatctttgcttgggaaatccgagacagattactgtccgagggggtctgtaccaacgataacataccaagcgtgtcatcaataaacagagttcttcgcaacctggctagcgaaaagcaacagatgggcgcagacggcatgtatgataaactaaggatgttgaacgggcagaccggaagctggggcacccgccctggttggtatccggggacttcggtgccagggcaacctacgcaagatggctgccagcaacaggaaggagggggagagaataccaactccatcagttccaacggagaagattcagatgaggctcaaatgcgacttcagctgaagcggaagctgcaaagaaatagaacatcctttacccaagagcaaattgaggccctggagaaagagtttgagagaacccattatccagatgtgtttgcccgagaaagactagcagccaaaatagatctacctgaagcaagaatacaggtatggttttctaatcgaagggccaaatggagaagagaagaaaaactgaggaatcagagaagacaggccagcaacacacctagtcatattcctatcagcagtagtttcagcaccagtgtctaccaaccaattccacaacccaccacaccggtttcctccttcacatctggctccatgttgggccgaacagacacagccctcacaaacacctacagcgctctgccgcctatgcccagcttcaccatggcaaataacctgcctatgcaacccccagtccccagccagacctcctcatactcctgcatgctgcccaccagcccttcggtgaatgggcggagttatgatacctacacccccccacatatgcagacacacatgaacagtcagccaatgggcacctcgggcaccacttcaacaggactcatttcccctggtgtgtcagttccagttcaagttcccggaagtgaacctgatatgtctcaatactggccaagattacagtaaaaaaaaaaaaaaaaaaaaaaaggaaaggaaatattgtgttaattcagtcagtgactatggggacacaacagttgagctttcaggaaagaaagaaaaatggctgttagagccgcttcagttctacaattgtgtcctgtattgtaccactggggaaggaatggacttgaaacaaggacctttgtatacagaaggcacgatatcagttggaacaaatcttcattttggtatccaaacttttattcattttggtgtattatttgtaaatgggcatttgtatgttataatgaaaaaaagaacaatgtagactggatggatgtttgatctgtgttggtcatgaagttgttttttttttttttaaaaagaaaaccatgatcaacaagctttgccacgaatttaagagttttatcaagatatatcgaatacttctacccatctgttcatagtttatggactgatgttccaagtttgtatcattcctttgcatataattaaacctggaacaacatgcactagatttatgtcagaaatatctgttggttttccaaaggttgttaacagatgaagtttatgtgcaaaaaagggtaagatataaattcaaggaagaaaaaaagttgatagctaaaaggtagagtgtgtcttcgatataatccaatttgttttatgtcaaaatgtaagtatttgtcttccctagaaatcctcagaatgatttctataataaagttaatttcatttatatttgacaagaatatagatgttttatacacattttcatgcaatcatacgtttcttttttggccagcaaaagttaattgttcttagatatagttgtattactgttcacggtccaatcattttgtgcatctagagttcattcctaatcaattaaaagtgcttgcaagagttttaaacttaagtgttttgaagttgttcacaactacatatcaaaattaaccattgttgattgtaaaaaaccatgccaaagcctttgtatttcctttattatacagttttctttttaaccttatagtgtggtgttacaaattttatttccatgttagatcaacattctaaaccaatggttactttcacacacactctgttttacatcctgatgatccttaaaaaataatccttatagataccataaatcaaaaacgtgttagaaaaaaattccacttacagcagggtgtagatctgtgcccatttatacccacaacatatatacaaaatggtaacatttcccagttagccatttaattctaaagctcaaagtctagaaataatttaaaaatgcaacaagcgattagctaggaattgttttttgaattaggactggcattttcaatctgggcagatttccattgtcagcctatttcaacaatgatttcactgaagtatattcaaaagtagatttcttaaaggagactttctgaaagctgttgcctttttcaaataggccctctcccttttctgtctccctcccctttgcacaagaggcatcatttcccattgaaccactacagctgttcccatttgaatcttgctttctgtgcggttgtggatggttggagggtggaggggggatgttgcatgtcaaggaataatgagcacagacacatcaacagacaacaacaaagcagactgtgactggccggtgggaattaaaggccttcagtcattggcagcttaagccaaacattcccaaatctatgaagcagggcccattgttggtcagttgttatttgcaatgaagcacagttctgatcatgtttaaagtggaggcacgcagggcaggagtgcttgagcccaagcaaaggatggaaaaaaataagcctttgttgggtaaaaaaggactgtctgagactttcatttgttctgtgcaacatataagtcaatacagataagtcttcctctgcaaacttcactaaaaagcctgggggttctggcagtctagattaaaatgcttgcacatgcagaaacctctggggacaaagacacacttccactgaattatactctgctttaaaaaaatccccaaaagcaaatgatcagaaatgtagaaattaatggaaggatttaaacatgaccttctcgttcaatatctactgttttttagttaaggaattacttgtgaacagataattgagattcattgctccggcatgaaatatactaataattttattccaccagagttgctgcacatttggagacaccttcctaagttgcagtttttgtatgtgtgcatgtagttttgttcagtgtcagcctgcactgcacagcagcacatttctgcaggggagtgagcacacatacgcactgttggtacaattgccggtgcagacatttctacctcctgacattttgcagcctacattccctgagggctgtgtgctgagggaactgtcagagaagggctatgtgggagtgcatgccacagctgctggctggcttacttcttccttctcgctggctgtaatttccaccacggtcaggcagccagttccggcccacggttctgttgtgtagacagcagagactttggagacccggatgtcgcacgccaggtgcaagaggtgggaatgggagaaaaggagtgacgtgggagcggagggtctgtatgtgtgcacttgggcacgtatatgtgtgctctgaaggtcaggattgccagggcaaagtagcacagtctggtatagtctgaagaagcggctgctcagctgcagaagccctctggtccggcaggatgggaacggctgccttgccttctgcccacaccctagggacatgagctgtccttccaaacagagctccaggcactctcttggggacagcatggcaggctctgtgtggtagcagtgcctgggagttggccttttactcattgttgaaataatttttgtttattatttatttaacgatacatatatttatatatttatcaatggggtatctgcagggatgttttgacaccatcttccaggatggagattatttgtgaagacttcagtagaatcccaggactaaacgtctaaattttttctccaaacttgactgacttgggaaaaccaggtgaatagaataagagctgaatgttttaagtaataaacgttcaaactgctctaagtaaaaaaatgcattttactgcaatgaatttctagaatatttttcccccaaagctatgcctcctaacccttaaatggtgaacaactggtttcttgctacagctcactgccatttcttcttactatcatcactaggtttcctaagattcactcatacagtattatttgaagattcagctttgttctgtgaatgtcatcttaggattgtgtctatattcttttgcttatttctttttactctgggcctctcatactagtaagattttaaaaagccttttcttctctgtatgtttggctcaccaaggcgaaatatatattcttctctttttcatttctcaagaataaacctcatctgcttttttgtttttctgtgttttggcttggtactgaatgactcaactgctcggttttaaagttcaaagtgtaagtacttagggttagtactgcttatttcaataatgttgacggtgactatctttggaaagcagtaacatgctgtcttagaaatgacattaataatgggcttaaacaaatgaataggggggtccccccactctccttttgtatgcctatgtgtgtctgatttgttaaaagatggacagggaattgattgcagagtgtcgcttccttctaaagtagttttattttgtctactgttagtatttaaagatcctggaggtggacataaggaataaatggaagagaaaagtagatattgtatggtggctactaaaaggaaattcaaaaagtcttagaacccgagcacctgagcaaactgcagtagtcaaaatatttatctcatgttaaagaaaggcaaatctagtgtaagaaatgagtaccatatagggttttgaagttcatatactagaaacacttaaaagatatcatttcagatattacgtttggcattgttcttaagtatttatatctttgagtcaagctgataattaaaaaaaatctgttaatggagtgtatatttcataatgtatcaaaatggtgtctatacctaaggtagcattattgaagagagatatgtttatgtagtaagttattaacataatgagtaacaaataatgtttccagaagaaaggaaaacacattttcagagtgcgtttttatcagaggaagacaaaaatacacacccctctccagtagcttatttttacaaagccggcccagtgaattagaaaaacaaagcacttggatatgatttttggaaagcccaggtacacttattattcaaaatgcacttttactgagtttgaaaagtttcttttatatttaaaataagggttcaaatatgcatattcaatttttatagtagttatctatttgcaaagcatatattaactagtaattggctgttaattttatagacatggtagccagggaagtatatcaatgacctattaagtattttgacaagcaatttacatatctgatgacctcgtatctctttttcagcaagtcaaatgctatgtaattgttccattgtgtgttgtataaaatgaatcaacacggtaagaaaaaggttagagttattaaaataataaactgactaaaatactcatttgaatttattcagaatgttcataatgctttcaaaggacatagcagagcttttgtggagtatccgcacaacattatttattatctatggactaaatcaattttttgaagttgctttaaaatttaaaagcacctttgcttaatataaagccctttaattttaactgacagatcaattctgaaactttattttgaaaagaaaatggggaagaatctgtgtctttagaattaaaagaaatgaaaaaaataaacccgacattctaaaaaaatagaataagaaacctgatttttagtactaatgaaatagcgggtgacaaaatagttgtctttttgattttgatcacaaaaaataaactggtagtgacaggatatgatggagagatttgacatcctggcaaatcactgtcattgattcaattattctaattctgaataaaagctgtatacagtaaaa

SEQ ID NO: 746 - DNA, 2271 bp, Homo sapiens
gaaagctggtgtggagggagaagcgagtgtggtccggagaaagaaggcgtggagaagagggagggagcgagagcgagagaataaatatataaataaatacgagaacgaaatccactccgcagtctccgggctcggaaactttggccccgagcgccagagcgccagagcgcgagagcgcggcgctcgccactctgaggctggcggcctcgattccggccgcgttcccccggcccccctccgccgcggggcctggtctccgggttctgccaggcgcatcagcccgcacaacttctggccgaggccagccggcagaggcggacttggggttggagtgtttgtttgtttgaacttcctcgtcgtcgccaccttccctccccccaacctccaccccacctcacccccctccccagcttctggacgcgtttgactgcagccaggggtggggggtgggggtagggagtgtgtgtggaggggagggagaagaggttaaaaaaaagaagacgaagaagacggaaagaaagagatcgcagcaggggtgaagggagcggacgggaagcgatttttgccgactttggattcgtccccggcgtgcgcaagaatggcggcccttcccggcacggtaccgagaatgatgcggccggctccggggcagaactacccccgcacgggattccctttggaagtgtccaccccgcttggccaaggccgggtcaatcagctgggaggggtcttcatcaatgggcgacccctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccagacaggtggcgactccggatgtagagaaaaagattgaggagtacaagagggaaaacccaggcatgttcagctgggagatccgggacaggctgctgaaggatgggcactgtgaccgaagcactgtgccctcaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaagggaaccggctggacgagggctcggatgtggagtcggaacctgacctcccactgaagcgcaagcagcgacgcagtcggaccacattcacggccgagcagctggaggagctggagaaggcctttgagaggacccactacccagacatatacacccgcgaggagctggcgcagaggaccaagctgacagaggcgcgtgtgcaggtctggttcagtaaccgccgcgcccgttggcgtaagcaggcaggagccaaccagctggcggcgttcaaccaccttctgccaggaggcttcccacccaccggcatgcccacgctgcccccctaccagctgccggactccacctaccccaccaccaccatctcccaagatgggggcagcactgtgcaccggcctcagcccctgccaccgtccaccatgcaccagggcgggctggctgcagcggctgcagccgccgacaccagctctgcctacggagcccgccacagcttctccagctactctgacagcttcatgaatccggcggcgccctccaaccacatgaacccggtcagcaacggcctgtctcctcaggtgatgagcatcttgggcaaccccagtgcggtgcccccgcagccacaggctgacttctccatctccccgctgcatggcggcctggactcggccacctccatctcagccagctgcagccagcgggccgactccatcaagccaggagacagcctgcccacctcccaggcctactgcccacccacctacagcaccaccggctacagcgtggaccccgtggccggctatcagtacggccagtacggccagagtgagtgcctggtgccctgggcgtcccccgtccccattccttctcccacccccagggcctcctgcttgtttatggagagctacaaggtggtgtcagggtggggaatgtccatttcacagatggaaaaattgaagtccagccagatggaacagttcacctaaaatgacactgagttgggcaaaacccaggacatctcctggctaagcctctgcttccgtactatggctccaacagaaataaaatacacaacacaaatatcaaaaaaaaaaaa

SEQ ID NO: 747 - DNA, 4065 bp, Homo sapiens
gggaacaaacttcagaaggaggagagacaccgggcccagggcaccctcgcgggcggacccaagcagtgagggcctgcagccggccggccagggcagcggcaggcgcggcccggacctacgggaggaagccccgagccctcggcgggctgcgagcgactccccggcgatgcctcacaactccatcagatctggccatggagggctgaaccagctgggaggggcctttgtgaatggcagacctctgccggaagtggtccgccagcgcatcgtagacctggcccaccagggtgtaaggccctgcgacatctctcgccagctccgcgtcagccatggctgcgtcagcaagatccttggcaggtactacgagactggcagcatccggcctggagtgatagggggctccaagcccaaggtggccacccccaaggtggtggagaagattggggactacaaacgccagaaccctaccatgtttgcctgggagatccgagaccggctcctggctgagggcgtctgtgacaatgacactgtgcccagtgtcagctccattaatagaatcatccggaccaaagtgcagcaaccattcaacctccctatggacagctgcgtggccaccaagtccctgagtcccggacacacgctgatccccagctcagctgtaactcccccggagtcaccccagtcggattccctgggctccacctactccatcaatgggctcctgggcatcgctcagcctggcagcgacaagaggaaaatggatgacagtgatcaggatagctgccgactaagcattgactcacagagcagcagcagcggaccccgaaagcaccttcgcacggatgccttcagccagcaccacctcgagccgctcgagtgcccatttgagcggcagcactacccagaggcctatgcctcccccagccacaccaaaggcgagcagggcctctacccgctgcccttgctcaacagcaccctggacgacgggaaggccaccctgaccccttccaacacgccactggggcgcaacctctcgactcaccagacctaccccgtggtggcagatcctcactcacccttcgccataaagcaggaaacccccgaggtgtccagttctagctccaccccttcctctttatctagctccgcctttttggatctgcagcaagtcggctccggggtcccgcccttcaatgcctttccccatgctgcctccgtgtacgggcagttcacgggccaggccctcctctcagggcgagagatggtggggcccacgctgcccggatacccaccccacatccccaccagcggacagggcagctatgcctcctctgccatcgcaggcatggtggcaggaagtgaatactctggcaatgcctatggccacaccccctactcctcctacagcgaggcctggcgcttccccaactccagcttgctgagttccccatattattacagttccacatcaaggccgagtgcaccgcccaccactgccacggcctttgaccatctgtagttgccatggggacagtgggagcgactgagcaacaggaggactcagcctgggacaggccccagagagtcacacaaaggaatctttatttattacatgaaaaataaccacaagtccagcattgcggcacactccctgtgtggttaatttaatgaaccatgaaagacaggatgaccttggacaaggccaaactgtcctccaagactccttaatgaggggcaggagtcccagggaaagagaaccatgccatgctgaaaaagacaaaattgaagaagaaatgtagcccccagccggtacccaccaaaggagagaagaagcaatagccgaggaacttggggggatggcgaatggttcctgcccgggcccaaggggtgcacagggcacctccatggctccattattaacacaactctagcaattatggaccataagcacttccctccagcccacaagtcacagcctggtgccgaggctctcctcaccagccacccagggagtcacctccctcagcctcccgcctgccccacacggaggctctggctgtcctctttctccactccatttgcttggctctttctacacctccctcttgggcatgggctgagggctggagcgagtccctcagaaattccaccaggctgtcagctgacctcttttgcctgctgctgtgaaggtatagcaccaccccaggtcctcctgcagtgcggcatccccttggcagctgccgtcagccaggccagccccagggagcttaaaacagacattccacagggcctgggcccctgggaggtgaggtgtggtgtgcggcttcacccagggcagaacaaggcagaatcgcaggaaacccgcttccccttcctgacagctcctgccaagccaaatgtgcttcctgcagctcacgcccaccagctactgaagggacccaaggcaccccctgaagccagcgatagagggtccctctctgctccccagcagctcctgcccccaaggcctgactgtatatactgtaaatgaaactttgtttgggtcaagcttccttctttctaacccccagactttggcctctgagtgaaatgtctctctttgccctgtggggcttctctccttgatgcttctttctttttttaaagacaacctgccattaccacatgactcaataaaccattgctcttcatctcaggctttggggttggctggggaaggaggcatcccggggctgggctttctcccaagaacatcagagctgagtagccgacaaactcactttggggccgtgggctggaagggaccatctgatgccccagagctctggcttggccttctccctctgcctttaattcacgttgaacgctgggtacctcactcatcccaagttcttcaacactgagcaaatgcaaggatagcacagtactgagccaaccatagactccccacaaggagttgctgttgttattaacaggaagccagagaatcagcagggtgggttagtgagggatccgggaatagctgtgactggagcctgcataaacagctctgaagggagagagaagactgggctctcttgtgtgccaggcacagtatggaaggcttcatataagttaagctgaaattagccctgttttacatacagcttcattttacatatgaggaaactgaggctttgaaaaaaatgagatgtcttgtccaagatgaaaagtagtagattcaaccaagtcctcttactctaagcccaacgcttttacccaaaaccccagagtcctcatcagggatgccaaatggttctagacccagtggaggttctggagctgccactggggatttaatttcttttgatttgctaaagatttgacctgactgaatggagaggtagagtgtagtgtggccaggacaaggtgagggaggctgtagagacttagcactttaggccaaccacctccaggaaatctgggaaatgcaatgtgacagctcgggctctgcactccagggggctgtctggtgtccacatggaccttctccatgtgggacacagctggaacaagggggcaggggcctgcagctgggatgcccaggtgaatatgggcagctggacaaacaacactgggattgagtcagatagaaggggcccaaggactccagggctgggaggacagaggctgggagagagggctcttacctccttaggcctcccaaagagcggttagggatgctgccatggatggcatggcagggggaaccctcctggaagaaaatccatctcttctgaagggatctgagatgcggctggtttttcaatggcagaacttccctctgcagcgcgactccgaatccatgacatctgagagtcttcctgaccacaaacctctgggatcccgagggctccctacccaagaatcactttgagcacagcatcccaaggagcccatagagcgatcccttgcattcacagccacagcccctctggggacactctgtacccccggcagaccctttccaactcacaaccaataaaggggcttgggctgtgctttgactaaggtgaaaaaaaaaaa

SEQ ID NO: 748 - DNA, 3122 bp, Homo sapiens
ccctcccctgctctcgcaaggagaaagcgggcgacgagcgctcgcagcccgtggggctgatcccacctcccgcagggctccggtcgtgtcgctgtcggaccgcagaacgccgggacgcatttccgagctcgggcccgacccaacccgctgccattctagctacctagtggagccgcggagagactcttgaaccgtgaggctccttgatgagaaggtggagaggctgccgggctattctccgagcatcttccggccgagctctgctcctctccgtgcgcttgcggcttctccttgggctagcgcgtccgcagtccctccaagtccaggccgcagtcacccaggtggggagctagcctgaaagagacagcggaaggagtttcctggactgcgctgtcgctcaccgacccgcaccaatcaccatgcagcttgccctcggacccgccccttttagggcgtgtccccagtgagtgatagacggagccgccctgccctgctcagcccagcccacgttgctgcttagattgaaatgcagaactcaagcctctttcatcggggcacagacttccttttacttcttccttttgccctctcgcctcctcctcctgggaagaagcggaggcgccggcggtcggccgggatagcaacaggccgggccactgaggcggtgcggaaagtttctgtctgggagtgcggaactggggccgggttggtgtactgctcggagcaatggagccagccttcggggaggtgaaccagctgggaggagtgttcgtgaacgggaggccgctgcccaacgccatccggcttcgcatcgtggaactggcccaactgggcatccgaccgtgtgacatcagccgccagctacgggtctcgcacggctgcgtcagcaagatcctggcgcgatacaacgagacgggctcgatcttgccaggagccatcgggggcagcaagccccgggtcactacccccaccgtggtgaaacacatccggacctacaagcagagagaccccggcatcttcgcctgggagatccgggaccgcctgctggcggacggcgtgtgcgacaagtacaatgtgccctccgtgagctccatcagccgcattctgcgcaacaagatcggcaacttggcccagcagggtcattacgactcatacaagcagcaccagccgacgccgcagccagcgctgccctacaaccacatctactcgtaccccagccctatcacggcggcggccgccaaggtgcccacgccacccggggtgcctgccatccccggttcggtggccatgccgcgcacctggccctcctcgcactccgtcaccgacatcctgggcatccgctccatcaccgaccaagtgagcgacagctccccctaccacagccccaaggtggaggagtggagcagcctgggccgcaacaacttccccgccgccgccccgcacgcggtgaacgggttggagaagggagccctggagcaggaagccaagtacggtcaggcaccaaatggtctcccagctgtgggcagttttgtgtcagcatccagcatggctccttaccctaccccagcccaagtgtcgccttacatgacctacagtgctgctccttctggttatgttgctggacatgggtggcaacatgctgggggcacctcattgtctccccacaactgtgacattccggcatcgctggcgttcaagggaatgcaggcagccagagaaggtagtcattctgtcacggcttccgcgctctgatgggaaattccgtctccagcagcttcacccgggtctccctgtctcagcacctcctcccccaattcccaggtctcacatcccacccctcctgccctccaacccttctgccttgaaagctggctgtacggactcacatcctttgtgctaatgacacttacatatttcttgccataacttttctcttgcagaaaaactgacatgactttaggatttaaaaacaagagcaacaataagcattgaatgagacatttgtgttgcccacatactgtcttaacataacaaagaaacctacacccctcaaagggtttaaggaactttacaaactagtctttggtaaaaccacatgtgtatatttattctaaatcaacctgaacttttgaaatgtgcaattgttgagattttgcaaaatcaataaaggaaaatacttatagaaaaaattatgctacaccctctaatcaaatatggtaaccaagtaagctttaattcatcattaggaaacaaatcaataagtgacttgtttgagtgatcctttgtttaagacatgacctattttgttgaaaaatatatgtagaacccaagcaatatctgaatctagctctccctggtgttttgacttggttccaaatacaataatgtttatattttctattagtttgtaaatacggactctggatggtgcatttgtgtcttcattccataagatattcccctcccctcagccccaccccctctctatttttttctttcttttttgcaaaggtgactttctggcaacgtctttgtctctgtttggtggtgggctgctcgggctcctggacctggacttgcccccaaattttgtgtatgcagtgaaggcttcaacatctcatgaaggacactttatttctacagcagaggacacgaaaaacagataaaacaagccagtctcccattttgtacctaatcaaacaacacacatgctaagcatataaagacaagagggtggaaaatatctgaacaagaaggctctaaaggaagtcacttagaaacttaagtttaatgtgaaatgttttgcaaagatgcttaaaatgaactttgtgttaagaaaaccactgtgaaactaaattgtcctattattgttggcttacctgtgtgttcagcaatctcagccccaaataatgttgtaatttaaagaaaatggaaaattctgctctaatgaatgtaacaatggcttgctgtgaagtttacattgttgtacagaagcatgtttcgcatgtaggtaaactggtggtggtactagaaatacaatgttatttaattttaacaaattccctttattcatttctgaaattacaggacacagtttaactcataaaaaaaaaaaaaaaaaa

SEQ ID NO: 749 - DNA, 2732 bp, Homo sapiens
  modified_base (940)..(940): a, c, t, g, unknown or other
  modified_base (2650)..(2650): a, c, t, g, unknown or other
  modified_base (2656)..(2656): a, c, t, g, unknown or other
  modified_base (2690)..(2690): a, c, t, g, unknown or other
cgaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatatcttacagactctttcagcacctacgaaaaatttagaacagcaggtgaatcacagccagcagggacatacaaatgccaatgcagtgctgtttagccaagtgaaagtgactccagagacacacatgctacagcagcagcagcaggcccagcagcagcagcagcagcacccggttttacaccttcagccccagcagataatgcagctccagcagcagcagcagcagcagatctctcagcaaccttacccccagcagccgccgcatccattttcacagcagcagcagcagcaacagcagccaccaccatcgcctcagcagcatcagctttttggacatgatccagcagtggagattccagaagaaggcttcttattgggatgtgtgtttgcaattgcggattatccagagcagatgtctgataagcaactgctggccacctggaaaaggataatccaggcacatggcggnactgttgacccaccttcacgagtcgatgcacgcaccttctctgtgagagtcaagtcagcagcgcgtattgcacaggcaataagagaaagaaagagatgtgttactgcacactggttaaacacagtcttaaagaagaagaaaatggtaccgccgcaccgagcccttcacttcccagtggccttcccaccaggaggaaagccatgttcacagcatattatttctgtgactggatttgttgatagtgacagagatgacctaaaattaatggcttatttggcaggtgccaaatatacgggttatctatgccgcagcaacacagtcctcatctgtaaagaaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttagatgcttggagagttcccttaaaagtgtctgcagagttgttgatgagtataagactacctcccaaactgaaacagaatgaagtagctaatgtccagccttcttcccaaagagccagaattgaagacgtaccacctcccactaaaaagctaactccagaattgaccccttttgtgcttttcactggattcgagcctgtccaggttcaacagtatattaagaagctctacattcttggtggagaggttgcggagtctgcacagaagtgcacacacctcattgccagcaaagtgactcgcaccctgaagttcctggcggcgatttctgtcgtgaagcacatagtgacgccagagtggctggaagaatgcttcaggtgtcagaagttcattgatgagcagaactacattctccgagatgctgaggcggaagtacttttctctttcagcttggaagaatccttaaaacgggcacacgtttctccactctttaaggcaaaatatttttacatcacacctggaatctgcccaagtctttccactatgaaggcaatcgtagagtgtgcaggaggaaaggtgttatccaagcagccatctttccggaagctcatggagcacaagcagaactcgagtttgtcggaaataattttaatatcctgtgaaaatgaccttcatttatgccgagaatattttgccagaggcatagatgttcacaatgcagagttcgttctgactggagtgctcactcaaacgctggactatgaatcatataagtttaactgatggcgtctaggctgccgtgcatgtcgactcctgcggtgcggggctggctgtctggctggcgaggagctgctgcgcttccttcacgtgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttctaaaactctgttttcttttanattganatcttgcccacattttaaataaatgtacttttgnacttaaaaaaaaaaaaaaaaaaaaaaaaaaaaaaaaaaaaaa

SEQ ID NO: 750 - DNA, 6683 bp, Homo sapiens
cttccccaccagcccttatccccaccctcaccccgcaaccccttcacgccccctccccctccccctcctcatcctcccaccatcctctaaagaggcaaagggattttttttttcttttggtcttcttttttcccccttccctgtttatcctgaaaaggatttgaagacaagcttgaaggataaaaagccttggtgcttcccaggagccgagccgaggagcagaagaggaagagccgggggctgccgtagcctttggagatggacgagcagcccaggctgatgcattcccatgctggggtcgggatggccggacaccccggcctgtcccagcacttgcaggatggggccggagggaccgagggggagggcgggaggaagcaggacattggagacattttacagcaaattatgaccatcacagaccagagtttggatgaggcgcaggccagaaaacatgctttaaactgccacagaatgaagcctgccttgtttaatgtgttgtgtgaaatcaaagaaaaaacagttttgagtatccgaggagcccaggaggaggaacccacagacccccagctgatgcggctggacaacatgctgttagcggaaggcgtggcggggcctgagaagggcggagggtcggcggcagcggcggcagcggcggcggcttctggaggggcaggttcagacaactcagtggagcattcagattacagagccaaactctcacagatcagacaaatctaccatacggagctggagaaatacgagcaggcctgcaacgagttcaccacccacgtgatgaatctcctgcgagagcaaagccggaccaggcccatctccccaaaggagattgagcggatggtcagcatcatccaccgcaagttcagctccatccagatgcagctcaagcagagcacgtgcgaggcggtgatgatcctgcgttcccgatttctggatgcgcggcggaagagacggaatttcaacaagcaagcgacagaaatcctgaatgaatatttctattcccatctcagcaacccttaccccagtgaggaagccaaagaggagttagccaagaagtgtggcatcacagtctcccaggtatcaaactggtttggaaataagcgaatccggtacaagaagaacataggtaaatttcaagaggaagccaatatttatgctgccaaaacagctgtcactgctaccaatgtgtcagcccatggaagccaagctaactcgccctcaactcccaactcggctggttcttccagttcttttaacatgtcaaactctggagatttgttcatgagcgtgcagtcactcaatggggattcttaccaaggggcccaggttggagccaacgtgcaatcacaggtggatacccttcgccatgttatcagccagacaggaggatacagtgatggactcgcagccagtcagatgtacagtccgcagggcatcagtgctaatggaggttggcaggatgctactaccccttcatcagtgacctcccctacagaaggccctggcagtgttcactctgatacctccaactgatctcccagcaatcgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttacctcactcgaatccctcactccctatgttaacaggcaatccttctctgtttctcttattactctcactacctcttagcaggaatactccacattgccctattcattccaggcctccctgcttcctcttgctcttcctccctggggacagtactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctaccagttataaagatggcagctctatcacttgattaagtgggaggtggtcaaatattttggtgcctcattttcttcatctgtgagatgggaactgttatgcctggcttactaagagtcttgtgagagactgagaagttgattttgttcatatccaatctgtaaatgcgaagtcaggggaagtaatgtccctgaaataaacgggttcatgccatctagggacaataaatggttttcttgttgtaacttctggttaatatcagtaccttgatgtcatcaccgtgatgacaaagagaagagttattgttgatcttcttggttttggtctgtctcttttcttaggataaagaaaaacttccaaactagaaaaacaggccctggttcccttagtttgcacttgaacccaatatgttgccttgtacatacttggtccctgtcacattgactgcttgggaggcttccagggagaagtatgagaccctgaggggtgagaatgggcagctagcaagaacatggaaattctgcttggcactacagtcataaatagaaaacactgtgtgtgctcaggggagcaggggatgccactgaagaaactcaagggaatgtgtatttgaaggaaatgcaaaaactaagtatttagcaaaatgaaattatgccttgatgactaaaaggcactagaaaggttgtgtctactaacttcagccctaatcagaacagatgcctagaaggagcatttttgtgacaacttcatagtgattagaatcagtggagaactccatcttagtggcaggaatataatgaaactacccacgcaagaacatggttgaatcacatttgcttgacttagggcaaagtacgaaagagagacaaaagggttctcttggaaacaagaagagtgactccagatgtggcctgaataattgccatgttaagttaatgcaaaagatcagaacagggctacatttgcacaggcagtttctctccgggccgtagttttcactgatgatcacctttcacagcattttccccaaccagcatttcacttagtcttctctatacccagcacctcccccggcacccccggcaagcccactatcacttccgacttccaacgtggcatccgtgagatctgtccacattaggcgaagcaggagaacactgagagcagcaggatgggtttggaaagagcatgcctctggaaacacagcttcctgggaattcacatgaggccagtcctacagagagcaagatgcaccccaggatttcttcattttctaatagatgtgggagtgctccattttccccgacagcgaatttcccctgagaaacgatactagaccctgggtttgcccaccttgtaactcttccttatctcctccttttcatccctaatccatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatag

SEQ ID NO: 751 - DNA, 3231 bp, Homo sapiens
ctctctcacacacacccccgcttgggcctcctctctctctccggctccattttctccgccgccgggggccggggtctcctgtggggggcccagccggtatcccaggtctcccttcagtgccggggtgaacccccgggggagccgggagccgggggcagacgggcgggggttggggcggagggagcagcggccccagcgagtttggggggagaagtaaccaggcggggggaggggcggagcagggagggggcctcagggcccccccccagctatggacgaacggctactggggccgccccctccaggcgggggccgggggggcctgggattggtgagtggggagcctgggggccctggcgagcctcccggtggcggagaccccggtgggggtagcgggggggtcccgggaggccgagggaagcaagacatcggggacattctgcagcagataatgaccatcaccgaccagagcctggacgaggcccaggccaagaaacacgccctaaactgccaccgaatgaagcctgctctctttagcgtcctgtgtgaaatcaaggagaaaactggcctcagcattcggagctcccaggaggaggagccggtggacccacagctgatgcgcttggacaacatgcttctggcagagggtgtggctgggcccgagaaagggggcggctcagcagcagcagctgcagccgctgcagcctctggtggtggtgtgtcccctgacaactccatcgaacactcggactatcgcagcaaacttgcccagatccgtcacatataccactcggagctggagaagtatgagcaggcatgtaatgagttcacgacccatgtcatgaacctgctgagggagcagagccgcaccaggcccgtggcccccaaagagatggaacgcatggtgagcatcatccatcgaaagttcagcgccatccagatgcagctgaagcagagcacctgcgaggctgtgatgatcctgcgctcccgtttcctggatgccagacgaaagcgccgtaacttcagcaaacaggccactgaggtcctaaatgagtatttctactcccacctgagtaacccatatcctagtgaggaggccaaggaggagcttgccaagaagtgtggcatcaccgtgtctcaggtctccaactggtttggcaacaagaggattcgctataagaaaaacatcggaaagttccaagaggaggcaaacatctatgctgtcaagaccgccgtgtcagtcacccaggggggccacagccgcaccagctccccgacacccccttcctctgcaggctctggcggctctttcaatctctcaggatctggagacatgtttctggggatgcctgggctcaacggagattcctattctgcttcccaggtggaatcactccgacactcgatggggccagggggctatggggataacctcgggggaggccagatgtacagcccacgggaaatgagggcaaatggcagctggcaagaggctgtgaccccctcttcagtgacatccccaacggagggaccagggagtgttcactctgatacctccaactgatcttgcccctcagggtcacaggggtgggggctctcacaaggcgacttgaagaggacgcaggcttccagaggacaaaccccaatacaggagaagcacaagacagagaagggccaatggggtcatcccctccctaacgagactctctgtgctgggggtgctaattacatggcaggaagaatggggcctctaaggggagtgtggggtctgtctctcccttttttccatctttttcctctctcgctttctttcttacacagaaacatacacataccgagaaacctatttctcagacccctttttctcctctgtctttctctctccctctcccacacctcacacacacatactcccacttgcaactattctgtttctctcctgggctcccccactttcccttccccaccccacttgtatgctctggaatctgtggagacgccagccctgcccaatcagagatgccaaaaatggggacatgacttctggacagaggacatgggccacgcccccatgcatccccacccccgcccctccggacggcttacttacctcatacgcagctcatcttaaaccaatagaatcgctcggtggacgagagtgtctgactcagatatctacctcggagggagtttctgctactttagggaattattgactgggctttggggttgaacttttttttttttaaagaaagaaaaagaaaccctgggatccatctgttttttttgttgttgttgttgtttttgttgttgttggtggtggtggtggtggtggttcttaatttttaatttagtttggggaagtagcttgtttttttttttataaatatgttgatttcttgtctttttttttttttatttcttactttcccatattaggggtgatagccaaaggggttctggtaagagaaagggggacaaacagaactggtaaagaggcccccctggctccaggcctgtccatcaggaagtaaattttacagggcaccaagctttgccccctaaaatcccttaggtgttctttgttcatgcaggcaggtttctgccgcatttgatgtggaggcagtgaagggcttgccctgctggcctctcatcccccttcttcccacaacccttgggcagggctggactcagtaattttgaggaaattgaagatgccatcttcccctgtgagtgacatgtctttaattttttaaaaaactactatttgaaaattggagggggaagaatgggaagggagttattgccaaatatgttaaatatgggttggggtgcttgtatatgtatcttcctcaatttccccataaatgaggtatctttttgtcacaccaaaatcaaggggtagggagagggaggaggttgcaaaaagccagatgtgggggaaaagtaacatcaacactgtcccatcctcagccctgaactagctaccatctgatcccctcagacattctcaggattttacaagactgtcagagtggggaacccctcccattaaagatccgggcaggactggggacaggttggaagtgtgatgggtgggggggtgggaggcatgggccgggggcagttctctcctcacttgtaaacttgtgtagtttcacagaaaaaaaacaaaatgcagttttaaataaagaaatttcttttttccctgggaaaaaaaaaaaaaaaaaa

SEQ ID NO: 752 - DNA, 1894 bp, Homo sapiens
gtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccatggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactg

SEQ ID NO: 753 - DNA, 1727 bp, Homo sapiens
acaacaaagatggcggcggcgactgtgacggtgacgaagacggcggcggcggcgacggcatttaacaaggcggtgtggtttactccatgcagttgtcaggagacctctgtatggcttttcaattttagttgaaattctctctccatggccttttggagtcccttgctgtatctccgaagtaaatttcaattactctacatttcatcaatgttggagtggcaagaaaaaggaggaacagatttggggtgaaaagttttgttttctaggtctaacaaactgtaaatgttaaaaaagcaaagatgggtgaaaaaaaaccagagcctttggacttcgtgaaagattttcaggaatacctgactcagcagacccatcacgtgaacatgatttctggatcagttagtggggacaaagaagcagaggctcttcagggagctggaacagatggtgatcaaaatggacttgatcacccatctgttgaagtttccttggatgaaaactcaggaatgttagtagacgggtttgaaaggacctttgatgggaagcttaagtgtcggtactgcaactatgccagcaaaggaacagcccggcttattgaacacatcagaatccacacaggtgaaaaacctcatcgatgtcatctttgtccatttgcatctgcttatgagcgtcatctggaagcccatatgcgttctcatactggagaaaaaccatacaaatgtgaattatgttccttccgctgcagtgatcgaagtaacttgtcccatcatcgaaggcgcaagcataaaatggtaccaattaaaggtactaggtcttccttaagcagcaagaaaatgtggggggttttacagaagaaaacaagcaatctgggctatagcagaagagcactaatcaacttaagtccaccttccatggtggttcagaaaccagactaccttaacgattttacccacgaaatcccaaatatccagactgactcctatgaaagtatggcaaaaaccacaccaactggtggccttccaagggacccccaagaactcatggttgataaccctttgaatcagctctcgactctagcagggcagttgtccagtctgccacccgaaaaccaaaaccctgcatcccctgatgtagttccctgccctgatgaaaagcctttcatgattcagcagccctctacccaagcagtagtttctgccgtatcagcaagtattcctcagagctcctctcccacaagcccagaacctcggccatcccatagtcaaaggaactatagtccagtggcaggtccaagcagtgagccaagtgcccacacgagcactcccagcataggaaacagccagccaagcaccccagccccagccctgccggtccaggaccctcagcttctgcaccactgccagcactgtgatatgtactttgcagacaacatcctttacactattcatatgggatgtcatgggtatgaaaatccttttcagtgtaatatatgtggatgcaaatgtaaaaacaagtatgattttgcctgtcattttgcaagagggcaacataaccaacattgattgaaaatagtcatattttacttagttttgctgtttttgtggtttggttttttttgttttttgttttggtcatccctaataaagtgtctgctaattcaaaaaaaaaaaaaaaaaaaaaaaaaaaaaaaaaaaaaaaaaaaaaaaaaaaaaaaaaaaaaaaaaaaaaaa

SEQ ID NO: 754 - DNA, 4717 bp, Homo sapiens
attatgcaacccgcctccccgcccgcccggtggagcttccactcggctgcgggctggagcggcggcgggcaggcgtgcggaggacactcctgcgaccaggtactggctgtgatcgaacttctcaaccctcagagacttagatcttccacctcactccctcagccaagcctccaggccccctcgtgcatccgtggtggcctctctgccttctctgttctgttctccccatggcccagacatgagtggccccctagaaggggctgatgggggaggggaccccaggcctggggaatcattttgtcctgggggcgtcccatcccctgggcccccacagcaccggccttgcccaggccccagcctggccgatgacaccgatgccaacagcaatggttcaagtggcaatgagtccaacgggcatgagtctagaggcgcatctcagcggagctcacacagctcctcctcaggcaacggcaaggactcagccctgctggagaccactgagagcagcaagagcacaaactctcagagcccatccccacccagcagttccattgcctacagcctcctgagtgccagctcagagcaggacaacccgtccaccagtggctgcagcagtgaacagtcagcccgggcaaggactcagaaggaactcatgacagcacttcgagagctcaagcttcgactgccgccagagcgccggggcaagggccgctctgggaccctggccacgctgcagtacgcactggcctgtgtcaagcaggtgcaggccaaccaggaatactaccagcagtggagcctggaggagggcgagccttgctccatggacatgtccacctataccctggaggagctggagcacatcacgtctgagtacacacttcagaaccaggataccttctcagtggctgtctccttcctgacgggccgaatcgtctacatttcggagcaggcagccgtcctgctgcgttgcaagcgggacgtgttccggggtacccgcttctctgagctcctggctccccaggatgtgggagtcttctatggttccactgctccatctcgcctgcccacctggggcacaggggcctcagcaggttcaggcctcagggactttacccaggagaagtccgtcttctgccgtatcagaggaggtcctgaccgggatccagggcctcggtaccagccattccgcctaaccccgtatgtgaccaagatccgggtctcagatggggcccctgcacagccgtgctgcctgctgattgcagagcgcatccattcgggttacgaagctccccggataccccctgacaagaggattttcactacgcggcacacacccagctgcctcttccaggatgtggatgaaagggctgcccccctgctgggctacctgccccaggacctcctgggggccccagtgctcctgttcctgcatcctgaggaccgacccctcatgctggctatccacaagaagattctgcagttggcgggccagccctttgaccactcccctatccgcttctgtgcccgcaacggggagtatgtcaccatggacaccagctgggctggctttgtgcacccctggagccgcaaggtagccttcgtgttgggccgccacaaagtacgcacggcccccctgaatgaggacgtgttcactcccccggcccccagcccagctccctccctggacactgatatccaggagctgtcagagcagatccaccggctgctgctgcagcccgtccacagccccagccccacgggactctgtggagtcggcgccgtgacatccccaggccctctccacagccctgggtcctccagtgatagcaacgggggtgatgcagaggggcctgggcctcctgcgccagtgactttccagcagatctgtaaggatgtgcatctggtgaagcaccagggccagcagctttttattgagtctcgggcccggcctcagtcccggccccgcctccctgctacaggcacgttcaaggccaaggcccttccctgccaatccccagacccagagctggaggcgggttctgctcccgtccaggccccactagccttggtccctgaggaggccgagaggaaagaagcctccagctgctcctaccagcagatcaactgcctggacagcatcctcaggtacctggagagctgcaacctccccagcaccactaagcgtaaatgtgcctcctcctcctcctataccacctcctcagcctctgacgacgacaggcagaggacaggtccagtctctgtggggaccaagaaagatccgccgtcagcagcgctgtctggggagggggccaccccacggaaggagccagtggtgggaggcaccctgagcccgctcgccctggccaataaggcggagagtgtggtgtccgtcaccagtcagtgtagcttcagctccaccatcgtccatgtgggagacaagaagcccccggagtcggacatcatcatgatggaggacctgcctggcctagccccaggcccagcccccagcccagcccccagccccacagtagcccctgacccagccccagacgcctaccgtccagtggggctgaccaaggccgtgctgtccctgcacacacagaaggaagagcaagccttcctcagccgcttccgagacctgggcaggctgcgtggactcgacagctcttccacagctccctcagcccttggcgagcgaggctgccaccacggccccgcacccccaagccgccgacaccactgccgatccaaagccaagcgctcacgccaccaccagaaccctcgggctgaagcgccctgctatgtctcacacccctcacccgtgccaccctccaccccctggcccaccccaccagccactacccccttcccagcggttgtccagccctaccctctcccagtgttctctcctcgaggaggcccccagcctcttccccctgctcccacatctgtgcccccagctgctttccccgcccctttggtgaccccaatggtggccttggtgctccctaactatctgttcccaaccccatccagctatccttatggggcactccagacccctgctgaagggcctcccactcctgcctcgcactccccttctccatccttgcccgccctcgccccgagtcctcctcaccgcccggactctccactgttcaactcgagatgcagctctccactccagctcaatctgctgcagctggaggagctcccccgtgctgagggggctgctgttgcaggaggccctgggagcagtgccgggcccccacctcccagtgcggaggctgctgagccagaggccagactggcggaggtcactgagtcctccaatcaggacgcactttccggctccagtgacctgctcgaacttctgctgcaagaggactcgcgctccggcacaggctccgcagcctcgggctccttgggctctggcttgggctctgggtctggttcaggctcccatgaagggggcagcacctcagccagcatcactcgcagcagccagagcagccacacaagcaaatactttggcagcatcgactcttccgaggctgaggctggggctgctcggggcggggctgagcctggggaccaggtgattaagtacgtgctccaggatcccatttggctgctcatggccaatgctgaccagcgcgtcatgatgacctaccaggtgccctccagggacatgacctctgtgctgaagcaggatcgggagcggctccgagccatgcagaagcagcagcctcggttttctgaggaccagcggcgggaactgggtgctgtgcactcctgggtccggaagggccaactgcctcgggctcttgatgtgatggcctgtgtggactgtgggagcagcacccaagatcctggtcaccctgatgacccactcttctcagagctggatggactggggctggagcccatggaagagggtggaggcgagcagggcagcagcggtggcggcagtggtgagggagagggctgcgaggaggcccaaggcggggccaaggcttcaagctctcaggacttggctatggaggaggaggaagaaggcaggagctcatccagtccagccttacctacagcaggaaactgcaccagctagactccattctgggaccatctccaggagtccatgagaggctttcttctcctatgtcccaattctcagaactcagatgtggctagaccaaccagtgggaaactgccccagcttctcccaccatagggggccggacccccatcaccagcctaggatccaggggctgcctctggcctcttagggagcagagagcagaactccgcagcccagcccagaggagtgtcacctcccacctttggagaggaatccttccctcccctggacaaagttgctgacaagctgctgaagtggcctctccatattccagctgagcctgaatctgactcttgagggttggggctgcacttatttattgcggggagacagctctctctcccacctcctccccagatgggaggagagcctgaggcccaagcaggacccgggggttccagcccctagctgctctggagtgggggaggttggtggaccatggagtccctggtgctgcccctcaggtgggacccaggcgttctcagctgtaccctctgccgatggcatttgtgtttttgatatttgtgtctgttactacttttttaatacaaaaagataaaaacgcccaaaaaaaaa

SEQ ID NO: 755 - DNA, 1337 bp, Homo sapiens
gtggtcgagccgcgcgcagggtgcgctcgtttgaactgcggtgacaccgagggttggggactcgaacccccgcttcgcagctcaggagcctgaggtccgaaagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagtcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatga

SEQ ID NO: 756 - DNA, 6203 bp, Homo sapiens
ggaaaagctcctcggagatgagcgtgaccccctggctcgtggtggccgcctgttctcactaacgccatggcggggaccggagtgagaaaccggtgtctgtcactgactgcaaagtgagcgagaagcaggctgcgggccgtcccagcacgacgtggagccccgcggagacctcgagatgccccgcggggaagctcctggccccgggagacggggggctaaggacgaggccctgggcgaagaatcgggggagcggtggagccccgagttccatctgcagaggaaattggcggacagcagccacagtgaacagcaagatcgaaacagagtttctgaagaacttatcatggttgtccaagaaatgaaaaaatacttcccctcggagagacgcaataaaccaagcactctagatgccctcaactatgctctccgctgtgtccacagcgttcaagcaaacagtgagtttttccagattctcagtcagaatggagcacctcaggcagatgtgagcatgtacagtcttgaggagctggccactatcgcttcagaacacacttccaaaaacacagatacctttgtggcagtattttcatttctgtctggaaggttagtgcacatttctgaacaggctgctttgatcctgaatcgtaagaaagatgtcctggcgtcttctcactttgttgacctgcttgcacctcaagacatgagggtattctacgcgcacactgccagagctcagcttcctttctggaacaactggacccaaagagctgcacggtatgaatgtgctccggtgaaaccttttttctgcaggatccgtggaggtgaagacagaaagcaagagaagtgtcactccccattccggatcatcccctatctgattcatgtacatcaccctgcccagccagaattggaatcggaaccttgctgtctcactgtggttgaaaagattcactctggttatgaagctcctcggatcccagtgaataaaagaatcttcaccaccacacacaccccagggtgtgtttttcttgaagtagatgaaaaagcagtgcctttgctgggttacctacctcaggacctgattggaacatcgatcctaagctacctgcaccctgaagatcgttctctgatggttgccatacaccaaaaagttttgaagtatgcagggcatcctccctttgaacattctcccattcgattttgtactcaaaacggagactacatcatactggattccagttggtccagctttgtgaatccctggagccggaagatttctttcatcattggtcggcataaagttcgaacgagcccactaaatgaggatgtttttgctaccaaaattaaaaagatgaacgataatgacaaagacataacagaattacaagaacaaatttacaaacttctcttacagccagttcacgtgagcgtgtccagcggctacgggagcctggggagcagcgggtcgcaggagcagcttgtcagcatcgcctcctccagtgaggccagtgggcaccgtgtggaggagacgaaggcggagcagatgaccttgcagcaggtctatgccagtgtgaacaaaattaaaaatctgggtcagcagctctacattgagtcaatgaccaaatcatcattcaagccagtgacggggacacgcacagaaccgaatggtggtggtgaatgtaagacctttacttccttccaccaaacactgaaaaacaatagtgtgtacactgagccctgtgaggatttgaggaacgatgagcacagcccatcctatcaacagatcaactgtatcgacagtgtcatcagatacctgaagagctacaacattccagctttgaaaagaaagtgtatctcctgtacaaatacaacttcttcctcctcagaagaagacaaacagaaccacaaggcagatgatgtccaagccttacaagctggtttgcaaatcccagccatacctaaatcagaaatgccaacaaatggacggtccatagacacaggaggaggagctccacagatcctgtccacggcgatgctgagcttggggtcgggcataagccaatgcggttacagcagcaccattgtccatgtcccacccccagagacagccagggatgctaccctcttctgtgagccctggaccctgaacatgcagccagcccctttgacctcggaagaatttaaacacgtggggctcacagcggctgttctgtcagcgcacacccagaaggaagagcagaattatgttgataaattccgagaaaagatcctgtcatcaccctacagctcctatcttcagcaagaaagcaggagcaaagctaaatattcatattttcaaggagattctacttccaagcagacgcggtcggccggctgcaggaaagggaagcacaagcggaagaagctgccggagccgccagacagcagcagctcgaacaccggctctggtccccgcaggggagcgcatcagaacgcacagccctgctgcccctccgcggcctcctctccgcacacctcgagcccgaccttcccacctgccgccatggtgcccagccaggccccttacctcgtcccagcttttcccctcccagccgcgacctcacccggaagagaatacgcagcccccggaactgcaccggaaggcctgcatgggctgcccttgtccgagggcttgcagccttacccagctttcccttttccttacttggatacttttatgaccgttttcctgcctgacccccctgtctgtcctctgttgtcgccatcgtttttgccatgtccattcctgggggcgacagcctcttctgcgatatcaccctcaatgtcgtcagcaatgagtccaactctggacccacccccttcagtcaccagccaaaggagagaggaggaaaagtgggaggcacaaagcgaggggcacccgttcattacttcgagaagcagctcacccttgcagttaaacttacttcaggaagagatgcccagaccctctgaatctccagatcagatgagaaggaacacgtgcccacaaactgagtattgtgttacaggcaacaatggcagtgagagcagtcctgctactaccggtgcactgtccacggggtcacctcccagggagaatccatcccatcctactgccagcgctctgtccacaggatcgcctcccatgaagaatccatcccatcctactgccagcgctctgtccacaggatcgcctcccatgaagaatccatcccatcctactgccagcacactgtccatgggattgcctcccagcaggactccatcccatcctactgccactgttctgtccacggggtcacctcccagcgaatccccatccagaactggttcagcagcatcaggaagcagcgacagcagtatataccttactagtagtgtttattcttctaaaatctcccaaaatgggcagcaatctcaggacgtacagaaaaaagaaacatttcctaatgtcgccgaagagcccatctggagaatgatacggcagacacctgagcgcattctcatgacataccaggtacctgagagggttaaagaagttgtactaaaagaagacctggaaaagctagaaagtatgaggcagcagcagccccagttttctcatgggcaaaaggaggagctggctaaggtgtataattggattcaaagccagactgtcactcaagaaatcgacattcaagcctgtgtcacttgtgaaaatgaagattcagctgatggtgcggccacatcctgtggtcaggttctggtagaagacagctgttgagtgactgtgaggatgaaccttcataccctttccaagacgtgttacacagacagacctttttaagtcctggacttttaaatgaccatgaagttatcattgaatgttaagattttttcttcttgattttttaatacacgtaatctttttgaagcagacattgtatacagaatcttacttctctttgttcctgatatattaaaatggccagttaggctctttttgtagttgaattgtcttctaaagagattggatggcctctaaagaggtatgtgtatctttatttcagatgtcacccagagtaaattataattagaagtatagctagaatgagccccaaaccttagcctcatttattttgttctgttacataagtcattttccccttagagtgcttgaagaaatgccacctacaggttgtgtacttttcataatggtttccatgaatgtagtacgttcatacaggcttcattcaacctggcgttcccctccataattaagatgaaacattccggttttctcacaacacattagcacatactgtccattagcatatctgggataaccaggttttgggggttgagttttggccttcatccttgtagatccctttcctattgatttcccaccttccagtgaaattctgaaagtcttatcttaaaaatcgatccgcttaccatgggcctattcttgtaagtttcagttagcatttgcatgtgtaatattaaaatgaaagagcttcttacccagtgctgttgcccttttgagtatttttgtttttaaaataatgattgtaaaatgttttacaagtaatgtaaaagctagtatcattcttacatacttctgtgtttaaattttcattcttaccaaaacagttaactctttctttccaatcaatttatacaaaagaggtcgctccagccctaccacaggtctgactggcactgccttttgtttgcccttgaacagggcagtgttgtggggactgcaaaagagaaaacgtccaggcgagcccagttgtcctcgcccacagggtcctgcaggctccatcagtcaccgctttctatggcgtttgtagttgtgtcttttaagaagtgagtgtgattgtttacttgataaatcagctcactctctggtgctttttagagaagtccctgattccttcttaaacttggaatgatagatgaaattcacacccctgcagatcagaaaaaacaaatagaagaaaatgagggttacagtaacctgttgtctttatataacttgcaacaaactaatttatttttttttcctttttttgtttttggttttttatggttttttaaggaaaatacttttctcctttgaagttttacagctttttgtaaatgcgtcctgataatgattaggaaaatcgaccttttcatccatgatgaccatcctcatagctcagatctcctttcaaagtagtggctttctggatggtaattccatcttaaggtgtcagaactattttcaaatgctgcctttgacagttcttggaattttctgatattaagcagttccatgcaaatattcgtgttttataaatagctctcatagtctgctccatcttgatagttaagtgatttctgaagcgtttgtgtgtgtgttgatcaggttgtgtgatatttttgcttgatagagaatcaaatttgaaacaattaaccagccagtagattgtctgtcagtgaccttctgtagtaataaagtttttgccactgtaaataaaaacagtatccgtagctatcaggatcattgcgcactcatatatgctaagccttctgttctctaatagaagcctttcttttccattgtttctggatatttgtattatccaaatgtgcttatttctttgccttagcacacgttttatggagtacttgttatactaggtttgatttgaaactggtgcttgtcgcagaactgtcagagcatgaggagcgctcctcctgtgggtggacgcattcacgcactcccaggttgcacctgctgctggcggtgagcagggggttcagcagcttgaccgatgccccccgagggggctctccccagcttaaactttgttgtttaaatttgttaactttttatattaatgactattgaaagtggtaataaaaatttatattataggcttcaatgttttcatgaatgttacccaaaaagctgtgttttctttggtcagaggtcaaaatttatgaaaaacaaaatgctgtatgaatggaaatcattttgcaattgagtgacacttcattgtaattcacagtgtaaatttaatccaaactgaaattttgtttcaactgaatttgtaattaactctgaatttgtttttaatcattagtaatatttcagttgggtatctttttaagtaaaaacaacaaataaactctgtacatgtaaaacgtga

SEQ ID NO: 757 - DNA, 743 bp, Homo sapiens
gaggatcatagagctgtctggcgcagcgaggcctcccggcgccaccgagacgcgcagaggacggctagagcgttgctcgccgagagacttcctcttcgttaagtcggccttcccaacatggcgcagtctattaacatcacggagctgaatctgccgcagctagaaatgctcaagaaccagctggaccaggaagtggagttcttgtccacgtccattgctcagctcaaagtggtacagaccaagtatgtggaagccaaggactgtctgaacgtgctgaacaagagcaacgaggggaaagaattactcgtcccactgacgagttctatgtatgtccctgggaagctgcatgatgtggaacacgtgctcatcgatgtgggaactgggtactatgtagagaagacagctgaggatgccaaggacttcttcaagaggaagatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggcagaaaaaaaaaaaaaaaaaaaaaaaaaaaaaaaaaaaaaaaaaaaaaaaaaaaaaaaaaa

SEQ ID NO: 758 - DNA, 13037 bp, Homo sapiens
agtccacagctgtcactaatcggggtaagccttgttgtatttgtgcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctcctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggtatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaatggtatgcaaaattttgtctatatatatttgtgtgaggaggaaattcataactttcctcagattttcaaaagtatttttaatgcaaaaaatgtagaaagagtttaaaaccactaaaatagattgatgttcttcaaactaggcaaaacaactcatatgttaagaccattttccagattggaaacacaaatctcttaggaagttaataagtagattcatatcattatgcaaatagtattgtgggttttgtaggtttttaaaataaccttttttggggagagaattgtcctctaatgaggtattgcgagtggacataagaaatcagaagattatggcctaactgtactccttaccaactgtggcatgctgaaagttagtcactcttactgattctcaattctctcacctttgaaagtagtaaaatatctttcctgccaattgctcctttgggtcagagcttattaacatcttttcaaatcaaaggaaagaagaaagggagaggaggaggagggaggtatcaattcacatacctttctcctctttatcctccactatcatgaattcatattatgtttcagccatgcaaatctttttaccatgaaatttcttccagaattttccccctttgacacaaattccatgcatgtttcaaccttcgagactcagccaaatgtcatttctgtaaaatcttccctgagtcttccaagcagtaatttgccttctcctagagtttacctgccattttgtgcacatttgagttacagtagcatgttattttacaattgtgactctcctgggagtctgggagccatataaagtggtcaatagtgtttgctgactgagagttgaatgacattttctctctgtcttggtattactgtagatttcgatcattctttggttacatttctgcatatttctgtacccatgactttatcactttcttctcccatgctttatctccatcaattatcttcattacttttaaattttccacctttgcttcctactttgtgagatctctccctttactgactataacatagaagaatagaagtgtattttatgtgtcttaaggacaatactttagattccttgttctaagtttttaaactgaatgaatggaatattatttctctccctaagcaaaattccacaaaacaattatttcttatgtttatgtagccttaaattgttttgtactgtaaacctcagcataaaaactttcttcatttctaatttcattcaacaaatattgattgaatacctggtattagcacaagaaaaatgtgctaataagccttatgagaatttggagctgaagaaagacatataactcaggaaagttacagtccagtagtaggtataaattacagtgcctgataaataggcattttaatatttgtacactcaacgtatactaggtaggtgcaaaacatttacatataattttactgatacccatgcagcacaaaggtactaactttaaatattaaataacacctttatgtgtcagtaattcatttgcattaaatcttattgaaaaggctttcaatatattttccccacaaatgtcatcccaagaaaaaagtatttttaacatctcccaaatataatagttacaggaaatctacctctgtgagagtgacacctctcagaatgaactgtgtgacacaagaaaatgaatgtaggtctatccaaaaaaaaccccaagaaacaaaaacaatattattagccctttatgcttaagtgatggactcagggaacagttgatgttgtgatcattttattatctgattcttgttactttgaattaaaccaatattttgatgatataaatcatttccaccagcatatatttaatttccataataactttaaaattttctaatttcactcaactatgagggaatagaatgtggtggccacaggtttggcttttgttaaaatgtttgatatcttcgatgttgatctctgtctgcaatgtagatgtctaaacactaggatttaatatttaaggctaagctttaaaaataaagtacctttttaaaaagaatatggcttcaccaaatggaaaatacctaatttctaaatctttttctctacaaagtcctatctactaatgtctccattactatttagtcatcataaccattatcttcattttacatgtcgtgttctttctggtagctctaaaatgacactaaatcataagaagacaggttacatatcaggaaatacttgaaggttactgaaatagattcttgagttaatgaaaatattttctgtaaaaaggtttgaaaagccatttgagtctaaagcattatacctccattatcagtagttatgtgacaattgtgtgtgtgtttaatgtttaaagatgtggcactttttaataaggcaatgctatgctattttttcccatttaacattaagataatttattgctatacagatgatatggaaatatgatgaacaatattttttttgccaaaactatgccttgtaagtagccatggaatgtcaacctgtaacttaaattatccacagatagtcatgtgtttgatgatgggcactgtggagataactgacataggactgtgccccccttctctgccacttactagctggatgagattaagcaagtcatttaactgctctgattaaacctgcctttcccaagtgctttgtaatgaatagaaatggaaaccaaaaaaaacgtatacaggccttcagaaatagtaattgctactattttgttttcattaagccatagttctggctataattttatcaaactcaccagctatattctacagtgaaagcaggattctagaaagtctcactgttttatttatgtcaccatgtgctatgatatatttggttgaattcatttgaaattagggctggaagtattcaagtaatttcttctgctgaaaaaatacagtgttttgagtttagggcctgttttatcaaagttctaaagagcctatcactcttccattgtagacattttaaaataatgacactgattttaacatttttaagtgtctttttagaacagagagcctgactagaacacagcccctccaaaaacccatgctcaaattatttttactatggcagcaattccacaaaagggaacaatgggtttagaaattacaatgaagtcatcaacccaaaaaacatccctatccctaagaaggttatgatataaaatgcccacaagaaatctatgtctgctttaatctgtcttttattgctttggaaggatggctattacatttttagtttttgctgtgaatacctgagcagtttctctcatccatacttatccttcacacatcagaagtcaggatagaatatgaatcattttaaaaacttttacaactccagagccatgtgcataagaagcattcaaaacttgccaaaacatacattttttttcaaatttaaagatactctatttttgtattcaatagctcaacaactgtggtccccactgataaagtgaagtggacaaggagacaagtaatggcataagtttgtttttcccaaagtatgcctgttcaatagccattggatgtgggaaatttctacatctcttaaaattttacagaaaatacatagccagatagtctagcaaaagttcaccaagtcctaaattgcttatccttacttcactaagtcatgaaatcattttaatgaaaagaacatcacctaggttttgtggtttctttttttcttattcatggctgagtgaaaacaacaatctctgtttctccctagcatctgtggactatttaatgtaccattattccacactctatggtccttactaaatacaaaattgaacaaaaagcagtaaaacaactgactcttcacccatattataaaatataatccaagccagattagtcaacatccataagatgaatccaagctgaactgggcctagattattgagttcaggttggatcacatccctatttattaataaacttaggaaagaaggccttacagaccatcagttagctggagctaatagaacctacacttctaaagttcggcctagaatcaatgtggccttaaaagctgaaaagaagcaggaaagaacagttttcttcaataatttgtccaccctgtcactggagaaaatttaagaatttgggggtgttggtagtaagttaaacacagcagctgttcatggcagaaattattcaatacataccttctctgaatatcctataaccaaagcaaagaaaaacaccaaggggtttgttctcctccttggagttgacctcattccaaggcagagctcaggtcacaggcacaggggctgcgcccaagcttgtccgcagccttatgcagctgtggagtctggaagactgttgcaggactgctggcctagtcccagaatgtcagcctcattttcgatttactggctcttgttgctgtatgtcatgctgaccttattgttaaacacaggtttgtttgctttttttccactcatggagacatgggagaggcattatttttaagctggttgaaagctttaaccgataaagcatttttagagaaatgtgaatcaggcagctaagaaagcatactctgtccattacggtaaagaaaatgcacagattattaactctgcagtgtggcattagtgtcctggtcaatattcggatagatatgaataaaatatttaaatggtattgtaaatagttttcaggacatatgctatagcttatttttattatcttttgaaattgctcttaatacatcaaatcctgatgtattcaatttatcagatataaattattctaaatgaagcccagttaaatgtttttgtcttgtcagttatatgttaagtttctgatctctttgtctatgacgtttactaatctgcatttttactgttatgaattattttagacagcagtggtttcaagctttttgccactaaaaataccttttattttctcctcccccagaaaagtctataccttgaagtatctatccaccaaactgtacttctattaagaaatagttattgtgttttcttaatgttttgttattcaaagacatatcaatgaaagctgctgagcagcatgaataacaattatatccacacagatttgatatattttgtgcagccttaacttgatagtataaaatgtcattgctttttaaataatagttagtcaatggacttctatcatagctttcctaaactaggttaagatccagagctttggggtcataatatattacatacaattaagttatctttttctaagggctttaaaattcatgagaataaccaaaaaaggtatgtggagagttaatacaaacataccatattcttgttgaaacagagatgtggctctgcttgttctccataaggtagaaatactttccagaatttgcctaaactagtaagccctgaatttgctatgattagggataggaagagattttcacatggcagactttagaattcttcactttagccagtaaagtatctccttttgatcttagtattctgtgtattttaacttttctgagttgtgcatgtttataagaaaaatcagcacaaagggtttaagttaaagcctttttactgaaatttgaaagaaacagaagaaaatatcaaagttctttgtattttgagaggattaaatatgatttacaaaagttacatggagggctctctaaaacattaaattaattattttttgttgaaaagtcttactttaggcatcattttattcctcagcaactagctgtgaagcctttactgtgctgtatgccagtcactctgctagattgtggagattaccagtgttcccgtcttctccgagcttagagttggatggggaataaagacaggtaaacagatagctacaatattgtactgtgaatgcttatgctggaggaagtacagggaactattggagcacctaagaggagcacctaccttgaatttaggggttagcagaggcatcctgaaaaaagtcaaagctaagccacaatctataagcagtttaggaattagcagaacgtgcgtggtgaggagatgccaaaggcaagaagagaagagtattccaaacaggagggattccaaagagagaagagtatcccaaacaacatttgcacaaacctgatggggagagagaatgtggggtggggatggatgatgagactgaagaagaaagccaggtctagataatcagtggccttgtacaccatgttaaagagtgtagacttgattctgttgtaaacaggaaagcagcacaattcatatgaatattttagaagactcccactggaatatggagaataaagttggagatgactaatcctggaagcagggagaacatttttgaggaagttgcactattttggtgaaaatgatgatcataaacatgaagaattgtaggtgatcatgacctcctctctaattttccagaagggttttggaagatataacataggaacattgacaggactgacgaaaggagatgaaatacaccatataaattgtcaaacacaaggccagatgtctaattattttgcttatgtgttgaaattacaaatttttcatcaggaaaccaaaaactacaaaacttagttttcccaagtcccagaattctatctgtccaaacaatctgtaccactccacctatatccctacctttgcatgtctgtccaacctcaaagtccaggtctatacacacgggtaagactagagcagttcaagtttcagaaaatgagaaagaggaactgagttgtgctgaacccatacaaaataaacacattctttgtatagattcttggaacctcgagaggaattcacctaactcataggtatttgatggtatgaatccatggctgggctcggcttttaaaaagccttatctgggattccttctatggaaccaagttccatcaaagcccatttaaaagcctacattaaaaacaaaattcttgctgcattgtatacaaataatgatgtcatgatcaaataatcagatgccattatcaagtggaattacaaaatggtatacccactccaaaaaaaaaaaaaaagctaaattctcagtagaacattgtgacttcatgagccctccacagccttggagctgaggagggagcactggtgagcagtaggttgaagagaaaacttggcgcttaataatctatccatgttttttcatctaaaagagccttctttttggattaccttattcaatttccatcaaggaaattgttagttccactaaccagacagcagctgggaaggcagaagcttactgtatgtacatggtagctgtgggaaggaggtttctttctccaggtcctcactggccatacaccagtcccttgttagttatgcctggtcatagacccccgttgctatcatctcatatttaagtctttggcttgtgaatttatctattctttcagcttcagcactgcagagtgctgggactttgctaacttccatttcttgctggcttagcacattcctcataggcccagctcttttctcatctggccctgctgtggagtcaccttgccccttcaggagagccatggcttaccactgcctgctaagcctccactcagctgccaccacactaaatccaagcttctctaagatgttgcagactttacaggcaagcataaaaggcttgatcttcctggacttccctttacttgtctgaatctcacctccttcaactttcagtctcagaatgtaggcatttgtcctctttgccctacatcttccttcttctgaatcatgaaagcctctcacttcctcttgctatgtgctggaggcttctgtcaggttttagaatgagttctcatctagtcctagtagcttttgatgcttaagtccaccttttaaggatacctttgagatttagaccatgtttttcgcttgagaaagccctaatctccagacttgcctttctgtggatttcaaagaccaactgaggaagtcaaaagctgaatgttgactttctttgaacatttccgctataacaattccaattctcctcagagcaatatgcctgcctccaactgaccaggagaaaggtccagtgccaaagagaaaaacacaaagattaattatttcagttgagcacatactttcaaagtggtttgggtattcatatgaggttttctgtcaagagggtgagactcttcatctatccatgtgtgcctgacagttctcctggcactggctggtaacagatgcaaaactgtaaaaattaagtgatcatgtattttaacgatatcatcacatacttattttctatgtaatgttttaaatttcccctaacatactttgactgttttgcacatggtagatattcacatttttttgtgttgaagttgatgcaatcttcaaagttatctaccccgttgcttattagtaaaactagtgttaatacttggcaagagatgcagggaatctttctcatgactcacgccctatttagttattaatgctactaccctattttgagtaagtagtaggtccctaagtacattgtccagagttatacttttaaagatatttagccccatatacttcttgaatctaaagtcatacaccttgctcctcatttctgagtgggaaagacatttgagagtatgttgacaattgttctgaaggtttttgccaagaaggtgaaactgtcctttcatctgtgtatgcctggggctgggtccctggcagtgatggggtgacaatgcaaagctgtaaaaactaggtgctagtgggcacctaatatcatcatcatatacttattttcaagctaatatgcaaaatcccatctctgtttttaaactaagtgtagatttcagagaaaatattttgtggttcacataagaaaacagtctactcagcttgacaagtgttttatgttaaattggctggtggtttgaaatgaatcatcttcacataatgttttctttaaaaatattgtgaatttaactctaattcttgttattctgtgtgataataaagaataaactaatttcta

SEQ ID NO: 759 - DNA, 5206 bp, Homo sapiens
cccgccgcggaggccgagcgagcccccagcccagcctggcgactggggaccccggcacatgaggtggacgcccccggggaagacttgggtgcacagccaggcgagaaggtcttgagtcagacagagcaccagccttggggaccctggaccactatcatggagactgagagcgagcagaactccaattccaccaatgggagttctagctcagggggcagctctcggccccagatagctcaaatgtcactttatgaacgacaagcagtgcaggctctgcaagcactgcagcggcagcccaatgcagctcagtatttccaccagttcatgctccagcagcagctcagtaatgcccagctgcatagcctggctgccgtccagcaggccacaattgctgccagtcggcaggccagctccccaaacaccagcactacacagcagcagactaccaccacccaggcctcgatcaatctggccaccacatcggccgcccagctcatcagccgatcccagagtgtgagctctcccagtgctaccaccttgacccaatctgtgctactggggaacaccacctccccacccctcaaccagtctcaggcccagatgtatctacggccacagctgggaaacctattgcaggtaaaccgaaccctgggtcggaatgtgcctctagcctcccaactcatcctgatgcctaatggggcggtggctgcagtccagcaggaggtgccatctgctcagtctcctggagttcatgcagatgcagatcaggttcagaacttggcagtaaggaatcaacaggcctcagctcaaggacctcagatgcaaggctccactcagaaggccattcctccaggagcctcccctgtctctagcctctcccaggcctctagccaggccctagcggtggcacaggcttcctctggggccacaaaccagtccctcaaccttagtcaagctggtggaggcagtgggaatagcatcccagggtccatgggtccaggtggaggtgggcaggcacatggtggtttgggtcagttgccttcctcaggaatgggtggtgggagctgtcccagaaagggtacaggagtggtgcagcccttgcctgcagcccaaacagtgactgtgagccagggcagccagacagaggcagaaagtgcagcagccaagaaggcagaagcagatgggagtggccagcagaatgtgggcatgaacctgacacggacagccacacctgcgcccagccagacacttattagctcagccacctacacacagatccagccccattcactgattcagcaacagcaacagatccacctccagcagaaacaggtggtgatccagcagcagattgccatccaccaccagcagcagttccagcaccggcagtcccagctccttcacacagctacacacctccagttggcgcagcagcagcagcagcaacaacagcaacagcagcaacagcagcagccgcaagccaccaccctcactgcccctcagccaccacaggtcccacctactcagcaggtcccaccttcccagtcccagcagcaagcccaaaccctggtcgttcagcccatgcttcagtcttcacccttgtctcttccacctgatgcagcccctaagccaccaattcccatccaatccaaaccacctgtagcacctatcaagccgcctcagttaggggccgctaagatgtcagctgcccagcaaccaccaccccatatccctgtgcaagttgtaggcactcgacagccaggtacagcccaggcacaggctttggggttggcacagctggcagctgctgtacctacttcccgggggatgccaggtacagtgcagtctggtcaggcccatttggcctcctcgccaccttcatcccaggctcctggtgcactgcaggagtgccctcccacattggcccctgggatgacccttgctcctgtgcaggggacagcacatgtggtaaagggtggggctaccacctcctcacctgttgtagcccaggtccctgctgccttctatatgcagtctgtgcacttgccgggtaaaccccagacattggctgtcaaacgcaaggctgactctgaggaggagagagatgatgtctccacattgggttcaatgcttcctgccaaggcatctccagtagcagaaagcccaaaagtcatggacgagaagagcagtcttggagaaaaagctgaatcagtggctaatgtgaatgctaatactccaagcagtgaactagtagccttgacccccgccccttcagtaccgcctcctacactagccatggtgtctagacaaatgggtgactcaaaacccccacaggccatcgtgaagccccagattctcacccacatcattgaaggctttgttatccaggaaggagcagaacctttcccggtgggttgttctcagttactgaaggagtctgagaagccactacagactggccttccgacagggctgactgagaatcagtcaggtggccctttgggagtggacagcccatctgctgagttagataagaaggcgaatctcctgaagtgcgagtactgtgggaagtacgcccccgcagagcagtttcgtggctctaagaggttctgctccatgacttgcgctaagaggtacaatgtgagctgtagccatcagttccggctgaagaggaaaaaaatgaaagagtttcaagaagccaactatgctcgcgttcgcaggcgtggaccccgccgcagctcctctgacattgcccgtgccaagattcagggcaagtgccaccggggtcaagaagactctagccggggttcagataattccagttatgatgaagcactctctccaacatctcctgggcctttatcagtaagagctgggcatggagaacgtgacctggggaatcccaatacagctccacctacaccggaattacatggcatcaaccctgtgttcctgtccagtaatcccagccgttggagtgtagaggaggtgtacgagtttattgcttctctccaaggctgccaagagattgcagaggaatttcgctcacaggagattgatggacaggcccttttattacttaaagaagaacatcttatgagtgccatgaacatcaagctgggccctgccctcaagatctgcgccaagataaatgtcctcaaggagacctaaggtggccctcttgcacaaaccagcctaaggcagacactctccactgtccaggttataacctggtaccagcagactttgcagggaagaaagagttgttccaatcatgtaaccttctgtaggggattactgagacagggaagagaagtgcaagaattggttgctggtgctacatggcggcagctttgacattttctctgggttctactttattttttaaaatctttacagttctcaccatttcacgtaccttaatccaatctttataaaagaggcagtctagagaactaggactgctcagccttatcctggagtggagcatttagcccaggtcttaattctccaagaggaggaatacatagtatggtaaggcaaggaactgggtggaatgtcaggttgcctgcccaatgggagaggtagggtttttctagcttgtgtgacagaagtagcaaaatctggtcctcccccctcccagtgtagctgtggctcagagttttttctttttgttgtcacttactcccttgtgattgaattttttctcctgcatccatggcaggatccccagccagtatagagacttggttggcatcttctgctgcagggactaaaagtatttgactggggcacatgtggctgttgtcattctttctgcatcccactgttcccctccaatttatgttattttctaccctgtttttcagttccatctctgctctgtcctatagctttataaaaccagagtgtgtggggctgaggtcaggagtataagtacctgccttaggcactattccttatataacaaaaatattaaatatttttttcctcagtaaaaggatgaaaattggtttcagttgtcttactctattccagtctttgcccactttcacacaaatgacaaggccaatatgttttgtttgttttttaatcattaagagtttttgtacaaaaggtgatggttttttttcttcattttaaaacaccagggtgtgggggagggatgcaaacaaataacaaaaaagatgcttttgtaacattattttccctgtttagaaagaaaaaaatcactccaatagtattgaaaagtccaaagatgaaatagtttcattttcttttcctaaggcttataaaaggccccctgcctgttgattccatccctcttttgtgtccagtggagccatgttactcttcagtggcccaggggttcactattaaagaaagatcagtccaggtttctgggcacatggcctaaacaggaagatggaagcatcagaggattaaaaacctttccccacagaaatgtgggcaagaagacacttccctgagccagcagaagggacaggtgcagcagcattccacacccagcgcagaggacagcagagccctcgatgtcccacttctgcttccgttccctttctagaagattgaaaaaaaggtcaaaaccacatgcctgtggagaaagtgcgacatgtttagaaatactggtagggaaccaggagtaagaaaagctttaccagcttttactacaaatggatgaaagacatcaggatcccaccaccgcaaggtaaagtgacttcccttttctggaacccctgtggcacaggagtaccaattttcctttccaacgaactggatttctggataggcattttggctgtatgtggacagataagaccacagtccttagcccaatcccagctatacagtcaccccaatttccacaaatgatgtgatggtaccgtataatcctgtaattgggaaatttcacatttttcctgtcctaatctcagaggtgggagaagcaagtctagaacatctccaggctcagactaaacgagagtacttggactgcaaccaagtaatcactgcaaagtagttccaagcagcaagaaataccagattctcatggaggctactatagggtacagaataacaacatgaaagcaatcaaccctgtataaataatgtttcttggcattttttttttaattaaagaaatccagtgtctcaaaaaaaaaaaaaaaaaaaaaaaaaaaaaaaa

SEQ ID NO: 760 - DNA, 6947 bp, Homo sapiens
gggctgaaagacacacagaagtcttcatggatatagttgatacatttaatcatttaattcctactgaacacttagatgatgccctatttctaggatccaacctggagaatgaagtctgtgaggattttagtgcaagtcaaaatgtcttagaggactcgctgaagaacatgctcagcgataaggatcctatgctaggatctgcaagtaaccagttctgtttgcctgttttggatagcaatgatcccaatttccagatgccttgttcaacagttgttggtcttgacgatattatggatgaaggagttgttaaagaaagtggcaatgataccattgatgaagaagaactgattttacctaacaggaacttaagggacaaggtagaagaaaattcagtgagatctccaagaaaatcacctcgtttaatggcacaagaacaagtaagaagtttgcgacagagcactattgccaagcgttcaaatgcagcaccattaagtaacacaaaaaaagcatctgggaagactgtatctactgctaaagcaggagtgaaacaaccagaaaggagtcaggttaaagaagaagtatgtatgtcactgaaacctgagtaccataaggagaatagaaggtgcagccgaaatagcggacaaattgaagtggtacctgaagtatcagtgtcttcaagtcattcttcagtgtcatcttgtcttgaaatgaaggatgaagatggattagattctaagcataagtgtaataatccgggagaaatagatgtgccatctcatgaattaaattgttcacttctttcagagacttgtgttactattggagaaaagaaaaatgaagctttgatggaatgtaaagccaagcctgttggtagtccattgtttaagttttcagataaagaagaacatgaacaaaatgattccatttcaggtaaaacgggtgagactgttgttgaagaaatgatagcaacaagaaaagttgaacaagattcaaaggagacagtaaaattatcccatgaagatgaccatattcttgaggacgctggatcttctgatatttctagtgatgctgcttgtacaaatccaaataagacagaaaacagccttgtaggtttgcctagttgtgtagatgaagtgactgaatgtaatttggaattgaaggataccatgggtattgctgataaaactgagaacacccttgaaagaaataaaattgaaccgttgggttattgtgaagatgcggagtctaataggcagttggagagcactgagtttaataaatcaaacttagaggtggttgatactagtacttttggaccggaaagtaatatcttggaaaatgctatttgtgatgtgcctgaccaaaattcaaaacagttgaatgctatagaaagtactaaaatagagtcccatgaaacagcaaaccttcaggatgacagaaacagccagtcaagtagcgtttcttacttagagtcaaaaagtgtaaaatccaaacatacaaaacctgtaattcattctaagcaaaacatgaccacagatgctccgaagaaaattgttgcagcaaagtatgaagtaatacatagcaaaactaaagttaatgtcaaaagtgtgaaacgaaatactgatgtaccagaatctcagcaaaattttcataggccagtcaaagtcagaaaaaaacaaattgataaggagccaaagattcagagttgcaattctggggttaaatctgtgaaaaaccaagctcattctgtactgaaaaaaacattacaggatcaaactttagtacaaattttcaagcccttaactcattctttgagtgataagtcacacgctcatcctggttgcttgaaagaacctcatcatcctgcacaaactggacatgtatcacattctagccagaaacagtgtcataagcctcagcaacaggccccagcaatgaaaaccaatagtcacgtgaaggaagagcttgaacacccaggcgttgagcattttaaggaagaggataaactgaaactgaaaaaacctgagaagaacctacaaccccgccaaagaagaagcagcaaaagtttttctttagatgagccaccattgttcattccagataacatagctaccataagaagagaaggctctgatcatagctcctcatttgaaagcaaatatatgtggactcccagcaagcagtgtgggttttgcaaaaaaccacatggcaacaggtttatggttggctgtgggagatgtgatgactggtttcatggtgattgtgttgggttaagtctttctcaagcacagcagatgggcgaggaagacaaagaatatgtctgtgtaaaatgttgtgctgaagaagacaaaaagactgaaatactagatccagatactttggaaaaccaagctacagttgaattccatagtggagataaaacaatggagtgtgaaaagcttggattatcaaaacacacaacaaatgatagaaccaaatatatagatgatacagtgaagcacaaggtcaaaattttaaaacgggagtctggtgaaggcagaaattcatcagactgtagagataatgaaattaaaaaatggcagctagctcctcttcgtaagatgggacaaccagttttacctcggagatcctcagaagaaaaaagtgaaaaaataccgaaagagtctacaactgttacttgcacaggagaaaaagcttcaaaaccaggtactcatgagaagcaagagatgaaaaagaagaaagttgaaaaaggagtgcttaatgtacatcctgctgcttctgcttccaagccttctgcagatcagatcaggcaaagtgtcagacattctctcaaagacattcttatgaagagacttacagactcaaatttgaaggtaccagaggaaaaggcagcaaaagttgccacaaaaattgagaaagagcttttctctttttttcgggacacagatgctaaatataagaacaaatatagaagtttgatgtttaatttgaaagatcctaaaaacaatatattatttaaaaaagtactgaaaggagaagtaactcctgatcatcttatcagaatgagtccagaagaactagcttctaaagagttagctgcttggagacgaagagaaaacagacataccatagaaatgattgagaaagagcagagagaagtggaacgacggccaatcaccaaaataactcataaaggtgaaatagaaattgagagtgatgccccaatgaaagaacaggaagcagccatggagattcaggaaccagccgccaataagtcattggagaagccagaaggatctgaaaaacaaaaagaggaggttgactctatgtctaaagataccactagtcaacacagacagcatctttttgatctcaactgcaaaatctgcataggtcgaatggcaccacctgtagatgatctttctccaaaaaaagtaaaagttgttgtaggagtagctcgcaaacattcagacaatgaagcagaaagtatagcagatgcattatcttcaacctcaaatattttggcttctgaattctttgaggaggagaaacaggagtctccaaagtcaacgttctctcctgctccacgtccagagatgcctggaactgttgaagttgagtctacctttctggctcgattgaacttcatctggaaaggttttatcaacatgccttctgtggcaaaatttgttaccaaagcctatccagtatctggctccccagaatacctgacagaggacctaccagatagtattcaagtaggtggcaggatatcacctcagacagtttgggattatgtggaaaaaataaaagcatcaggaaccaaggaaatttgtgtggttcgcttcacaccagtaactgaagaagatcaaatttcttatactttgctctttgcatacttcagtagcagaaagcgctatggagtagctgctaacaacatgaagcaggttaaagatatgtaccttattcctttgggtgccacagataaaattccacaccctcttgtgccttttgatggacctgggcttgaactgcatagacctaatctattgttgggcttaattattcgtcagaaactgaagcgacagcacagtgcctgtgctagtactagtcatatagctgagactcctgaaagtgcaccaccaatagcattgccacctgataaaaaaagtaaaatagaagtttctacagaagaagcaccagaggaagaaaatgacttttttaattcttttacaactgtattacacaagcagagaaataaacctcagcagaatcttcaggaagaccttccaacagcagttgaacctttaatggaagtcaccaaacaggagccaccaaaacctttaagatttcttcctggcgtgttgattggctgggagaatcaacctactactctggaattagcaaataaacctcttcctgtggatgatatacttcaaagccttttgggcaccactggtcaagtatatgaccaggcccagtcagtgatggaacaaaacactgttaaagaaattccatttttaaatgagcagaccaactcaaaaatagagaaaacagataatgtggaagtaactgatggtgaaaacaaggagataaaagttaaagtagataatatttcagaatctacagataagtcagcagaaatagaaacatcagtagtagggtcctcttccatttctgcagggtctttgacgagtcttagtctcagaggtaagccaccagatgtttctacagaagcatttttaacaaatttatcaattcagtcaaaacaagaggaaactgtggagagtaaagagaaaacattaaaaagacagcttcaggaagatcaagagaataatttgcaagataaccagacttcaaatagttctccatgcagatctaatgtaggaaaaggaaacatagatggtaatgtgagctgtagtgaaaaccttgttgctaatacagcgaggtctccacagtttatcaacctgaaaagggatcctaggcaagcagcaggacgaagtcagcctgtaactacttcagaaagcaaagatggagatagttgccggaatggagaaaaacacatgctgcctggcctgtcacacaacaaggagcacttaacagaacaaatcaatgtagaggaaaagttgtgttctgcagagaaaaactcgtgtgttcagcagagtgacaatttaaaagttgcacaaaactcaccatcagtagaaaacatacagacttctcaagcagaacaagcaaaacccttacaggaggatattttaatgcaaaatattgaaactgtgcacccatttcgaagaggatcagcagtagcgacatctcattttgaagttggaaacacatgtccatcagaatttccttctaaaagcatcacctttacttccagaagcaccagccccagaacaagtacaaacttttcacccatgaggccacagcagcccaaccttcagcatctcaagtctagcccacctggatttccatttccagggcctcctaattttcccccacaaagcatgtttggatttccaccacatttgccacctccattacttccccctccaggctttggctttgctcaaaatcccatggttccctggccacctgttgttcatctcccaggtcagccacagcgtatgatgggtcctctctcacaagcatcaaggtatataggcccgcagaatttttaccaggttaaagacattcggaggccagaaaggcgccatagtgacccttggggtaggcaagaccaacagcaactggataggccatttaataggggtaaaggggaccgccagagattttatagtgattcacaccatttgaaaagagagcgacatgaaaaggaatgggagcaagaatctgaaaggcatagacgcagagacagaagccaagacaaggacagagacagaaaaagcagggaggaagggcacaaagataaagagagggcacggttatcacatggtgatcgaggaacagatggaaaagcaagcagagatagtaggaatgtagacaagaagccagataaacctaaaagtgaagactatgagaaggacaaagaacgagagaaaagtaaacacagagaaggagaaaaggacagggataggtaccacaaagatagggaccacactgacagaactaaaagcaaaaggtaaaatttgcaggctgcttcaggattacatttaaataactgttaaaatgttgtatcttgtaaacaaaagaaagattgcctgctaggattgtgccatctttaaaatttttactattggtcatttgcagaacagtaaattctgtgtgttggtacagagtgctctgtaccagtgctcatcatcccttcttcataccaacggtccctagttataggaatttaatatttttaaaagttttacattgctgtatattcaaagatttgttttattaatatgcaataaaggcttagaaattttagttttattccttaattggtaaatatggttaactatggaatatatttacttcctctagtgaatgtcctttatataatgactaatttgggagtaatgtgtgctctgtaagtttgttttaaattgcactgtttttaaagaaactgtagaggagcaacaaaaatccaagcaacttcataatcagattatgctaatcatttagttgagcagtttttgaccaagaatcagaagcccaaggggtacatttattgctttaatctgcactcattgaagtcatttattaccatatactacagctttgtggtaggccattattttcattttcatttttggctcttcagaaacttgaatacttaagcttgtacatgatcttgtgttttgctatcctttttactgtaaaatgtaaatattttaagggatattttgattctaaatatgataaaataatttctcacctattttgtgtgtgtgacttgaaattcagtagtaaaagaatttcttctttaaagcttt

SEQ ID NO: 761 - DNA, 6463 bp, Homo sapiens
ctctcttgctcgctcgctccctctctctcctgctggctgcctgttctaggaagccagcgcggagaggggggggatgcacagcacaggggagagagattgcgcatgttggtcagtcgtgttttaaagagtacagtgcggggaggctgagaggggcgcatgcaacaacaacttttggaaggatggaagagaagaggcgaaaatactccatcagcagtgacaactctgacaccactgacagtcatgcgacatctacatccgcatcaagatgctccaaactgcccagcagcaccaagtcgggctggccccgacagaacgaaaagaagccctccgaggttttccggacagacttgatcacagccatgaagatcccggactcataccagctcagcccggatgactactacatcctggcagacccatggcgacaggaatgggagaaaggtgtgcaggtgcctgccggggcagaggccatcccagagcccgtggtgaggatcctcccaccactggaaggcccccctgcccaggcatccccgagcagcaccatgcttggtgagggctcccagcctgattggccagggggcagccgctatgacttggacgagattgatgcctactggctggagctcatcaactcggagcttaaggagatggagaggccggagctggacgagctgacattagagcgtgtgctggaggagctggagaccctgtgccaccagaatatggccagggccattgagacgcaggaggggctgggcatcgagtacgacgaggatgttgtctgcgacgtgtgtcgctctcctgagggcgaggatggcaacgagatggtcttctgtgacaagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcagtgttttctgtgc

SEQ ID NO: 762 - DNA, 4932 bp, Homo sapiens
atacaatagtgctccgcgccgcctcagccgccgccgccgcccaaccgcctgcccagcgctgaggcctgacgggccgggcggacgagggccgagggcgggagctgaggcgcggggggcggccccggcggggggcgggggcgaggaggggattaaggggcaggtgcgagggagggaagagaagaaagcgagcggttaggggggcggttaccactccgaccggactcacccggcacattgccgggccgcggcgtggagccgggcaggagccgcgagccagctgcgcgaaggatgctccaggatgaaacgccataggcctgtcagcagcagtgacagttcagacgaaagtccttccacttcctttacttctggctcaatgtataggatcaagtcaaaaattccaaatgaacacaagaaacctgctgaggtattccggaaggacctcatcagtgccatgaaacttccagattctcaccacattaatcctgatagctattacctctttgctgatacatggaaggaagaatgggaaaagggagtccaggtaccagccagtccagacaccgttccacagccttctctcaggattatagctgagaaggtaaaggacgttctgtttatccgaccccggaagtatattcactgctccagcccagacaccacagagcctggctacatcaacatcatggagttggcagcatctgtttgccgctatgacctagatgacatggacatcttctggcttcaggaactcaatgaagaccttgcagaaatgggttgtgggccagttgatgagaatcttatggaaaagacagtagaagtcctggaacgccattgccatgaaaatatgaaccatgctattgagacagaggaagggctaggcatagagtatgatgaagatgtgatctgtgatgtgtgccggtctccagacagtgaagaagggaatgatatggtgttctgtgataagtgtaacgtctgtgtgcatcaggcctgctatggcatcctcaaggtcccagaaggcagctggctgtgtcgctcctgtgtcctgggcatttatccgcaatgtgtgttatgtccaaagaaaggtggagccctgaagaccaccaagacagggactaaatgggctcatgtcagctgtgccctgtggatcccagaggtcagcattgcttgtcctgagaggatggaaccgatcacgaagatctcccacatcccacccagtcggtgggccttagtctgcaacttgtgcaagttgaagacgggggcttgtattcagtgctctataaaaagctgcatcactgccttccacgtcacctgtgcctttgagcacggcctagagatgaagaccatcctagatgagggagacgaagtgaagttcaagtcatattgcctcaagcatagccaaaacaggcagaaacttggagaagctgagtacccccaccacagggctaaagagcagagccaggccaaaagtgagaaaaccagcctgcgggcacagaagcttcgggagctggaggaggagttctattccttggtacgagtggaagatgtggccgcagagctgggtatgcccacgctagctgtggactttatctataactactggaaactgaagcggaaaagtaacttcaataagccattatttcctccaaaggaggatgaagaaaatgggctggtgcagccaaaagaggaaagcattcacactcgaatgagaatgtttatgcatctacgccaggacctggagagggtccgaaatctgtgctatatgataagcagacgagagaagctgaagctgtcacacaacaaaatacaggaacagatcttcggtttgcaagtccagcttcttaaccaagaaattgatgcagggcttcctttgacaaatgcacttgaaaactcactgttttacccaccaccaagaattaccttgaagttaaaaatgcccaaatcaaccccagaagaccacagaaacagctccacagaaaccgatcagcagccccactctcctgacagcagctcatctgttcacagtataaggaacatgcaggtgcctcaggagtcactagaaatgagaacaaaatcgtatccgagatacccactagagagcaagaataaccgtttgctggccagtctcagccattctaggagtgaagcaaaggagtccagtcctgcttggagaaccccgtcctcggagtgctatcatgggcagtcactgggaaagcctctggtccttcaggctgccctccatggacagtcttccattgggaatgggaaaagtcagcctaactccaagtttgccaaatccaatggcctggagggcagctggtctgggaatgtcacccaaaaagacagctcgagtgagatgttctgtgaccaggagcctgtgttcagcccccacttggtcagtcagggcagctttagaaaatccactgtagaacactttagtaggtcctttaaagagaccaccaataggtgggtgaagaacacagaggacctccagtgctatgtgaagccaaccaagaatatgagccccaaggagcagttctggggtagacaggttctcaggcggtctgcagggagagctccatatcaggaaaatgatggctattgcccagatttggagctgagtgattcagaggcagaaagtgatgggaataaagaaaaagtcagggtaaggaaagatagctcagacagggaaaatcctccccatgactctagacgggattgccatggtaaaagcaagacacatcccctttcccacagttcaatgcaaaggtgattagaaacttccaaggatgacccaacctttgcctttgccccatatattggggaaaacccatacaccaaaaggattttagcatatgttaagaggaattgcagtgaaaaggataacatttttccatagtaaattgtcttgcagtttttgaaaatgtttcaagtctagtttttacaagcacattacagtaattgcaggttgtccagaggttggtttgtcagaggctattgggaacagctgggcccagggtatttgctcagtaaatattttggggcagctttccggttatataacacattgacaagtatatgtattaagagtccttgcattgttaactgatttgcaagagaccatgattatcagacactaaaactacttatcttttgaagctacagcatgtgactccccagagctcctgtctgtaggaagtttctaattccctggtatctataaacccttttcaggggagagaccggagaccccatcttagatactgtcaactcactactgtcttcctttgttctgcacaaggttgagtttctttcacagtatcttaacttactgagtcaatactcctcatgcttatcagtgtccagtgcctgttcctaaacttgcttgttggggacacactcataactatttcacctgactgacaagcataaaaggctaacttgtggatagtgtttacaaaagtacaaaagtactacttccaaggaaaatgctctgattctctgtttaggcatttgtgaaggattccagagcctttcccaaagtgagaccatttctggggtatttgtaccaggtcagggtttttgtgttgttttcaaataagtttgactaaaataagtttggctgacagtttttgtatacctgctttaatgtttataaaatttttattgaggtataattaaaatatagtaaaatgcacagaggttaagtattcttacctgctttaattttgaaacagatttttattgtcaaacagaatttgaaagcatgtgtttaacacatggatataatttagctttgtgtcacctttgaatctgaggcagtttcccaaacaaaaaggctggagccatttttcagaagttgcttataccctgttcccaaactatcagccttgattaatttctagtaggaagagaataattacatttgcgggggggggggtggataaaaaacatgtctgcttctcatttaaataagagagaaatgatgccgttttttaaatgtgaagcagactataattctcagctctcttttcttcttagccttaaattaatattctctttcttctagttttggaaagtgtagtgggaatattcagacaaaagaggccattttccatttttaaagcttcttactggtgaaacagcccagttgtagtaggtgccagtcagtcaaggcaggggccctctctccgtcaatatggaaaactcagcagttttcctctcccccagttgtgttcttgtaacgttgttaatgggttcctttgctttttgctttctccttttctgaaaatgtatgtgttttgcctctcttttggctacatcttcaaaatatttcttttgtgcctatgtacatgtgtaaacatgccatagcatgtgtggtaggtgtcctgtattttgtttgggaaaaaaactatcaaaatgaggaagagaatttcccctatttatgcactaggtttctgtgctttttctttgagttctctggagtagatattaatttgataccttcatggtaatgaaattatgatggagctgtgttataaattccttatgtcagaggccagtgcggtagcctttgtcccttcatgcctttcaattctgagtgggaggaaaagcaaacatcaaaacagtgcttcagccaaattccatatgtaatgccattgggagagtattgactaaaatatcattcgtcagggaaatatagttgtaatatttttacaggatattcctaggtaaatgaaggagccttcagttgtaaatttcaattaccccaaaatgtatttgctacattttgttgtttgaagtattacctcttaaccttctttgttaatttttttcattttgtcttatatagtccagttttccaagataagctcagtcctttttcaaatgtcccctttttaccaatactttttcattaaattatgaaaactgcta

SEQ ID NO: 763 - DNA, 3244 bp, Homo sapiens
ctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagactttc

SEQ ID NO: 764 - DNA, 2309 bp, Homo sapiens
gcgggggcgggccggggcggggccaggccggctagaggggcgggtctagcggcggcccccggcgaagttcactgcgcttgcgctgacagacgcaagatggcggacagtgcggaactaaagcaaatggttatgagccttagagtttctgaactccaagtactgttgggctacgccgggagaaacaagcacggacgcaaacacgaacttctcacaaaagccctgcatttgctaaaggctggctgtagtcctgctgtgcaaatgaaaattaaggaactctataggcggcggttcccacagaaaatcatgacgcctgcagacttgtccatccccaacgtacattcaagtcctatgccagcaactttgtctccatctaccattccacaactcacttacgatggtcaccctgcatcatcgccattactccctgtttctcttctgggacctaaacatgaactggaactcccacatcttacatcagctcttcacccagtccatccggatataaaacttcaaaaattaccattttatgatttactggatgaactgataaaacccaccagtctagcatcagacaacagtcagcgctttcgagaaacctgttttgcatttgccttgacaccacaacaagtgcagcaaatcagtagttccatggatatttctgggaccaaatgtgacttcacagtacaggtccagttaaggttttgtttatcagaaaccagttgtccacaagaagatcacttcccacccaatctttgtgtgaaagtgaatacaaaaccttgcagccttccaggttaccttccacctacaaaaaatggcgtggaaccaaagcgacccagccgaccaattaatatcacctcacttgtccgactgtccacaacagtaccaaacacgattgttgtttcttggactgcagaaattggaagaaactattccatggcagtatatcttgtaaaacagttgtcctcaacagttcttcttcagaggttacgagcaaagggaataaggaatccggatcattctagagctttaattaaagagaagttgactgcggatccagacagtgaaatagctacaaccagcctaagggtttctctactatgtccacttggtaaaatgcggctgacaattccgtgtcgggcccttacatgttctcatctacaatgttttgacgcaactctttacattcagatgaatgagaaaaaaccaacctgggtttgtcctgtctgtgataagaaggctccatatgaacaccttattattgatggcttgtttatggaaatcctaaagtactgtacagactgtgatgaaatacaatttaaggaggatggcacttgggcaccgatgagatcaaaaaaggaagtacaggaagtttctgcctcttacaatggagtcgatggatgcttgagctccacattggagcatcaggtagcgtctcaccaccagtcctcaaataaaaacaagaaagtagaagtgattgacctaaccatagacagttcatctgatgaagaggaagaagagccatctgccaagaggacctgtccttccctatctcccacatcaccactaaataataaaggcattttaagtcttccacatcaagcatctccagtatcccgcaccccaagccttcctgctgtagacacaagctacattaatacctccctcatccaagactataggcatcctttccacatgacacccatgccttacgacttacaaggattagatttctttcctttcttatcaggagacaatcagcattacaacacctccttgcttgccgctgcagcagcagcagtttcagatgatcaagacctcctacactcgtctcggtttttcccgtatacctcctcacagatgtttcttgatcagttaagtgcaggaggcagtacttctctgccaaccaccaatggaagcagtagtggcagtaacagcagcctggtttcttccaacagcctaagggaaagccatagccacaccgtcacaaacaggagcagcacggacacggcatccatctttggcatcataccagacattatttcattggactgattcccaggccctgctgctcccatccccaccccagatcgaatgaacttggcagaaagaagagaactttgtgctctgttttaccttactctgtttagaaaagtatacaagcgtgttttttttcctttttttagggaaaaaattaaaagaaatgtacagagaacaaaactatattttcagttttacttttgtatataaatctaagactgcctgtgtgataaaacacttgtttaaaaaaaaaaaaaaaaaaaaaaaaaaaa

SEQ ID NO: 765 - DNA, 2902 bp, Homo sapiens
ggcatttgcggccggcgccagggtggagagttgtgcgccggtccctgggcctgagctccggctccggctggggcgcctgcgatgtctcaagatggcggagctgggcgaattaaagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttgcatccacttctagccagcggtttgaggaagcgcactttacctttgccctcacaccccagcaagtgcagcagattcttacatccagagaggttctgccaggagccaaatgtgattataccatacaggtgcagctaaggttctgtctctgtgagaccagctgcccccaggaagattattttccccccaacctctttgtcaaggtcaatgggaaactgtgccccctgccgggttaccttcccccaaccaagaatggggccgagcccaagaggcccagccgccccatcaacatcacacccctggctcgactctcagccactgttcccaacaccattgtggtcaattggtcatctgagttcggacggaattactccttgtctgtgtacctggtgaggcagttgactgcaggaacccttctacaaaaactcagagcaaagggtatccggaacccagaccactcgcgggcactgatcaaggagaaattgactgctgaccctgacagtgaggtggccactacaagtctccgggtgtcactcatgtgcccgctagggaagatgcgcctgactgtcccttgtcgtgccctcacctgcgcccacctgcagagcttcgatgctgccctttatctacagatgaatgagaagaagcctacatggacatgtcctgtgtgtgacaagaaggctccctatgaatctcttatcattgatggtttatttatggagattcttagttcctgttcagattgtgatgagatccaattcatggaagatggatcctggtgcccaatgaaacccaagaaggaggcatctgaggtttgccccccgccagggtatgggctggatggcctccagtacagcccagtccaggggggagatccatcagagaataagaagaaggtcgaagttattgacttgacaatagaaagctcatcagatgaggaggatctgccccctaccaagaagcactgttctgtcacctcagctgccatcccggccctacctggaagcaaaggagtcctgacatctggccaccagccatcctcggtgctaaggagccctgctatgggcacgttgggtggggatttcctgtccagtctcccactacatgagtacccacctgccttcccactgggagccgacatccaaggtttagatttattttcatttcttcagacagagagtcagcactatggcccctctgtcatcacctcactagatgaacaggatgcccttggccacttcttccagtaccgagggaccccttctcactttctgggcccactggcccccacgctggggagctcccactgcagcgccactccggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctctatttatatatctaagttcacagtgtttcttattcccccctaagcttctagaggctcatggccctgtagttaggcctggctcattctgcacctttccagggaggtggaaggaccctgtgccctccttcccaatcttctttttcaggctcgccaaggcctaggacctatgttgtaattttactttttatttctaaagttgtagtgaagctctcacccataataaaggttgtgaatgttc

SEQ ID NO: 766 - DNA, 1835 bp, Homo sapiens
ggtgaccaagatggcggcggagctggtggaggccaaaaacatggtgatgagttttcgagtctccgaccttcagatgctcctgggtttcgtgggccggagtaagagtggactgaagcacgagctcgtcaccagggccctccagctggtgcagtttgactgtagccctgagctgttcaagaagatcaaggagctgtacgagacccgctacgccaagaagaactcggagcctgccccacagccgcaccggcccctggaccccctgaccatgcactccacctacgaccgggccggcgctgtgcccaggactccgctggcaggccccaatattgactaccccgtgctctacggaaagtacttaaacggactgggacggttgcccgccaagaccctcaagccagaagtccgcctggtgaagctgccgttctttaatatgctggatgagctgctgaagcccaccgaattagtcccacagaacaacgagaagcttcaggagagcccgtgcatcttcgcattgacgccaagacaggtggagttgatccggaactccagggaactgcagcccggagttaaagccgtgcaggtcgtcctgagaatctgttactcagacaccagctgccctcaggaggaccagtacccgcccaacatcgctgtgaaggtcaaccacagctactgctccgtcccgggctactacccctccaataagcccggggtggagcccaagaggccgtgccgccccatcaacctcactcacctcatgtacctgtcctcggccaccaaccgcatcactgtcacctgggggaactacggcaagagctactcggtggccctgtacctggtgcggcagctgacctcatcggagctgctgcagaggctgaagaccattggggtaaagcacccggagctgtgcaaggcactggtcaaggagaagctgcgccttgatcctgacagcgagatcgccaccaccggtgtgcgggtgtccctcatctgtccgctggtgaagatgcggctctccgtgccctgccgggcagagacctgcgcccacctgcagtgcttcgacgccgtcttctacctgcagatgaacgagaagaagcccacctggatgtgccccgtgtgcgacaagccagccccctacgaccagctcatcatcgacgggctcctctcgaagatcctgagcgagtgtgaggacgccgacgagatcgagtacctggtggacggctcgtggtgcccgatccgcgccgaaaaggagcgcagctgcagcccgcagggcgccatcctcgtgctgggcccctcggacgccaatgggctcctgcccgcccccagcgtcaacgggagcggtgccctgggcagcacgggtggcggcggcccggtgggcagcatggagaatgggaagccgggcgccgatgtggtggacctcacgctggacagctcatcgtcctcggaggatgaggaggaggaggaagaggaggaggaagacgaggacgaagaggggccccggcccaagcgccgctgccccttccagaagggcctggtgccggcctgctgaccccggccgcacactcgactttcctggtgctcaccacgcagaggggcacgggccagcctcgggcgcagagggaggagtgacctttctttttctttttattgtcgttcgttttgtttttccacccttttgcctggctcctggcacctgtacctctggactctcctatcgggggattaaaaaaaaaagtaaaatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 767 - DNA, 2642 bp, Homo sapiens
gtttctctccctgcccccgcgacttcgcgcaagatccgggaaggacacccgaggcccctgggagaccctggggaggtgaaaatcagagagcgaagcgggccgtggcccctaggcctgacccctccccgcggggtaaggcgggcaccccgcgagcgcaggggtcctcttactgctgatggcacccagctctgggcccagacgccgctcaccgtccaccgccggtgctgggtaaaatgtcggttccaggaccttaccaggcggccactgggccttcctcagcaccatccgcacctccatcctatgaagagacagtggctgttaacagttattaccccacacctccagctcccatgcctgggccaactacggggcttgtgacggggcctgatgggaagggcatgaatcctccttcgtattatacccagccagcgcccatccccaataacaatccaattaccgtgcagacggtctacgtgcagcaccccatcacctttttggaccgccctatccaaatgtgttgtccttcctgcaacaagatgatcgtgagtcagctgtcctataacgccggtgctctgacctggctgtcctgcgggagcctgtgcctgctggggtgcatagcgggctgctgcttcatccccttctgcgtggatgccctgcaggacgtggaccattactgtcccaactgcagagctctcctgggcacctacaagcgtttgtaggactcagccagacgtggagggagccgggtgccgcaggaagtcctttccacctctcatccagcttcacgcctggtggaggttctgccctggtggtctcacctctccagggggcccaccttcatgtcttcttttggggggaatacgtcgcaaaactaacaaatctccaaaccccagaaattgctgcttggagtcgtgcataggacttgcaaagacattccccttgagtgtcagttccacggtttcctgcctccctgagaccctgagtcctgccatctaactgtgatcattgccctatccgaatatcttcctgtgatctgccatcagtggctcttttttcctgcttccatgggcctttctggtggcagtctcaaactgagaagccacagttgccttatttttgaggctgttctgcccagagctcggctgaaccagcctttagtgcctaccattatcttatccgtctcttcccgtccctgatgacaaagatcttgccttacagactttacaggcttggctttgagattctgtaactgcagacttcattagcacacagattcactttaatttcttaattttttttttaaatacaaggagggggctattaacacccagtacagacatatccacaaggtcgtaaatgcatgctagaaaaatagggctggatcttatcactgccctgtctccccttgtttctctgtgccagatcttcagtgcccctttccatacagggatttttttctcatagagtaattatatgaacagtttttatgacctccttttggtctgaaatacttttgaacagaatttcttttttttaaaaaaaaacagagatggggtcttactatgttgcccaggctggtgtcgaactcctgggctcaagcgatccttctgccttggcctcccgaagtgctgggattgcaggcataagctaccatgctgggcctgaacataatttcaagaggaggatttataaaaccattttctgtaatcaaatgattggtgtcattttcccatttgccaatgtagtctcacttaaaaaaaaaaaaaagaaaaagaaatggataatttcatctactgcctttacttggggttaatgtgattcttaaacaccttcatcatggaactctcagagtggggtccgttttggtttcctggtggtgggttttgaaagataagggaaagcacattttgagcatgtctgggtaccatggtgcggatgcttgggaaccagaactgtttcagaggaatctaaagtctgattttagttttcagagacacagcttgttgtaaaacatgagaagacatgatttctaggactcaagcagcaagccaggattctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccacatagtactttggtgttacctgcttttgaaaaataaagtctttggttcacccggtgaactatttatgagttcttttggtgtgaagaaagggctcatgttgcatttccagccattgctacaaagaacctttatttgttcagtaacggtagaaaatccttcccgattaaaaacttcagacttgctgaatatcctgcaatgtcaagatgaccgatgttgagttgggtggatttgctaacgagtcagatttgaacatgaggctattggaacccaataggcgtcattgatggcggcaagccatagctttcaagttttaataaaatgcacaaaagagaaaaaaaaaa

SEQ ID NO: 768 - DNA, 1811 bp, Homo sapiens
agggaggccgactagcgcaggcggacgggagagaatgggggaggggtgggatgggagcaggggcagagacgggcagagggcagagggcggagcggcgccggagcgggcgtcatggcgcggctcctctggttgctccggggcctgaccctcggaactgcgcctcggcgggcggtgcggggccaagcgggcggcggcgggcccggcaccgggccgggactgggggaggcagggtctcttgcaacgtgtgagctgcctcttgccaagagtgagtggcaaaagaaactaaccccggagcagttctacgtcacaagagaaaagggaacggaaccgcctttcagtgggatctacctgaataacaaggaagcaggaatgtatcattgcgtgtgctgcgacagtccactcttcagttctgagaaaaagtactgctctggcactgggtggccttcgttttccgaggctcatggtacgtctggctctgatgaaagccacacagggatcctgagacgtctggatacctcgttaggatcagctcgcacagaggttgtctgcaagcagtgtgaagctcatctaggtcacgtgtttcctgatggacctgggcccaatggtcagaggttttgcatcaacagtgtggctttgaagttcaaaccaaggaaacactgaccatcttcaagagtcccgttcccttgccaccccttcacgtgcaccctcaatttccacaattcacttgaatgacttgttttatttgcaataaaactgggctgaatttgctgctgtctccagcgagtcattgcttctcttaatttatttacctggaatcaacttaatcctgtgtgttaggctgttcttgtgttgctataaagaagtacctgatcaggatctgggagaatttgaaaaaaaaagaaaaactagaaaaataaacaaaattaaaaagaaaaaaaaatacctgagactgagtaacttataaagaaaagaggtttaattgactcacagttctgcagggtgtacagaaagcatggtgccagcatttgctcggattctggggagacctgagggagcttttactcatggcagaaggtgaagggggagccggcgtctcacatggcaaagcaggagcaagagagagtggtagggaggtgccacatacttttaaacagccagatctctcaagaactcactcactgtcaccaggacagcaccaagccatgagggatccaccctcatgacccagttacctcccggcagggcccacctccggcactaggaattatacttcaacataagatttggagagggaaaacatccaaaccatatcacccaactcccacttggagtagaacttcacaaaacgacagagggacagctgtttccatcaaacacttccacagcttcacctgagacgagggcatgactctgggaacatcaggaggctgatggactattaagccaaacaattcctacaaaaattccctgcaccttccactgcgtttcagtccttgacagacataagtaagggatcaagtgagaagaggaaggaaaatacaggatccaaggaatcaacaatgctagcactgaagagcaggattacggaggagctgtgctctgggagcatatatggtgatcaatcagatgcatgacttttttttcaaaattttaaatgtcttgagcatgctacttccaaccattctacccacaaataaactgcaataggacttggttagatttcaatgattatgaataaatgttcaccttcataccttctggttacaaagctaaactttaaaatgtccaaataaaatattcactaaaattta

SEQ ID NO: 769 - DNA, 2383 bp, Homo sapiens
cctggcgcagggactgctggaacctggctgtgcgcgctgtcgctttaagacagactctgccggcgccgtccggagccttagaaaccggccccggatcgcgagccggagccggagccggagccggggccggccgggctgctgaggcccgagcggcaggagcgcagcgcggagcgctgagccaggcgcccagtcgcgagaagctgccgccgcctctgcccgcccggcgccgcagccccgggcggtccatggggcgggcacggcgtcgctgcaggcgccggcagccctggagggcagccgcttaggcgctgcgctcttgtccccgcaggtcgcagccagggcggcggggcgcgcccagccccggcccctggagcgcccgccgcggtccccacctccatggacgccttcaaggggggcatgagcctggagcggctgccggaggggctccggccgccgccgccgccaccccatgacatggggcccgccttccacctggcccggcccgccgacccccgcgagccgctcgagaactccgccagcgagtcgtctgacacggagctgccagagaaggagcgcggcggggaacccaaggggcccgaggacagtggtgcgggaggcacgggctgcggcggcgcagacgacccagccaagaagaagaagcagcggcggcaacgtacgcacttcacaagccagcagttgcaagagctagaggccacgttccagaggaaccgctaccccgacatgagcatgagggaggagatcgccgtgtggaccaacctcaccgagccgcgcgtgcgggtctggttcaagaaccggcgagccaagtggcgtaagcgcgagcgtaaccagcagctggacctgtgcaagggtggctacgtgccgcagttcagcggcctagtgcagccctacgaggacgtgtacgccgccggctactcctacaacaactgggccgccaagagcctggcgccagcgccgctctccaccaagagcttcaccttcttcaactccatgagcccgctgtcgtcgcagtccatgttctcagcacccagctccatctcctccatgaccatgccgtccagcatgggcccaggcgccgtgcctggcatgcccaactcgggcctcaacaacatcaacaacctcaccggctcctcgctcaactcggccatgtcgccgggcgcttgcccgtacggcactcccgcctcgccctacagcgtctaccgggacacgtgcaactcgagcctagccagcctgcggctcaagtccaaacagcactcgtcgtttggctacggcggcctgcagggcccggcctcgggcctcaacgcgtgccagtacaacagctgaccgccccgccgcaccacgcgggccggcggccggagcggggaagggcgcgggcgcgggcgcggaggacgcacgcggggccccggctcgcaagccccagctcaccgcgccgcggacctcacacctgcgcagccccctcctcccacttcccactccgggttggttttgtgtttgcttttccggaccccactctgccctccaaaaagacaaaaaaaaaaaaaaaaaaaaaaaagcaaaaagacgtcggagaaaagtgccgcgaaaaaatggatgagttgcaatttctctcgggatggcgcgggtggtgtgtgtgttcccacgggccccggaggcccactccgcggagggcacgcggcgcggtaggcgagcgccgaggcccagcggccgggggaggacgacctcgtatcccgcgtccccgccgcgctggatccggactgagtggccgggcctgcggactggatgtgcggggcctggacttgcctaggatttcccgaccccgtacaaaccaagttgccctctccgagctaggcccggccgagagcgccttagctcgagtcggatccgtgttggggcgggcgttgggtttggggggacggtgcccccagcccaggatcgggcactcagtggagccgcacacggccccggcgcgcctggtagagcctcgctggccccgcgccccggagccctatattaaggccacggagcgacagcgggcagtgcgggcctggcgggaggtgggggaggtccatctcagaacaccccagccttgagcttagctgcaggcccaggccctctgctctgctcccgggctaggaggtggccctctgtctgggcgaacagccccctcctcaccgcccgccgtgcaagagtcgagccggcagagcaaggggcgcggccccagggccctgcgcccactttgcacacccgctctccggcccgcgcccctgtttacagcgtccctgtgtatgttggactgactgtaataaatctgtctatatcgacttgtccatgtacgtctattaaaaccatagtccgagcgtgctaagca

SEQ ID NO: 770 - DNA, 2337 bp, Homo sapiens
gttaggccaacagggaagcgcggagccgcagatctggtccgtcgctcgcctgggtgcctggagctgagctgcggcaaggcccggctcctgttcgaccgcccgaggggtgtgcgtgtgcgcgttgcggagggtgcgctcagagggccgcgtcgtggctgcagcggctgctgccgccgcaggggatctaatatcacctacctgtccctgtcactcttgacacttctctgtcagggctgccgcgtggggggggggcgggcagagcgcggtcggcgttagctttccttattggaggggttcttgggggagggagggagagaagaagggggtctttgcccactcttgtttcgctttggagcttggaagcctgctccctaaagacgctctgagtggtgcccttctgcccacatcccatgtcttcgtttgcccgctgactttccgtctccggactttttcgcttgagccttccggaggagacgggggcagcttggcttgagaactcggcgggggttgcgtcccctggctctccccgcagcggggaaactccgcgcctagagcgcgacccggagcgggcagcggcggctacgggggctcggcggggcagtagccaaggactagtagagcgtcgcgctccctcgtccatgaactgcatgaaaggcccgcttcacttggagcaccgagcagcggggaccaagctgtcggccgtctcctcatcttcctgtcaccatccccagccgttagccatggcttcggttctggctcccggtcagccccggtcgctggactcctccaagcacaggctggaggtgcacaccatctccgacacctccagcccggaggccgcagagaaagataaaagccagcaggggaagaatgaggacgtgggcgccgaggacccgtctaagaagaagcggcaaaggcggcagcggactcactttaccagccagcagctccaggagctggaggccactttccagaggaaccgctacccggacatgtccacacgcgaagaaatcgctgtgtggaccaaccttacggaagcccgagtccgggtttggttcaagaatcgtcgggccaaatggagaaagagggagcgcaaccagcaggccgagctatgcaagaatggcttcgggccgcagttcaatgggctcatgcagccctacgacgacatgtacccaggctattcctacaacaactgggccgccaagggccttacatccgcctccctatccaccaagagcttccccttcttcaactctatgaacgtcaaccccctgtcatcacagagcatgttttccccacccaactctatctcgtccatgagcatgtcgtccagcatggtgccctcagcagtgacaggcgtcccgggctccagtctcaacagcctgaataacttgaacaacctgagtagcccgtcgctgaattccgcggtgccgacgcctgcctgtccttacgcgccgccgactcctccgtatgtttatagggacacgtgtaactcgagcctggccagcctgagactgaaagcaaagcagcactccagcttcggctacgccagcgtgcagaacccggcctccaacctgagtgcttgccagtatgcagtggaccggcccgtgtgagccgcacccacagcgccgggatcctaggaccttgccggatggggcaactccgcccttgaaagactgggaattatgctagaaggtcgtgggcactaaagaaagggagagaaagagaagctatatagagaaaaggaaaccactgaatcaaagagagagctcctttgatttcaaagggatgtcctcagtgtctgacatctttcactacaagtatttctaacagttgcaaggacacatacacaaacaaatgtttgactggatatgacattttaacattactataagcttgttattttttaagtttagcattgttaacatttaaatgactgaaaggatgtatatatatcgaaatgtcaaattaattttataaaagcagttgttagtaatatcacaacagtgtttttaaaggttaggctttaaaataaagcatgttatacagaagcgattaggatttttcgcttgcgagcaagggagtgtatatactaaatgccacactgtatgtttctaacatattattattattataaaaaatgtgtgaatatcagttttagaatagtttctctggtggatgcaatgatgtttctgaaactgctatgtacaacctaccctgtgtataacatttcgtacaatattattgttttacttttcagcaaatatgaaacaaatgtgttttatttcatgggagtaaaatatactgcatacaaaaaaaaaaaaaaaaaaaaaaaaa

SEQ ID NO: 771 - DNA, 1407 bp, Homo sapiens
ggagcgcccgagcggagaggcggcccgggagcaggggggcggcccccactccggccgggtgcccggcccctggcccctgcctgccctctagatcgccgccgcagccgccgctactgggagtctgcctgttgcaggacgcactagccctccctccatggagttcggcctgctcagcgaggcagaggcccggagccctgccctgtcgctgtcagacgctggcactccgcacccccagctcccagagcacggctgcaagggccaggagcacagcgactcagaaaaggcctcggcttcgctgcccggcggctccccagaggacggttcgctgaaaaagaagcagcggcggcagcgcacgcacttcaccagccagcagctacaggagctagaggcgaccttccagaggaaccgctaccccgacatgagcacgcgcgaggagatcgccgtgtggaccaacctcaccgaggcccgcgtgcgggtgtggttcaagaaccggcgcgccaaatggcggaagcgcgagcgcagccagcaggccgagctatgcaaaggcagcttcgcggcgccgctcggggggctggtgccgccctacgaggaggtgtaccccggctactcgtacggcaactggccgcccaaggctcttgccccgccgctcgccgccaagacctttccattcgccttcaactcggtcaacgtggggcctctggcttcgcagcccgtcttctcgccacccagctccatcgccgcctccatggtgccctccgccgcggctgccccgggcaccgtgccagggcctggggccctgcagggcctgggcgggggcccccccgggctggctccggccgccgtgtcctccggggccgtgtcctgcccttatgcctcggccgccgccgccgccgcggctgccgcctcttccccctacgtctatcgggacccgtgtaactcgagcctggccagcctgcggctcaaagccaaacagcacgcctccttcagctaccccgctgtgcacgggccgcccccggcagccaaccttagtccgtgccagtacgccgtggaaaggcccgtatgagcggccccgcccgtagatcatccccgagggcgggggcaacgattcacagcctccgcggactggggtcattttgactggcttgctcccgccccagggtctgaaaggggtgtttgggcagctggggggcaccggctcaggagagggccttcccctcccagccctgaggggtggactaggccctacacacagaccgcgcccctgggactaaagccaggaacagggaccagctccccgggggccaactcacccttggcccatcccgccttctccaggcttcccctccctcgttttcaaagataaatgaaataaacgtgcgcggactgtcaaaaaaaaaaaaaaaaaaa

SEQ ID NO: 772 - DNA, 4997 bp, Homo sapiens
gcgtcgccctcctcccattgagcgaggctgtgtcgcgtggcccagcgtcggcgtgacggttggacgcgggcgcggcactgcgggtcccgattgctgcagccgcttgtcagtgtgatgaagattggcacccagacaccattcgcttttcacccaagatgatttgatgtcttataaaactctgatgaaccatgatggctacacagacattaagtatagacagctatcaagatgggcaacagatgcaagtagtaacagagttaaagacagaacaagatccaaactgctctgaacccgatgcagaaggagtgagccctccccctgtggagtctcagaccccgatggatgtggacaagcaggccatttataggcatccactatttccattattagctttgttgtttgaaaaatgtgaacaatctacacagggctctgaaggcacaacttctgccagttttgatgtagacatcgaaaattttgtaagaaagcaagagaaggaagggaaacctttcttttgtgaagatccagaaactgataatttaatggtaaaagcaatccaggttttgcgcattcatcttcttgagctggaaaaggttaacgaactctgcaaagatttctgcagtcgatacattgcttgtctgaaaacaaaaatgaacagtgaaactctgttgagtggagagcctggaagcccgtactcaccagtgcagtcccagcagattcaaagtgccatcacaggcaccatcagccctcagggaattgtggtgccggcgtccgcgctgcagcagggaaacgtagccatggcgacggtggcaggtggcacagtgtatcagcctgtcacggtcgtcactccccaaggccaagtggtcacacagacattgtcgcctgggacaattaggatccagaactcccagcttcagttacagttaaaccaagatctcagcatcttgcatcaagatgatggttcatctaagaacaagaggggcgtcctgccaaagcatgccacgaacgtgatgcggtcctggctcttccagcacatcgggcatccctacccaacagaggatgagaaaaaacagattgctgctcagacaaatttgacactactccaagtcaacaactggttcatcaatgccagaagacgaattcttcagccaatgttggattcaagttgttcagagacccccaaaacaaagaaaaaaactgctcagaaccggccagttcagaggttttggcctgattctattgcatcaggagtcgcacagccaccgccgagcgagctcaccatgtcggaaggagctgttgtcaccatcaccacgcccgtgaacatgaacgtggacagccttcagtctctgtcctcggacggggccaccctggcggtgcagcaggtcatgatggcagggcagagcgaggacgagtctgtggacagcacagaggaggatgcgggtgccctggcccctgcccacatcagcgggctggtcttggagaacagtgactccctgcagtaggggcaggagcagacgcacctgactttttggagtttgcacagcaaacattttacacagttttatttctaatatgttttatatgtagatatagaagagtgcacttttgtatttcatagtaagcttaaagcgcgtctttgccggtgcagcgacttctttcaagtgtgtgtgtgtgtgtgtgtgtgtgtgtgtgtgcgtgtgtgcgtgtgtgtggatttttaaagaaattctttaaaggtttaacgctagattgtgaggaatgacacaccactccctccccaccttgaatccctaattagattaaggaatagcgctgccattttctaaaccgtgatgcggttgtcacttagttctgtggttccagcagatctcagtgggctggttgatttgtgtggcccatggatttgaaagaagctgctgcacccgaaactgccagtgtgcggtgacaacggcacacgcctagactgagtgtggtttcgtcgtgagtggatggacggcaagcttagcaagcctaagtcccctcatgttcagtgagcctgtttcatttgctatatagaaaaagaaactcctatttttaccttgctggaattattggataaaaaagctatttttataaattcgttatgaattggatgatgactatattgaggataaaatttctagagaagaaacaatacatgcttgctattaatatttcaatttggaatgttctgaattgaccaaatttaatgaacctgcccaaagttagctaccgttccatggttctttgctctccccgggtagtgatgaacatttactactataaaagaaacagctatttaatgaaattttgatatctgcaaatttttgttgatatgtaatgctcagattgcattttacacttgatctaaacatatatcgaaagatatctgctaaacaggacttcaggtaagtgaggtgaaatggtagccagtgacccgttaggagctctcaccgtacatactccagtctaatttaaatctgaccacagttgcatggtcgctttaccatgttagctgtgtattgttttaaaagttttaacttcaaaatatgttatgcacagaatgtttattataaactaatataaaatgtgctctaccccattggctcagagctagggcaaacagcagatattcagactttattacttaactagcggacatccctggagtcccagcagcgagctggtctggcgagggcacctcggcagcccccacgggttggctcctacgtttgcgtttgtggctggtctcctggtgtcagtgttctcttgtacgttgttgctttcgacttttcagagccctcctgctcacttgaccacgtgagatttggaataactgtaggacttctgtttcctggtaacaagatgaaccgagagagtgggctgggttctgttttctttggttttgatttgttttcattgtttacttaggagtggtgctttttctcagaaaacaggccacggtgtttcatacagaatgtcttcatatcatctgaaatggtatggctgaagttcatttgtttacagggtcgggaatgtcttcagttcttgagagtcaacagtaatgattggttgtaagccaagggacattttaagctagtgaagagttttttctggaattgatttttcccaaaagaatatattaattgaggttaagaagtcagtgggaaacacacagaaatttgttttaaaatctttcaggagctttactgaaagacttggttatcaagtcttttggggagagaatgacattttttttttgagacagagttttgctcttgttgcccaggctggagggcaatggtgcaatctcagctcactgcaacctccacctcttatgttcaagcaattctccttccttagcctcctgagtagctgggattacaggcatgcgccaccacacccggctaattttgtatttttagtagagatgggtttctccatgttggtcgggctggtctcgaactcccgacctcaggtgatctgcctgcctcagcctcccaaagtgctgggattacaggtgtgagccaccgcgcccggccgagaatgacatcttaaagccaccattgcgttcctcatttgtgaactgtcttctcatattttaagtcaagtctataagatcatttttaacctaagttccaactttgttggactccttaaaataagcacccatgaaagccagccagcccttcctccttccctcaccaccctccgtctcttcggctgcttgctctttagtgtagattagtggaagccattcacagaatgtagactcatgtataggtcaccgtttctttcccccactagaaatcacattcactaagcagtggattgaatttaagagtgctgcccctgcccggcgcagtagggcgtgcctctagttccagctactcgggagtctgaggcagaggatggcatgtgccaggagtttgaggctgcagtgcactatgcttgcacctgtgaatagccactgcactccatcttgggcaacacagtgagacccccatctataaaaagagagcactgcctgaacctcggtggcactgggaagctctggcctgagagttaaacacccatgctgaatgatacagtgtgcattctctccagctgcaaactttcttcaactttcctaaattcttactaaattcagaggaataggataaagatcacttagagaaagggtgcttatggacatagcctgagtttcctttaacctctctgcaatgggtgcttttaactagcttctacatggcaagctgtttcagtttgcaaaatcactgcccagcatgtttgaggtcagttggcaccttaaaacacctgttctccagcccttggacagtggagagaatctgtaaaagtgtgaccccctctaagatttcgttttaaatgatcagattcggttccagttttattcttgttgagtttttccctatgaaggctccttttgaatgtgtcttgagacccaaattgagcatgttgctgttattcctgccctgcacctgtggagcaggagtggcagggctggctgtgctgggttccagctcgctcccaccgagggactagcttggcctttgcgctttgattccagatagtaagatgagtggaagtgtttatcgagcatgcaaaagaaaccctcacggctaagggctctgggagttgtgtctgtgtgacctgagagtgatccatctcctgcctgtgtgaggtagcagtgggcacttttcattgagacaaactccagggtgtccagagggggttctgccccttgtgaaggcccattcctggcacttagagacagaaagaactcagcaatctttcgttctagttatattcggtctttgaaactgacaatctttgaaatgtgaatactgtaacaatatgttttcttggattgttgtctttaaaaaggatttttgtgaagcaattgatttatcaaagcaaaaaaattaaaaatagaaacttgcaaaaaaaaaaaaaaaaaaaaa

SEQ ID NO: 773 - DNA, 3730 bp, Homo sapiens
gtgtgaagggggggtccggggggcgggtccctgtgccgctgacgtcccgagcagtgctgggaagtataggctgtgttgtcacgccggtgtcagtctgatgaagattggcatcaggtgaagtctggagcaggacttctgaggctttctatcctccatgctgctcactagaaaaggggctgtgaactgtgctttggctctagcagacaggaagaaattctggcccagctggaagtagaaagaggggagtgagtctcctgaggaccatctcagaggccccgggatcacccgaacagtcctccatgtgaatcaatcccatgatgcaacatgcctccccagcccccgctctgacgatgatggccacgcagaatgtcccgcccccaccctaccaggacagcccacagatgacggcaaccgcccagccaccctccaaggcccaggctgtccacatctctgccccctcagctgctgccagcacacctgtgcccagtgcccccatcgacccccaggcccagctggaggctgacaagcgagctgtatacaggcaccctcttttcccgctcctgacgctgctgtttgagaaatgtgaacaggccacccagggctctgagtgcatcacctccgccagctttgatgtggacatcgagaactttgtccaccagcaggaacaggagcacaaacccttcttcagcgatgacccagaactggacaatctgatggtgaaggcaatccaggtcctgagaatccacctgctggagctggagaaagtcaatgaactctgcaaggacttttgtaaccgttacatcacctgcctcaaaaccaagatgcacagcgacaacctgctcaggaatgatctaggggggccctactcccccaaccagccctccatcaaccttcactcacaggacctcctgcagaattcccccaattccatgtccggagtctccaataacccccaggggattgtggtcccagcctcagcgctccagcagggcaacatcgccatgacaaccgtcaactcacaagttgtgtcaggtggagccttataccaaccggttaccatggtaacctcccagggtcaggtggtcacccaagcaatcccccagggagccatccagatccagaacacacaggttaaccttgacctcacctccctcctggacaatgaggataagaagtccaagaacaaacgaggagtcttgcccaagcatgccaccaatataatgcgttcttggctcttccagcatctcatgcacccctaccccacggaggatgagaagaggcagatcgcagcccagaccaacctcaccctcctgcaagtaaacaactggttcatcaatgcccggaggcgcatcctgcagcccatgcttgatgccagcaacccagatcctgcccccaaagccaagaagatcaagtctcagcaccggcccacccaaagattctggcccaactccatcgctgcgggggtgctgcagcagcagggcggtgccccagggacaaaccccgatggttccatcaacttggacaacctgcagtccctgtcctcagacagtgccaccatggccatgcagcaggctatgatggctgcacacgatgactcattggatgggacagaagaagaggatgaggatgagatggaagaggaggaggaggaggagctggaggaggaggtcgacgagctgcagacgacaaatgtcagcgacctgggcttggaacacagtgactccctggagtagtcgggcagcccagatggcactgatcactgagcaggagaggagtgtcgccgggaggccttcagggtgggggggaaggggacatgggcaggaagcaccgagggagttgggccctagcttccccaaatcagtagcttgaagaaaggcaaaggagacacctgttccttcccaaccaccgagcttcaatgaggaccccagccccacttccctggaactgccgaggactctgtttggcggggccagtcgagcagcctgtgtggaaagacaggagtgagatctggactcaccaaatccctgaggatagatggcacccatggcccccacccacggaaggacttgagttgtttacaagccctgcactgaggcagattggtgctgttcgcagagtaggcctttgcccgggggcagacttagaaggaaggggagagacaaagggggactgagtttcatccccagaagtttctcagctcctttgacagacattcaagggcaggagggagccccaaagcataaccagtggccagaggagtgggagggcctgaggcatcacatcttgcagatcagaatgggatggaatccaccaggctccagctcatccctccaaggccctgtctctgcgcacagcaaccatggacatgggagaaagggatgggagccacagtgcccttcactctctcctggaaaccaactgtaagctggtgggctcaacctgtgggaggttaagaggagtcccttctgggttgactccaagagccaaggagatggcagaccctgggctaggaaccatatggaggtgactttgaggccacagctgtccctaggtgatcacagaacttagctcctttaacaacaggacaatggttttttaccctagatgttcccaccttcagtgctccacgccctccatagaccttcagagaaggtgaaaccaggttatctgggaatctttccagcccgcaggtcgccacggccatccctttgctcccagcctggctccatcagcctccagcttcctttcttcattctgtccttcagggaaggcagaagaaacattggaaagcatctagtccagtgggaagccaggggttggagaaggtgctacatccctcttcccatcaatatcctaaatgtgggggagggcccagagaatggcacccaagagcctgcggggatgcccatcccacacaccccacccagctgttctaaccctgctatccacagccctggaggaactggggctcctggaaggaggaggaggctctccactgtccaccctaacacataccctcccacccaccttccagacccccttggttggcaccctctcctccggttccctctcaccccatggctgtgaatgacaggacaggtcacacgtgtgttttccattgggtttaatttaatggacgtgcagtttcatttgtaaattgtgcattggccacctccttcagtggcaggatgtgagtggctacctggctcaactggaggggaccccttgggccctctggggcttcccctcccccacctggttggggtagagcaaaaggatggtcactcttccgaggtctccctgaaatgaatgtatttctcccccaaaagagctgatatttaatgttttaataaggatttttgagaaacaaataaccttatttataatctgggtgatccaatcattttttactcccttttgatgccatacatagaggaaagtctagcttttttggcgtgagacttttgcaatgtgcagtgggataaaatgcatttccttttctggttcgtttttcttgttaacacgcgcacacagacacacacacacaccgttccactcaccacctggacaggcgtcccccagcacggacacactggcacacaggtgcccacatctcttcctctcagcccctccacctgcctaatgttatgcaacctccttctgatgtatccaccaaaccagtactgaatgtggccgagacgttttcagtaaatcttattacctaccgtaa

SEQ ID NO: 774 - DNA, 7338 bp, Homo sapiens
agctgcaagttgggctgcaggggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcggttgcctcttggtgctgccttggccgtatttggcacccagaatgcttcattctgtgacggtctattaataaggttgccttgctagagtttggagcagggcctcagattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtcctgattcactgccaattgtcacattttaagacttttttttttccatataggaaagccattattagtagtaaacttttacaaatcccattttcaaattacttttagatcttaaaattttcatttttgtctaataacagtggctctaccttttgacatctggctcattaaaaaatttagcaatagaatgtaaattgtataaaaagtttgtgaataactcaagggtttaaattttcttactagcttctaaatggattaataatcaagtgcttcaaatgaattaagagtccagtttcggaagataataaatgtttgttagatacaccataatttcagatcagtatattctgaagactccctgttgtctggctaaaatatttgccatctttattatgagcctttaaggaaaacaaaccctaaacacaaagcatcagtatttatagcaaaaagagactctgttaggtgacatggcatttcgtgtcacttaatagttggccctaaattagtacacaggatattttgtcgtgtttcatccttcttaacatgctatcttttcatttaataatagtaatagtgtatggcattggggtcttcagagtcgatatataggtagatctctttagtcttttccacctttcacatccaaggggtgggtcaagtgcagccagcaatttattttcattgttggcccacggttagtccataatctagagccattgtggaactgcagccatgaggtgtgtttatcccacagtggattgactcagcctctgtgggtgacagacttctaagcaggaagatagacgtgaagcacatggttacatttgggaacttgtgtagggatcatggcccctgtagccagggttaaaaactggactttttagaagtaaagtaaaagcatatcgcttatatcatttcttgctgaatttgatatgtttttctttcccttaagaatcaaaagcagaaaacaaaaacaacagtcctactccgatgttatctttctgattcaatgtgaatccatctttccttgcaatattttggatggagaatttgaagttaaatgcattagaaaactacctgatgaactaccacaaagttttaagtgactagaaatatatacagtaaaatcccactttcatgcatctctgggaaatgataggagtattgcaaataagttgagtttgtagagggtaacaaagtaaagtaaaacaaacctatcttggttaacatgaaaataacaattgagaatatattatattcactgaataattataggcttttcctcacattagacaaccaacataatcttcttaaaggtctaattaatatatttttctaagggtcagttgggacattaacctaagaaacatatctattaagcacttgttaacaccttattttaggaccctttccgttggggatgggggcaagggtgggaggtttttagaagagtatatatctctttaaaaaaaaacagaaagaaaaatatttctgagcactcattagccctatatggaaacttctttcctttttgtagggccagttatcactgcagattgcaatgtttaccaagaatttctaaaaatgagtgcagattactgaatataatacattatttaaaatatttgggagtagtataatttgtggagaaatgtaaattgtaataatgtaaatgggggcttcaatatatatatataatacacacacacacacacatgcacacataccgcacttcatagaatcaaagttgctctctgaaggagctttggctcctgatattttatcatgctcctatatttttttaatccttggagcagtagtttttatacttatgtatttaaattttattatgaaaaattacatttattaaaaaagtgtgttccaaaggcattaaaattatatatgttaataaggaagtacatttttaaatttttcaaactgctcctagcttttgattaggagaatattttttctgaaagtaggcttttcgctctgcttcattactgcttcctttagtttctatgaaacagattgcttacctaaatctttagttgaatgattagtgttcaatattgctttaatcaccatataaaaggaaaaaaattggtgacagagcacaaatagaaaacctatttttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtgtgtgtgtatatatacacacacacacacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagtgtgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctttatttttcttagtcatttgtggaatatagtgatatattgtgttaatttggacagtagcggtttttaaaaaccatatactgactgaaacatgagccagagccgattgctttattaagctaataatgaatgttaaagagtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaattatagaatggcttta

SEQ ID NO: 775 - DNA, 2949 bp, Homo sapiens
gagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggattgctgtcacgtctaatgtggctgctgcctcgtgtcacatctgaaactcatctgtacctcacttagaaagtggttctgattagacaagacttttcgttgcagtcgacagaaacctaatgggaccattgaagaattccaaacaggtatttgcataggaatcagaggagttaatcttgtctcttctcacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaaaaaaa

SEQ ID NO: 776 - DNA, 5656 bp, Homo sapiens
acaatgcaccgcacaatggcccgaccgccgccactaccggggcctgagggggcctggcggagcccgagcgcggcccggcccgcagcgtggggccccgagcgcggtgaagagattgttttctgaaagctgcgttggaggctgtgacagagctgagagcctgtgtggagcggatggggaggctttctcaataacatggccctttgccattagccttgccatgaccacatttttcaccagcgtccccccctggattcaagatgcaaagcaggaggaggaagtgggctggaaactagttcccaggcctcggggccgggaggcggagagtcaagtgaagtgccaatgtgaaatttcgggaacacctttctcaaatggggagaagctgaggcctcacagcctcccgcaaccagagcagagaccatatagctgccctcagctgcactgtggcaaggcttttgcttccaaatacaagctgtataggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagctgctcaagatcaagacagagcccgtggacatgttaggcctactcagctgcagctccacagtcagtgtgaaggaagagctgagccctgtgctgtgcatggcctctcgggacgtaatggggaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctctttactgttaactcttaacagatgcagtcagcagtttctgggcacttctctcagtaggtgcctcatgctgacttctccagtagggtttcaggacaaactaccaaggaattgcctcagcctcctaccagtcctccctcacccaccttctgtctaggttcacttggtttgtcatcaggaactgagcaggtccaggactcagctttctgcttcagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggtgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatgacatgcccaggtgtcagctcaaaggatctctgcatcatcttgaggtgggaggcagggaaaggagcgccaatgaggttccctgcaacccccgccctccagcccaccgcccaaccttttacaaatggcattttcttaattgaaaatccgggaagcaggtgtgattacttttttgctcgtagatattgtcctaagttggaattctcccactgccctaaaactttccctagtagtcctttaaactcccccctccctttttggtagctgttttctccgtcctctctccacctgccctcttatctaggagctgtttgtaagcacgatttttttaacaggttatattgtacaggatcaatattttgctttttaacaaggatatttatgtaataagaaactttgccttaggcaggtgttggccagaaaagtccagattcctctgggatcccaccctggcctctcctggaactctgaacctgctgtggaaggaattggccatgaccttcacctctggagagtagggtctatggcgagggaaaagggtgttcaccatgataacctagtgcctccatagaggggtttggaaaaattccagtccgatttctttgtgtgtcagctgacttccttagctgattgttcccacttgcacctctccacctttggcactagaactcctgagacaccacttctcatgcttctccctccctaccagcggtcaaggctttggagccactcttttgtaactccagattatttaaagagaaaagtacaagacagaaatcttctagcactttgtaaacacagtgaataacctcttggagtatttttggctttatataaaacaaggtttttaattgtaaagtataagtgccattagaaaatgcacagggcatatctttgttaaagtagatttttcaatgttttacagaattacattttcaaaaaaaggtttttataatgaagttgtttattaaaaacttctgaatgatgtgtt

SEQ ID NO: 777 - DNA, 1797 bp, Homo sapiens
ggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccctaaaaaaaaaaaaaaa

SEQ ID NO: 778 - DNA, 1082 bp, Homo sapiens
agatttggaggttcaacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcagctaccagagattcactgactgctataagtgcttctaccagttgcagcctgcgatgacacagcaaatctatgacaagtttatagctcagttgcagacatctatccgggaggaaatctctgacatcaaagaggaggggaacctagaagctgtcttgaatgccttggataaaattgtggaagaaggcaaagtccgcaaagagccagcctggcgccccagcgggatcccagagaaggatctgcacagtgttatggcaccctacttcctgcagcaacgggacaccctgcggcgccatgtgcagaaacaggaggccgagaaccagcagctggcagatgccgtcctggcagggcggaggcaggtggaggagctgcagctacaggtccaggcccagcagcaggcctggcaggctctacacagagaacagagggagctggttgctgtgctgagggagcctgagtgaggagaccgccagccccagaagcagagggcagtcaaggtcaagagcctgtggtccagcatgcctggcctgggcgggctacctctgagaacggctgaaatggtgcccagtccatcagcagtgatggaatttgctggaggactaggccagagcaagcctcactgccactgtgcctttggggcacccttggggttggacatacaccccctttagattcctctgtttcttctacctggataattcttggccatgttctctcttctctaggttcaggtcagctctgcccctccgcccccctcctgctggttccccagcccttttccctggccctggcttggagaatctgttttcaatctccactgattgcccccttgctggccagcccaggggcctttaccatgttctctccacatccgtaaataaacttccttcactacactgtaa

SEQ ID NO: 779 - DNA, 2254 bp, Homo sapiens
ctctccagaggcgggccctgagccggcacctcccctttcggacagctcaagggactcagccaactggctcacgcctccccttcagcttctcttcacgcactccaagatctaaaccgagaatcgaaactaagctggggtccatggagcctgcacccgcccgatctccgaggccccagcaggaccccgcccggccccaggagcccaccatgcctccccccgagaccccctctgaaggccgccagcccagccccagccccagccctacagagcgagcccccgcttcggaggaggagttccagtttctgcgctgccagcaatgccaggcggaagccaagtgcccgaagctgctgccttgtctgcacacgctgtgctcaggatgcctggaggcgtcgggcatgcagtgccccatctgccaggcgccctggcccctaggtgcagacacacccgccctggataacgtctttttcgagagtctgcagcggcgcctgtcggtgtaccggcagattgtggatgcgcaggctgtgtgcacccgctgcaaagagtcggccgacttctggtgctttgagtgcgagcagctcctctgcgccaagtgcttcgaggcacaccagtggttcctcaagcacgaggcccggcccctagcagagctgcgcaaccagtcggtgcgtgagttcctggacggcacccgcaagaccaacaacatcttctgctccaaccccaaccaccgcacccctacgctgaccagcatctactgccgaggatgttccaagccgctgtgctgctcgtgcgcgctccttgacagcagccacagtgagctcaagtgcgacatcagcgcagagatccagcagcgacaggaggagctggacgccatgacgcaggcgctgcaggagcaggatagtgcctttggcgcggttcacgcgcagatgcacgcggccgtcggccagctgggccgcgcgcgtgccgagaccgaggagctgatccgcgagcgcgtgcgccaggtggtagctcacgtgcgggctcaggagcgcgagctgctggaggctgtggacgcgcggtaccagcgcgactacgaggagatggccagtcggctgggccgcctggatgctgtgctgcagcgcatccgcacgggcagcgcgctggtgcagaggatgaagtgctacgcctcggaccaggaggtgctggacatgcacggtttcctgcgccaggcgctctgccgcctgcgccaggaggagccccagagcctgcaagctgccgtgcgcaccgatggcttcgacgagttcaaggtgcgcctgcaggacctcagctcttgcatcacccaggggaaagatgcagctgtatccaagaaagccagcccagaggctgccagcactcccagggaccctattgacgttgacctgcccgaggaggcagagagagtgaaggcccaggttcaggccctggggctggctgaagcccagcctatggctgtggtacagtcagtgcccggggcacaccccgtgccagtgtacgccttctccatcaaaggcccttcctatggagaggatgtctccaatacaacgacagcccagaagaggaagtgcagccagacccagtgccccaggaaggtcatcaagatggagtctgaggaggggaaggaggcaaggttggctcggagctccccggagcagcccaggcccagcacctccaaggcagtctcaccaccccacctggatggaccgcctagccccaggagccccgtcataggaagtgaggtcttcctgcccaacagcaaccacgtggccagtggcgccggggaggcagaggaacgcgttgtggtgatcagcagctcggaagactcagatgccgaaaactcgtcctcccgagagctggatgacagcagcagtgagtccagtgacctccagctggaaggccccagcaccctcagggtcctggacgagaaccttgctgacccccaagcagaagacagacctctggttttctttgacctcaagattgacaatgaaagtgggttctcctggggctacccccacccctttctaatttagtctctgagtcccaaaaagaagtgcaggcagagccatctgccaggcccaggagagctctgagctctggccaacaactgcagccaggctgggcagagcactccggctcacctgggctcctggcgtgtcatttgctggcttgaataaagatgtccgccttatccagtgcctgagtgtgcgagagaggcagatgcctccaaaaaaaaaaaaaaaaa

SEQ ID NO: 780 - DNA, 4071 bp, Homo sapiens
tgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaaggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactcta

SEQ ID NO: 781 - DNA, 2928 bp, Homo sapiens
cggcggcggcggcgcggcgcagggcgcggggcggcatggccaccaccgcgcagtacctgccgcggggccccggtggcggagccgggggcaccgggccgcttatgcacccggacgccgcggcggcggcggcggcggcggcggccgcggagcgattgcatgcaggggccgcgtaccgcgaagtgcagaagctgatgcaccacgagtggctgggcgcgggcgcgggccaccccgtgggcctagcgcacccccagtggctacccacgggaggaggcggcggcggcgattgggccggcggcccgcacctagaacacggcaaggcaggcggcggcggcaccggccgagccgacgacggcggcggcggcggaggtttccacgcgcgcctggtgcaccagggggcggcccacgcgggcgcggcatgggcgcagggcagcacagcgcaccacttgggcccggccatgtcgccctcgcccggggccagcgggggccaccagccccagccgctcgggctgtacgcgcaggcggcctacccggggggcggcggcggcggcctggccgggatgctggcggcgggcggtggcggcgcggggccgggcctgcaccacgcgctgcacgaggatggccacgaggcgcagctggagccgtcgccgccgccgcatctgggcgcccacggacacgcacacggacatgcacacgcgggcggcctgcacgcggcggcggcgcacctgcacccgggcgcgggcggcggcggctcatcggtgggcgagcactcggacgaggatgcgcccagctcggacgacctggagcagttcgccaagcagttcaagcagcggcgcatcaagctgggctttacgcaggccgacgtggggctggcgctgggcacgctctacggtaacgtgttctcgcagaccaccatctgccgcttcgaggccctgcagctgagcttcaagaacatgtgcaagctcaagccgctgctcaacaagtggctggaggagaccgactcgtccagcggcagccccaccaacctggacaagatcgcggcgcagggccgcaagcgcaagaagcgcacgtccatcgaggtgggggtcaaaggcgcgctcgagagccactttctcaagtgccccaagccctcggcgcacgagatcaccggcttggcagacagcctgcagctggagaaggaggtggtgcgcgtctggttctgcaaccggcggcagaaggagaagcgcatgacccctgcggccggcgcgggccacccgcccatggacgatgtatacgcgcctggggagctagggcctggcgggggcggcgcatcgccaccctccgcgcccccaccgcccccgccggcggcgctgcaccaccaccaccaccacacactgcccggctcagtgcagtgaccccgcgggccgggcccccgccggcgcgctgcagggcgcgggcgcgcagcccgcccgcgcggcctggactctttttgttcggttgctttggattttacaaaaaaaaaaaaaagcccagaaactttcgaacaaaaccaaacacccggacgaccctctccggtgagcggcgaagacagcccggtaggctgcgtcgcccgagccccgggagagaggagcgaagatccggaactcgccaactcaccccgggcatcctgcccgccgcctgctctctgcccccatcccctcgacgacccccgcccctgcccccccgggctgttcggggccggatcccggcagcggcctccccaaagcgacaggtaacgcagtgcggggttagggattccccgggagagaggacgaagcgaggagagttctccatcccctctccccgcgtggactcctgagcctgcgggtccagggtggggggctgtcactttattcgctacacgcctcttctctcctataaggatgcgccccaccccgctttcccctttctccgggcttggttttttacggtttttatttattcgtggagcctctcggctcctggggtccttctaactccgcccgcgcccttaatttaaatcgcagtatactgtatttatcggggccccggaggggaggtcgcgagagccgcgtctgtgtataaaagcaggaaatagccaaagctttaatctagcctaatttatttttccccttatatttccctaccctaccctccccccaaaaaaaagcaaaaaaaaaaaaaaaaaactaacaaaaaaaattcgagtgttcatttttcgtttcgtttcatccgagccccggcttggttcccggccacgccggaggggtctgcgctcccacacacccagacgggaaggggcttctgccctgctgcagaccgaccgccgcatagcgcggcccctgctccccgcggggccctgccctcctggccacaccaaacgaaacttggaaaagttagagagattgttttttaaccagctgtagaaataagccgttccctgagaaccctccgcctgattccctgcagcttccctctgctccctttccagcccgccgggatgcgggatgccaggggaggccgggagagaaattccccaagtttggggtgaggtgggaaccatgtaaatatgtgagatatgtacacactggcggggagaagaaacattttgtgcttggtttttatttttggttttccgggttacccttccttcctaccctaaaggattttgtacactgactaatccgaaaaagatattttaatatgatttccgaatttctgacccatctctatttattttctggatgtgtttggagcttcccccttctccgtttcttcttctgtttgttaaggtttgaatttaaattttgttattttatttttattattttttgaaacaatgtttcggtgcattctctttgtatctttattgaaaaaaaaataatgtagactgggaagttccctttatatttatgttatagtaaatattttatt

SEQ ID NO: 782 - DNA, 4172 bp, Homo sapiens
agtaatagcaggagcagcaacagaaggcgtcggagcgggcgtcggagctgcccgctgtgggagagagaggagacagaaagagcgagcgaggagagggagcccgaggcgaaaaagtaactgtcaaatgcgcggctcctttaaccggagcgctcagtccggctccgagagtcatggcgaccgcagcgtctaaccactacagcctgctcacctccagcgcctccatcgtgcacgccgagccgcccggcggcatgcagcagggcgcggggggctaccgcgaagcgcagagcctggtgcagggcgactacggcgctctgcagagcaacggacacccgctcagccacgctcaccagtggatcaccgcgctgtcccacggcggcggcggcgggggcggtggcggcggcggggggggcgggggcggcggcgggggcggcggcgacggctccccgtggtccaccagccccctgggccagccggacatcaagccctcggtggtggtgcagcagggcggccgcggagacgagctgcacgggccaggcgccctgcagcagcagcatcagcagcagcaacagcaacagcagcagcaacagcagcaacagcagcagcagcagcagcaacagcggccgccgcatctggtgcaccacgccgctaaccaccacccgggacccggggcatggcggagcgcggcggctgcagcgcacctcccaccctccatgggagcgtccaacggcggcttgctctactcgcagcccagcttcacggtgaacggcatgctgggcgccggcgggcagccggccgggctgcaccaccacggcctgcgggacgcgcacgacgagccacaccatgccgaccaccacccgcacccgcactcgcacccacaccagcagccgccgcccccgccgcccccgcagggtccgcctggccacccaggcgcgcaccacgacccgcactcggacgaggacacgccgacctcggacgacctggagcagttcgccaagcagttcaagcagcggcggatcaaactgggatttacccaagcggacgtggggctggctctgggcaccctgtatggcaacgtgttctcgcagaccaccatctgcaggtttgaggccctgcagctgagcttcaagaacatgtgcaagctgaagcctttgttgaacaagtggttggaggaggcggactcgtcctcgggcagccccacgagcatagacaagatcgcagcgcaagggcgcaagcggaaaaagcggacctccatcgaggtgagcgtcaagggggctctggagagccatttcctcaaatgccccaagccctcggcccaggagatcacctccctcgcggacagcttacagctggagaaggaggtggtgagagtttggttttgtaacaggagacagaaagagaaaaggatgacccctcccggagggactctgccgggcgccgaggatgtgtacggggggagtagggacactccaccacaccacggggtgcagacgcccgtccagtgaactcgagctgggggaggggcagagcgcggggctccccctccccttcggtccttggccctttcccggccctcttgttccctctctaacttctgattgttcttttatttttaattattatttccccgtcccttaaaaagacaaaaaaaataaggcaaaaggaaagcaactaagacactggactatcctttaaaggtagcaggtgtaatgatgtgttttgacctttgcaggcgagtaaccaggcaatggagtggagtgtctcctggagagagtgaggagagtgtgtgatagctagaaagagagagagacagagagatggcaagcactgagataaatacctggcaaaactaaataaattaccaaaaaggaaaaaaaatccaccaaaccatgataaacacaaaatgcagcttcctgatgcttagagttggcacatgctgctgtgtttatttattgtggattcccatcaggaaagaggaaaaaatacacatgttctttcatataggcaaaatttaaccacataaatttgcactgcaagaaaattgaagtttacgtgaacaaattcatgagcatattttctctttctccccaccgttaatttgggagttgccgttttgggggattttgttttgctttgctttattcatcggagagagttgaagccagctcttggccactctccatttctaatgttcttgtgttgccccttcttcgtactgtttgtgaactttggttaccttcacattccccttacgagggtgtaacatctatttgttcctcttaccaaagcaaaaggattggcttcatacaaaatagacaattctctgatttcaggaaatgtgcatggtctacccgctttatcgaaggcaagaatccggtttggaatataaaaataagcattggttgttcttaccagccacaaagtaaacttcattttcaggcagtgtttctgggggaggttatggagggaagaaaaaagaaaaatcgatagtgagtgactgattgcttcattttatcaggcgggcccattgtgaaagagctcaggggaaatgtggaggttaaatatatttccagagttgtccagcagaaagaaagtggcactttgaagagaactagggaagtacatatcttcagatatccctatatagttctctaccttcagttttagtaacaattatgaagaattatttgtgctgacagcagcagttaaactttgtttctctaatagctttttttttacataaaaaaagacccaggaacttaatagtgtatgcataagactgtgttttttagcacacagatacccacagcatacactgacgatctccacgcagtagacaggttttgtcttcactagctcatttgtttatcaagtcatatttagggtcccacaccctcttttcctgtaatttattgcagaatacaccactttgacttggacagctttctgccccctctttcactaaggaaggcaaatgaagtgaaaaaaaaaaatgccattttcaatccttcctttctcccctttgttaatagttttaagtgaatttttgaccttatcttaatggaaaacggttaactccaaacacaaaagactctactggaaagtgtaggtgaaaaaacttgtaactgtattgaaaataaataccattaaactgtgatcagttaaaatttaaaagaaaaatcagcacaaaagggcgctaaaagggaaaacactttttattaatcttaaaagtttgggggtttttttccagttaggtattagataaatttttattttaaaaaatgaaagtctcactaccataaaattatggttcagcatcagattagcattgcactcagtagtctttaaggttttaggaaatatgctttatattgtcttttcaaacacctgtgattgtttcattttccatgtttttgcaagataaatggtgacttataatgggcatatttatttgcctgtatttcatttcccccaatgaatgtcacaaggagatgggcacggagctgcttcgggtgcatcacgctgctcgttcctgaggtatgggaactggcctttagtgaagctatccagagcagggcaaatagccactggtaaagggaggaaatgaatttccagatacttattaccaagtaggtaaggtcagaagctggagttcagagaatgtgtctacagcttctctgactcttataggtttactaagatgaaagttaccactgaaccttaccactatgtatatatgtttaatatctgtcttttgaaatgcagaaatagtttaaatgtttctttgtctatttttctttttttttaatgctacccagggaaatattttcatatcatttttaagtggcctgcctcaatgtatatttatttcttttgaaacaaaaaggttctggaaactgtttttctgtagctttaaatgaataggtgagcaaaatctatatgggatgtaatttttttgttcagtctcttaaaaaatactttgttttggtacatttggttgtgcttgtggggaaaataaaaacgcagagatccttatatatttatgttaaagtaatattttattatctacataaaacagaaatgcacaataaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 783 - DNA, 1503 bp, Homo sapiens
atggccacggcggcttctaacccctacctgccggggaacagcctgctcgcggccggctctattgtgcactcggacgcggcaggggctggcggcggcgggggtggcggcggcggcggcggcgggggcggcgcagggggcgggggcggcggcatgcagccgggcagcgccgccgtgacctcgggcgcctaccggggggacccgtcctctgtcaagatggtccagagcgacttcatgcagggggccatggccgccagcaacggcggccatatgctgagccacgcgcaccagtgggtcacagccctgccccacgccgccgccgccgccgccgctgccgccgccgccgccgtggaggcgagctcgccgtggtcgggcagcgccgtgggcatggctggcagcccccagcagccaccgcagccgccgccgccaccgccgcagggccccgacgtgaagggcggcgccgggcgcgacgacctgcacgcgggcacagcgctgcaccaccgcgggccgccgcacctcggacccccgccgccgcccccacaccagggccaccctgggggctggggggcggccgccgctgccgcagccgcagccgccgccgccgccgccgccgcgcacctcccgtccatggccgggggccagcagccgccgccgcagagtctgctctactcgcagcccggaggcttcacggtgaacggcatgctgagcgcgccaccggggcccggcggcggcggcggcggcgcgggcggtggagcccagagcttggtgcacccggggctggtgcgcggggacacgccagagctggccgagcaccaccaccaccaccaccaccacgcgcatcctcacccgccgcacccgcaccacgcgcagggacccccgcaccacggcggcggcggcggcggcgcggggcctggactcaacagccacgacccgcactcggacgaggacacgccgacgtcggacgacctggagcagttcgccaagcagttcaagcagcggcgcatcaagctgggcttcacgcaggccgacgtggggttggcgctgggcacactctacggcaacgtgttctcgcagaccaccatctgccgcttcgaggccctgcagctgagcttcaagaacatgtgcaagctcaagccgctgctgaacaagtggctggaggaggcggactcaagcaccggcagccccacaagcatcgacaagatcgcggcgcagggccgcaagcgcaagaagcggacctctatcgaggtgagcgtcaagggcgcgctggagagccacttcctcaagtgccccaagccctccgcgcaggagatcaccaacctggccgacagcctgcagctcgagaaggaggtggtgcgggtctggttctgcaatcggcgccaaaaggagaagcgcatgacgccgcccgggatccaacagcagacgcccgacgacgtctactcgcaggtgggcaccgtgagcgccgacacgccgccgcctcaccacgggctgcagacgagcgttcagtga

SEQ ID NO: 784 - DNA, 1507 bp, Homo sapiens
agatgtcaaaggctgaagctgctccctttgccacattataactagtaggggatcctcaccgaccatggccacagctgcctcgaatccctacagcattctcagttccacctccctagtccatgcggactctgcgggcatgcagcaggggagtcctttccgcaaccctcagaaacttctccaaagtgattacttgcagggagttcccagcaatgggcatcccctcgggcatcactgggtgaccagtctgagcgacgggggcccatggtcctccacactggccaccagccccctggaccagcaggacgtgaagcccgggcgcgaagacctgcaactgggtgcgatcatccatcaccgctcgccacacgtagcccaccactcaccgcacactaaccaccccaacgcctggggggccagcccggcaccgaacccgtctatcacgtcaagcggccaacccctcaacgtgtactcgcagcctggcttcaccgtgagcggcatgctggaacacgggggactcaccccacctccagctgccgcctctgcacagagcctgcacccggtgctccgagagcccccggatcacggcgaactgggctcgcaccattgccaggatcactccgacgaggagacgccaacctctgatgagttggaacagttcgccaaacaattcaaacaaagaagaatcaagttgggcttcacgcaggccgacgtggggttggcgctgggcacactgtatggtaacgtgttctcgcagaccaccatctgcaggttcgaaggcttgcagctgagcttcaaaaatatgtgcaagctgaagcccctgctgaacaagtggctggaggaggcggattcgtccacagggagcccgaccagcattgacaagatcgctgcacagggccgcaagcgcaagaagcggacctccatcgaggtgagtgtcaagggcgtactggagacgcatttcctcaagtgtcccaagcctgccgcgcaggagatctcctcgctggcagacagcctccagttggagaaggaagtggtgcgtgtctggttctgtaatcgaagacaaaaagagaaaagaatgactccgccaggggatcagcagccgcatgaggtttattcgcacaccgtgaaaacagacacatcttgccatgatctctgactggaggaagcgaggaggcggccggccgcactgggagcagcgcggatttctctttctctctcactctcttcctttcattctagtattctttattatttttctctctctctcgttcgctcgctctctcgtactctctctcttttccctcctttcctttttctttcctttcccctttttctttcccttctttttccctttcctttcctttcattttctttcctttccccttcccttcccttcccttccatctcttcctttcctttcctttcttttcttttgctttcctttcctttttttcccttttctttccttttcataagaggttctaacttctgttgacaaaggaaacacatactc

SEQ ID NO: 785 - DNA, 3817 bp, Homo sapiens
gcggggctagagctgtcggagaagcgggaccgcgaggccggcgcgcggcgctctgcgcggtcagagggagcgcctggcagcagcaggagcagcagcagcagcccgcggcggggccgccgccagccgccgcgaccgccgcggctgcagcctccgaagggaggccgggtgagccggcgtacgcactttcccgcggactttcggagtgtttgtggatatacatgccaagccgccacgatgatgtccatgaacagcaagcagcctcactttgccatgcatcccaccctccctgagcacaagtacccgtcgctgcactccagctccgaggccatccggcgggcctgcctgcccacgccgccgctgcagagcaacctcttcgccagcctggacgagacgctgctggcgcgggccgaggcgctggcggccgtggacatcgccgtgtcccagggcaagagccatcctttcaagccggacgccacgtaccacacgatgaacagcgtgccgtgcacgtccacttccacggtgcctctggcgcaccaccaccaccaccaccaccaccaccaggcgctcgaacccggcgatctgctggaccacatctcctcgccgtcgctcgcgctcatggccggcgcgggcggcgcgggcgcggcggccggcggcggcggcgcccacgacggcccggggggcggtggcggcccgggcggcggcggcggcccgggcggcggccccgggggaggcggcggtggcggcccggggggcggcggcggcggcccgggcggcgggctcctgggcggctccgcgcaccctcacccgcatatgcacagcctgggccacctgtcgcaccccgcggcggcggccgccatgaacatgccgtccgggctgccgcaccccgggctggtggcggcggcggcgcaccacggcgcggcagcggcagcggcggcggcggcggccgggcaggtggcagcggcatcggcggcggcggccgtggtgggcgcagcgggcctggcgtccatctgcgactcggacacggacccgcgcgagctcgaggcgttcgcggagcgcttcaagcagcggcgcatcaagctgggcgtgacgcaggccgacgtgggctcggcgctggccaacctcaagatcccgggcgtgggctcactcagccagagcaccatctgcaggttcgagtcgctcacgctctcgcacaacaacatgatcgcgctcaagcccatcctgcaggcgtggctcgaggaggccgagggcgcccagcgcgagaaaatgaacaagcctgagctcttcaacggcggcgagaagaagcgcaagcggacttccatcgccgcgcccgagaagcgctccctcgaggcctacttcgccgtgcagccccggccctcgtccgagaagatcgccgccatcgccgagaaactggacctcaaaaagaacgtggtgcgggtgtggttttgcaaccagagacagaagcagaagcggatgaaattctctgccacttactgagggggctgggaggtgtcgggcgggacagaatggggagctgaggaggcatttttggggggctttcctctgcttgcctcccctcggatttggagtgtccgttatcctgcctgcatttggggagtcccttctcgctctctttcctccacccattctctgattttcctgcctttgctgtcccctagccttgaggactggggtgctgggtgtggggattggagtatagggtaggggagaagggggggagcattcgggggagtggggagtggggggaaggaaagcggagacccgagcaggggttttaaggagcaggatggttctggggtttgggtggggggagacgcgggaagggtaggaaaatggactgtttctgaccagagacacttacctaaatatcctggggaccaaggaactatgtacaaaaacaaacctaccaaccaccaaaaactagacaaataaagacaaactaaaacaaaacagaacaaaagcaaaggaaaatgctttagaaattttaactccggggagccataatctgcaacttcattttcccccatagaagagaaaaaagagcaccaccattattaccacctccccaaccctacacgcacgaactgagtcgaaaaacgaaaaccaaacgagcgagaagttgaagttctgggtatcaaagctagttgttctgtctgcgtgtttaatttttccctctctcacctccaccccatccatatcctctttatttcctccgttccaatgagaggcctatggctgctctccaatcccgggaagtgagtgggagcacagctgaaaagagagggtcagggggaggctggctgcttgcttaggtggaatccaagttttcccgtggccctgcctatactctggtggcctggtcctgttggggtgggggtctttggagagaagggcatagtctttgagctactaaaaagcagaattccggagcttcgagatatcttattctaggaaaatgaaacaattttaacaacagttttttttcctcttatgtcgaagatctagttttagacaatttcaaaataagcttttcccactcatagaactttaacttgccctttcagttttatcttttttttagagagaggtttaaactactgatttttcctgttgattcaaatagactaatggggtgaaagttattaggagagatactctctcctgttttctccactgaacgagactcatcttgctcttctaggtcccgtttcttcctctcttggaggacatgaaattatagaaatgttgagaagttcctgctttcttttgcggtaggacttggctgtgagaaaatcacctaaatcccagaaaagaggaagacagatttaaagtgcccccacccccatttgtttcaaagaggtctgcatgttgggcgaaaacagaacaactgtgtttccttttacttgttcttattattcaagagtcatttattacaggggataaatgttgggtagcaagaactttaatttgcactaccagtctcccaaatagaaaatcatgtatagtatttcatagtaataatcaggtaccttacaagctgctggtggattttaaaaaattaagatagttgaaggtggttaggtaaaatgcctgctttgtgtacaagatactctttggatctctcgtagagatggtttgttaccatcctttaatcataactaaaacattgaaaacagaacaaatgagaaaagaaaaaaaacctgccgattaacaagactgaaatcatgcatgatctgaaaggtgtggaaagaaacacaattaggtctcactctggttaggcattatttatttaattatgttgtatatcattgtttgcagggcaaacattctatgcatttgaaactgagcactaaactgggctagctttctggtagaccgttttgtggctagtgcgatttcacagtctactgcctgtttccactgaaaacatttttgtcatattcttgtattcaaagaaaaaggaaaaaagattattgtaaatattttatttaatgcacacattcacacagtggtaacagactgccagtgttcatcctgaaatgtctcacggattgatctacctgtccatgtatgtctgctgagctttctccttggttatgttttttctcttttacctttctcctcccttacttctatcagaaccaattctatgcgccaaaatacaacagggggatgtgtcccagtacacttacaaataaaacataactgaaagaagagcagttttatgatttgggtgcgtttttgtgtttatactgggccaggtcctggtagaacctttcaacaaacaaccaaacaaaaa

SEQ ID NO: 786 - DNA, 3141 bp, Homo sapiens
agtttcgggtgccgaggtctgcagctagcggcaagcggagtcaggcatccgttcagactgacagcagaggcggcgaaggagcgcgtagccgagatcaggcgtacagagtccggaggcggcggcgggtgagctcaacttcgcacagcccttcccagctccagccccggctggcccggcacttctcggagggtcccggcagccgggaccagtgagtgcctctacggaccagcgccccggcgggcgggaagatgatgatgatgtccctgaacagcaagcaggcgtttagcatgccgcacggcggcagcctgcacgtggagcccaagtactcggcactgcacagcacctcgccgggctcctcggctcccatcgcgccctcggccagctcccccagcagctcgagcaacgctggtggtggcggcggcggcggcggcggcggcggcggcggcggaggccgaagcagcagctccagcagcagtggcagcagcggcggcgggggctcggaggctatgcggagagcctgtcttccaaccccaccgagcaatatattcggcgggctggatgagagtctgctggcccgcgccgaggctctggcagccgtggacatcgtctcccagagcaagagccaccaccaccatccaccccaccacagccccttcaaaccggacgccacctaccacactatgaataccatcccgtgcacgtcggccgcctcttcttcatcggtgcccatctcgcacccttccgcgttggcgggcacgcaccaccaccaccaccatcaccaccaccaccaccaccaaccgcaccaggcgctggagggcgagctgctggagcacctgagtcccgggctggccctgggcgctatggcgggccccgacggcgctgtggtgtccacgccggctcacgcgccgcacatggccaccatgaaccccatgcaccaagcagcgctcagcatggcccacgcgcacgggctgccgtcgcacatgggctgcatgagcgacgtggacgccgacccgcgggacctggaggcattcgccgagcgcttcaagcagcgacgcatcaagctgggggtgacccaggcagatgtgggctccgcgctggccaacctcaagatccccggcgtgggctcgcttagccagagcaccatctgcaggttcgagtccctcacactgtcccacaataatatgatcgcgctcaaacccatcctgcaggcatggctcgaggaggccgagaagtcccaccgcgagaagctcaccaagcctgaactcttcaatggcgcggagaagaagcgcaagcgcacgtccatcgctgcgccagagaagcgctcgctcgaagcctactttgccattcagcctcggccctcctctgaaaagatcgccgccatcgcggagaagctggacctgaagaaaaacgtggtgcgcgtctggttctgcaaccagaggcagaaacagaaaagaatgaaatattccgccggcatttagaagactcttggcctctccagagacgcccctttcctcgtccgctcttttctctcctctcttctgcctcttttcacttttggcgactagaaacaattccagtaaatgtgaatctcgacaaatcgaggactgaagagggagcgaacgagcgaacaactgagcccaagccggtgagaatgtgaaacagtttctcaaaggaaagaataacaaaagatggtatttgtctgttgtagcaaagttgtccctttgaaccccacctcggcttcttcagaggaagtgtggagatggctgtttgcaggaaggcagacgagacagtgtttaaaaagtccacaagaatgatcaagtaagatttgtttttattcttacagacatcacccgtgttcaagtttaaaagtacactttgcaactatttttcagaaatagaaattgattcaggactaaaactttaaactagagttgatgcttaatgtgatagagacatctctaaagtattttgaattttaaaaaaagatggcagattttctgcatttacactgtatattatatatatatttttattgtggttcttacccccttttccttctctgaagtgttaatgcttaagaaaagagttgcgcctgctgtgttcactgatcttgaaagctattattagattattgcagaacaaccctctgtaaattattaatttatctctctagcaacttaattttgtgcacattctaattaattaaacttcttccgtctaaaaaaagtgggggaaatgtatagctagtaacgttcaaaaaattttgtttgatgagtttaccgaatttttacagctttcctcctatactgtgttccttttgacccatttgtatattctcacttgaatgaagattgtttttttctttgtttttactggtagtgttctgatttgtgagtcgacactcagtaatggatgtcttaatcgtgtagacctgattcactgtctgaagtattgtttacttcgttacatatttaatggggattcccacattgtccccatgacacatgagcgctctcacttacccttacacacacacacacacacacacacacctctaacagaagggaagaagcagttggaagcatgaccgatgcaccattttctagttttaggtgcatttgccacttggtgtttgcccttcagattttagatttcaccaaggtatttcagtcttccagttttcaattgctttgttggctacatgttaatatttataggaatacttcagtttttccttttggaggtttgtttgtagaaaaactaatttgaactataagaaagacagtgcactgcttgtaaattcacattgtttggaaaaattcttttggaacaaaaaattaggtacatgataactggtaccttatctactgtaaatatttcattaaaaatgatgcacacatagatatattcttacaaattttgctgtattgctgttctctttgaggctctccaaagtcttgagttctgtatatggcctggtttcttgtttttattaatagatggtttatttactatggtaatgtattaatttatttttggtgttgttcgattgtctttcattgaagagataattttaatgttttattggcaacgtatgctgctttttcattaaaatatgctattaaaattaaatggctttta

SEQ ID NO: 787 - DNA, 1182 bp, Homo sapiens
cgctgagcagcgctcacttggagagcggcaagcaagctagacaagcctgattccatgtcacccgctgccaccctgccaggagcgcgaagatgatggccatgaactccaagcagcctttcggcatgcacccggtgctgcaagaacccaaattctccagtctgcactctggctccgaggccatgcgccgagtctgtctcccagccccgcagctgcagggtaatatatttggaagctttgatgagagcctgctggcacgcgccgaagctctggcggcggtggatatcgtctcccacggcaagaaccatccgttcaagcccgacgccacctaccataccatgagcagcgtgccctgcacgtccacttcgtccaccgtgcccatctcccacccagctgcgctcacctcacaccctcaccacgccgtgcaccagggcctcgaaggcgacctgctggagcacatctcgcccacgctgagtgtgagcggcctgggcgctccggaacactcggtgatgcccgcacagatccatccacaccacctgggcgccatgggccacctgcaccaggccatgggcatgagtcacccgcacaccgtggcccctcatagcgccatgcctgcatgcctcagcgacgtggagtcagacccgcgcgagctggaagccttcgccgagcgcttcaagcagcggcgcatcaagctgggggtgacccaggcggacgtgggcgcggctctggctaatctcaagatccccggcgtgggctcgctgagccaaagcaccatctgcaggttcgagtctctcactctctcgcacaacaacatgatcgctctcaagccggtgctccaggcctggttggaggaggccgaggccgcctaccgagagaagaacagcaagccagagctcttcaacggcagcgaacggaagcgcaaacgcacgtccatcgcggcgccggagaagcgttcactcgaggcctatttcgctatccagccacgtccttcatctgagaagatcgcggccatcgctgagaaactggaccttaaaaagaacgtggtgagagtctggttctgcaaccagagacagaaacagaaacgaatgaagtattcggctgtccactgattgcggcagggcgcagcgtcgggagccgggagagcctagtgctcatccctcccgggttcgggggatggttatcggg

SEQ ID NO: 788 - DNA, 1411 bp, Homo sapiens
ccttcgcaagccctcatttcaccaggcccccggcttggggcgccttccttccccatggcgggacacctggcttcggatttcgccttctcgccccctccaggtggtggaggtgatgggccaggggggccggagccgggctgggttgatcctcggacctggctaagcttccaaggccctcctggagggccaggaatcgggccgggggttgggccaggctctgaggtgtgggggattcccccatgccccccgccgtatgagttctgtggggggatggcgtactgtgggccccaggttggagtggggctagtgccccaaggcggcttggagacctctcagcctgagggcgaagcaggagtcggggtggagagcaactccgatggggcctccccggagccctgcaccgtcacccctggtgccgtgaagctggagaaggagaagctggagcaaaacccggaggagtcccaggacatcaaagctctgcagaaagaactcgagcaatttgccaagctcctgaagcagaagaggatcaccctgggatatacacaggccgatgtggggctcaccctgggggttctatttgggaaggtattcagccaaacgaccatctgccgctttgaggctctgcagcttagcttcaagaacatgtgtaagctgcggcccttgctgcagaagtgggtggaggaagctgacaacaatgaaaatcttcaggagatatgcaaagcagaaaccctcgtgcaggcccgaaagagaaagcgaaccagtatcgagaaccgagtgagaggcaacctggagaatttgttcctgcagtgcccgaaacccacactgcagcagatcagccacatcgcccagcagcttgggctcgagaaggatgtggtccgagtgtggttctgtaaccggcgccagaagggcaagcgatcaagcagcgactatgcacaacgagaggattttgaggctgctgggtctcctttctcagggggaccagtgtcctttcctctggccccagggccccattttggtaccccaggctatgggagccctcacttcactgcactgtactcctcggtccctttccctgagggggaagcctttccccctgtctccgtcaccactctgggctctcccatgcattcaaactgaggtgcctgcccttctaggaatgggggacagggggaggggaggagctagggaaagaaaacctggagtttgtgccagggtttttgggattaagttcttcattcactaaggaaggaattgggaacacaaagggtgggggcaggggagtttggggcaactggttggagggaaggtgaagttcaatgatgctcttgattttaatcccacatcatgtatcacttttttcttaaataaagaagcctgggacacagtagatagacacacttaaaaaaaaaaa

SEQ ID NO: 789 - DNA, 4715 bp, Homo sapiens
aggatcaagggaatcgtggctgcctgccccactgagcccactgccccaaccccctctccttcttgtgccagatcccttgggattggagccgctgtgagcagtggctaggcatttgagcacctctgtctctgccttgctccatagcagctgctgtgctgaacaccgctcttccggcaccggtacaagctgccgcaccagtacaggcctcctcgacggcccaaccccggccaccagcccagccccagacgctgttccagacccagccgctgctgcagaccacacctgccatcctcccgcagcccactgctgccaccgctgctgcccctacccccaagccagtggacacccccccacagatcaccgtccagcctgcaggcttcgcatttagcccaggaatcatcagtgctgcttccctcgggggacagacccagatcctggggtccctcactacagctccagtcattaccagcgccattcccagcatgccagggatcagcagtcagatcctcaccaatgctcagggacaggttattggaacccttccatgggtagtgaactcagctagtgtggcggccccagcaccagcccaaagcctgcaggtccaggccgtgaccccccagctgttgttgaacgcccagggccaggtgattgcgaccctggctagcagccccctgcctccacctgtggctgtccggaagccaagcacacctgagtcccctgctaagagtgaggtgcagcccatccagcccacaccaaccgtgccccagcctgctgtggtcattgccagcccagctccagccgccaagccatctgcctctgctcctatcccaattacctgctcagagacccccaccgtcagccagttggtgtccaagccacatactccaagtctggatgaggatgggatcaacttagaagagatccgggagtttgccaagaactttaagatccggcggctctcgctgggccttacacagacccaggtgggtcaggctctgactgcaacggaaggtccagcctacagccagtcagccatctgccggttcgagaagctagacatcacacccaagagtgcccagaagctaaagccggtgctggaaaagtggctaaacgaagctgaactgcggaaccaggaaggccagcagaacctgatggagtttgtgggaggcgagccctccaagaaacgcaaacgccgcacctccttcaccccccaggccatagaggctctcaatgcctattttgagaagaacccactgcccacaggccaggagatcactgaaattgctaaggagctcaactacgaccgtgaggtagtgcgggtctggttctgcaatcggcgccagacgctcaagaacaccagcaagctgaacgtctttcagatcccttagggctcagcccctggccctgtgttctagcactttgtccatttcccgtggcatccggctgcagccactgccatgacagcacctgtcattttgccacgtgcagctgtgctcaccccaggtcatcagactccaccgtgtgcatgtgcatcaatgtccctcttttctcccacacatctcacatcatggggaggccagagggggccacacgagagctccaggctctgggctggtcactccgaagaagaggatttgtgacgtcacttagagaagcaccttgctagcatggtttctgaagggtgaattctggtggggaaccagaaactccctgtctttggggcagggctaaagcagctcctaaggaccactggccattagctcttgcttttgatggcattctctttccaccttgtcttctcctttgctcctctgtgttagtgtggcaggtatgacaactcatccagtggaaacacagcctcacactgcccttccgccccccacactttgcctgcaggtgcaccgaaaggacctgggagataaaattcaaaaaagtgtgatgtgctgctcagaaggtcagactccatgtctgccttgacctcaaggtcagaaggttcccaaacccctggggctggaacatgggatctcctcttccacctcttcctggttcctttgcggggaaaattgcactaaaacagaaccttttcttaatccatgttggaaggaagcaacagtgaactctacctgttctggagttctcctgggtctgcagaaggttgggaatttagaaaataaggctgttctttcatattttaatttaatctctgtcaatggccatccctcccacaaaaaaacgtgggttaagagaacttgcagactggatatgcaagcaaacgggcaactctggagaaaaataaggaaaggaatgctgactttctctttctttctcttgtccccacacccattcccaacccaatactggggccttctcaaaaggagcaaattaaacaataaaccagacagcaaggccctgggggaaaggacaacatcctgaaataaatgatggagcccaggaaggtctcttgtggaagttgacttaactctaattttctttgtaactttaagccttggatacgggaggagaaatctcattttgtcgagtctcagaccatgtctgtgtgtaagcaatccccacagtgtcctctgagccaaggacacccccagatcagattgagttttgcttctagacggggtagctatggtaccttgggggttagctctcatccaagctgttaagtgagtttccagcctcactgtggctggaaagcccctaaaattcagtatgtaactccaggaagtcaggagagaactgagatttgcctagatgaccacaggcttgcggtgtagattatccctaaagggccccaagtcacgggggtcaaccacccctgtcttcagtactcttatccttacagaggctggtctctaacagctgcctccagtggacctcccatgatccaccctgagggaaggaccgtcagctggggacacatcaccacctctgtcagtcactggtgcagagccacctcctagcctagcttcctctggtgtcctgtttcctttcccacttactgttggtgcctcccaggccctgcagtgccagcgtggccaccctcttggtagcctggccagtaagaggaggacagttgtgtgctgaattagcacacgcacgtgcagcgcgcacagacgcgcgcacacacacacacatacacgctctgctgcatttggacaaaccatgcctgccagagtgtagcagaggtgaggaagcaggtgggcagcttgcctgacccagcttttcaggagagcgtgtctccaacagagagtctccacactctagttcagggttatcgacctgcctcaatgagatgacagactcatttgggaggggtgttgcaaacaagttttcagtgagaatagttaagttccagagcttgtaaaggattcagtgactgacacttcagtaaattaggccaggcacattggcttatgcctgtaattccaacactttggaaggccgaggtgggcggatcatttgaggtctggagttcgagaccagcctgaccaacatggtgaaaccccgtctctactaaaaatacaaaaattagccaggtgtggtagtgcacatctgtaatcccagctacttgggaggtggaggcaggagaattgcttgaaccctggaggttgcaatgagctgagatcacactacttcactccagcctgggtgacagagcaagactcggtctcaaacaaacaaaaacttatggcgatgcaggttttcatgctcagacgcttgcattcaggtatgctttcttttttgagagagacaaatgggtcacagctggcaccctgggaatagcacataatccagggtgtgtctgtggtggtggacgtgcaggggaacaccatctgtcctgtgtcatgatgggaaaacaatcatgaaccactggtctaaattaggcctggccatgctttctcagcccctccctcatttaaatttgtcttcccaaagctgagctaaaactaaaccatttctcctctgctggaatgatggattggtcattcagaggaacaataccaggggtgggaggtttgcaggctgagttccccaggcatgggggtgcagggtgtccctgaggtttacccaaagcacagctcgctggcctgtgacctctgcccttcctcccacagtgtaagaccccccaggaagcagctggggcctgaacctctcacctaggaggtaggtttattttattttttgttagcatcaggctctgaaggagttggtatacattttgttttgaaaacatcttctggacttacaccagagcttagtgtcgtctttactatggaaagagaggagaatggacagaaatggtttaactgtgtggagttttgtttgttttgttttaaatggaagaaagaccaaaactttcctggtggatcagctagggcctttgaccctgcattaccacggcattttatccaggtgaagtccagggaaagaactcagccaaatggactaaggaacacacgagtttggaatgcgagactctgacatttttgtgttcttggaaatccaattaccttcccatgcccagatttccttcctgcctcttggaccaggctctggcactgaggttctcactgttcccaacacagacaaagcttcctgagggctggaggggcagcaaggggagaggagaatggggaagaagcgcttgatgtagttgtgtggaataaacagtattttttcttttgtaaaaaaaaaaaaaaaaa

SEQ ID NO: 790 - DNA, 10049 bp, Homo sapiens
gcgccgcctccttcggcgttcgccccacggaccggcaggcggcggaccgcggcccaggctgaagctcagggccctgtctgctctgtggactcaacagtttgtggcaagacaagctcagaactgagaagctgtcaccacagttctggaggctgggaagttcaagatcaaagtgccagcagattcagtgtcatgtgaggacgtgcttcctgcttcatagataagagtagcttggagctcggcggcacaaccagcaccatctggtcgcgatggtggacacggaaagcccactctgccccctctccccactcgaggccggcgatctagagagcccgttatctgaagagttcctgcaagaaatgggaaacatccaagagatttcgcaatccatcggcgaggatagttctggaagctttggctttacggaataccagtatttaggaagctgtcctggctcagatggctcggtcatcacggacacgctttcaccagcttcgagcccctcctcggtgacttatcctgtggtccccggcagcgtggacgagtctcccagtggagcattgaacatcgaatgtagaatctgcggggacaaggcctcaggctatcattacggagtccacgcgtgtgaaggctgcaagggcttctttcggcgaacgattcgactcaagctggtgtatgacaagtgcgaccgcagctgcaagatccagaaaaagaacagaaacaaatgccagtattgtcgatttcacaagtgcctttctgtcgggatgtcacacaacgcgattcgttttggacgaatgccaagatctgagaaagcaaaactgaaagcagaaattcttacctgtgaacatgacatagaagattctgaaactgcagatctcaaatctctggccaagagaatctacgaggcctacttgaagaacttcaacatgaacaaggtcaaagcccgggtcatcctctcaggaaaggccagtaacaatccaccttttgtcatacatgatatggagacactgtgtatggctgagaagacgctggtggccaagctggtggccaatggcatccagaacaaggaggcggaggtccgcatctttcactgctgccagtgcacgtcagtggagaccgtcacggagctcacggaattcgccaaggccatcccaggcttcgcaaacttggacctgaacgatcaagtgacattgctaaaatacggagtttatgaggccatattcgccatgctgtcttctgtgatgaacaaagacgggatgctggtagcgtatggaaatgggtttataactcgtgaattcctaaaaagcctaaggaaaccgttctgtgatatcatggaacccaagtttgattttgccatgaagttcaatgcactggaactggatgacagtgatatctccctttttgtggctgctatcatttgctgtggagatcgtcctggccttctaaacgtaggacacattgaaaaaatgcaggagggtattgtacatgtgctcagactccacctgcagagcaaccacccggacgatatctttctcttcccaaaacttcttcaaaaaatggcagacctccggcagctggtgacggagcatgcgcagctggtgcagatcatcaagaagacggagtcggatgctgcgctgcacccgctactgcaggagatctacagggacatgtactgagttccttcagatcagccacaccttttccaggagttctgaagctgacagcactacaaaggagacgggggagcagcacgattttgcacaaatatccaccactttaaccttagagcttggacagtctgagctgtaggtaaccggcatattattccatatctttgttttaaccagtacttctaagagcatagaactcaaatgctgggggtaggtggctaatctcaggactgggaagattacggcgaattatgctcaatggtctgattttaactcacccgatgttaatcaatgcacattgctttagatcacattcgtgatttaccatttaattaactggtaacctcaaaattcgtggcctgtcttcccattcaccccgcttttgactattgtgctcctttataattctgaaaactaatcagcactttttaacaatgtttataatcctataagtctagatgtatccaaaggtgaagtatgtaaaaagcagcaaaatatttatttcaaagacttcacttctgtttcctgaatctaaagaaagacaacatgctgctttttaatcataggatggagaattttaaagaactgtttgggccaggcacagtcgctcatacttgtaatcccagcactttgggaggccgaggcgggtggatcacaaggtcagcagatcgagaccatcctggccaacatggtgaaaccctgtctctactaaaaatacaaaaattagccgggtgtggtggcacatgcctgtaatcccagctactcgggaagctgaggcaggagaattgcttgaaccagggagttggaggttgcagtgagctaagactgcaccactgcactccagcctggtgacagaacgagactctgtcttaaaaacaaacaaacaaaaaaaaaatctgttagataagctatcaaaatgcagctgttgttttgtttttggctcactgttttcgtggttgtaactaatatgtggaaaggcccatttccaggtttgcgtagaagagcccagaaaacagagtctcaagacccccgctctggactgtcataagctagcacccgtggtaagcgggacgagacaagctcccgaagcccgccagcttcctgctccactcagctccgtccagtcaacctgaacccacccagtccagctgtctgtgggaatggtggtgttcttagggacagactgacaccttacttgtcagtgttcctccgggccccatttggcagctcccgtatcttttgttatgttgcttttaaagatatgatgttttattgttttaactcttggtgacagtagatgctctctggagcgcagacgaggcacatgtgtcttcatagcctgggctgggtgggagccagtcaccctgcggatcgagagagggggtagagtcttcttcaaatggcagttttacttcaaatggcagatttcacaagagttggttattttttacaatggtttaggttgttaagtctcctttgtatgtaaggtagttttttcaacatctaaaatttttgttttagccttcaaaaccaacttaccaacctcagtccagctgggaaggcagcgttgattatggtagtttgtcaagaatatatggacctggaaacactttctctctctgtccacctggtagataaattgtcctgttgagaatttttagatctggactggaactgccaggaccaccgcctccagggagtcgctgggcacctggaggtatcgtcgatgcctctcccccatctttagaaaatttggctcttctgaggtcattattattttaagaatgattaggattgataagggtcccatgaccagcattatgaaaatgcgagagtgggaaggacacagtgtgagacttccactagaaaaaagtgaaagttagggttaggacatccttttttaaaaattacaaatttagtccgttttggtttttgtaatcaggctaggcacagtggctcacacatggaatcccagcactttgggaggccgaggtgggaggatcacttgagcccaggagttcgagaccagcctaggcaacatagcaagaccctgtctgtacacaaaatttaaaaattagttcatcggggtggcacacatcagtagtcccagctactctgcaggctgaggtgggaggattgcttgaacccaggaggtcgaggctgcagtgagctgtgatctcaccactgcattccagcctgggtgacagagttagattccaccctctcccaccccggcaaaaaaaaaaaaaaaagatgcaatcaaaggggctgttggccagcaatggcagcagcagcggcgggcagtctgcccaagtgtcttaggaaccaaaagcaaataaaagtgtttccatatatgccaccagccaagtggccatcctaattcagaaagaagctagcctttgagtgtctgtcatggtgcatccgtttcagtattatttcctaaaatgagaagcccctgtgtcaacaagatccaggggctggagcccaatgccaagcctgtgttgtccccagcgaccctgcagctgctcgctctgatgtaccctgtgccattcaaggagatgtggtccaggaaagtgagcctcatggttttcagagaagtcattgttctgtttacattttcataaaacctgtttaaaatagctccccgtctcaggctttcagcagtaacagtgagctgactggcaagttcgatgttagctcccgggacactcagcagcgatggtgagcattttggtttccttaaggcccagcaagacttccagggacatctctggtgaagccagaatggagacacccgtgacctcaggctgaaagtcactcgacattggtctcttgtgttgatagggaaggaaatcaggcattcctatttctttaaataacaaaaccactaattgccactcaatgctggaatattttgggtcacctaatcatagatttctcagggcatcaatactcaaatataggctgattatgccccagttcaaatgggaactattaacagagtgcatttcttgcttgctgggtttcaacagacatcagccaaaagaacaaaagagatgtcaggacagattccaggagtgtcggagcacatgtgtggcacccgctccctctggcagcgaatgtaggaagtcgccaaatttacccactcttcaacaagtcattgtttaaacacggtttttcattttctcaacttttaatagcaaaaagtgccaaagtcctcagagacctaacagccttggtctaccgtgctgaccagggtgaaggcacggcgagggactcctcccagacgtgcctcttgtgtgccagctggctgtggctcgggagcagacgcaggcctctccattgtccaggggagcctggcggcgcatccctcctctcccacctcctggcacttccagctgggtgtcccacatgttggattccgtccccaccacacttccagagaccggagaactgtgcagggcctaaggccgtttggatgaattgtcaaaacaagatgcttccagttacagcggcaggagcgggactgggagcacgggctgacggctgctggtgcctttcttcccacctcgcttgcctgtttccgcttgacccttcctccagctccgatgagaagagtataaagcatcttcctaacgggtgtgtttgctatacgaacataatggacgtgaagtggggcagaaacccagaactcagcattcaaggatgcccaggagagctgtccctgttttaaagagctgtgttttgttttgtttcgcatttagagagcagacaaggcacccttctgctgcgctgatacgtttcttacactgggccattttagacccccagggaaacagccttcctggagcgttgtctggaggttccagggacagggcagcctcccagagccgagcaagagctcaaggtacaaatgagagatttgctataccgtgagaagtcaacaacttagccaccacttccccgcaatggaccatgtaacaaatacctcagcaggccctgcaaaaggccatgctagagctgaggcgcacagcctgtggcctctgtagttagggcaggtgggatggagactccttgagtgcacacacctgagcctgcccacacacaggggagcagcatctcgtatgacgtctggaaggaacttcggttgtgtaaagggagccttgaagatacgtgcaaaaggtgctaccccaatttggtgaaactgacattgggcacgtcttgggcttaggagaagcggccgatggtcccggcctgcagtgacaaacccccctccccgcaccgcccccagcaccccctctcctcttcacctcttcctgctggccacgaggaagccacttcctcagagagaccctaccagatgcggatggaaacagatgcaccaaagcaagccctgatgaaaccgcgacttcctaaggtctgtctcctctgaacttgcacctgggcctctctgtgtttggttccaagcacttcccacctcaaactcccattttcaaaccactgtatctctgcgcacatctgctacttaccagccgcatacatgatggagggttttttggtcctgatccagtggccacacctgtctttgaaatgtctcactgaactccagttttaaaatagattcattgcttcaacacagcaagcccaatgcacccagctaagactggcttgaccgacagcctggcctttggtggggggcttcctggggcctggggaaagctggccaccttcaacagctggtacctcttcaacagtgtggcctttcaaaatgcagatgccaccaggagaacatgcccacagctcaccacctatggatgccatggctctgggcagctttcaaagcaggttcctgtggtctcctcagctgtttgagggggtaacagcaaatcagcctccattttaaaatgaaaacaccagcctccagatgtagggcctgctgggtgttgctagccgctggtccccaggcacggtgcactttctccacctcctgcagcctccctgttgtttctagactcttgcacctggtgagtgcaaggataggtgacccaggggcctgcagccttgtcctcagctcccatctcctggactgccagcctcaccctctgcagttagcatggttggcctgatgcagggatcccgagggattactttttagaccttctttcacattcagaaaagtagtatagattcaggagaggcaagaaaattatgctgtccatagaagtcacccatgaagactgatgccaccacctgaaggctcatgattgttaaaaatgtccacgggaacctctcgtccacaggaggtttgtctcaacacttcccatttttacggcattggcattgccaagcatggggaagtatctgctcttctcatgttaaaagtggcccagcttttcttaactcagtccaagctgacttgtttagctgcactggaatttcttaccaaccaaatatttgcatcgagcaaagggggctgtgtgcacctccctaatggcagcgatgatggctgctgtcattcaagcccatcttcagacgtcacagtctggaagtgaaatgtccacaaacatctgtggcagaaaaggctatacggaccacccagttgtgctgcagctttacagagcaaggaagggttgtggcaaataaatgattaacctgcctcgactgtgctgagggcaacaaaggccatctcaccaaaggattattcgatgccattaaatcatcccgtgaccttcctgcttccgagtccatggcctttgcccagggcatgtactcccctgagaggccttctgcctagaaagatctatgactgggttccaaagttgaggcctaggtttttgctgggatttagatattttcaggcaccattttgacagcattcaggaaaacggttattgaccccatagactagggtaagaataaaggcaataaatttggtctgactcagaatataggagatccatatatttctctggaaaccacagtgtacactaaaatgtgaaattgaaggttttgttaaaaagaaaaagataatgagcttcatgctttgtttaattacataatgatttccattacgctatttctgtgaaatgcagcaggttcttaaacgttatttcagtggcatgggctggaagcttatcacaaaaagccatgtgtgtggccttatcagaacagaaagagacaggctggtgcccaaggctgctgcctgctccaccttttgccagctctggacatctgaggacgtcccggcagatctggaatggggccctcaactgaccatttgcttctcagaatttcagtttgagacatgagaggtataatcagttacttttctccccccagagaaacccttttgtgaggggagaggagctatggtatgtggttcagctgaaacacatacaactgcatccttttggagtcctttgccaacaaaaacagaccaacagaccagatggtgtccatgttcaatatcatgtcttgatggacgcagctgatgacctcaaatacttgagtggtctcatggctgttagatggattatttgaaaaaaaaaaaaaaaaaagagagaaaaaataattgatttttacatcagagatagcaaactaagacctggggaggggggtcagcttttattttattttattttttttaagtttgctagttgggtcaaatgtgaggaggagggagtctacctgccacctcttctcttgcccctcttctgcccacacatccagcatccaaaatccattcatttaatgaattgataaagtgccgtgcaaactggtgcacaaacaggcccccagtccacgcagcctggctcctaggaaaagtggtgaccgggcgtgggggggcatgccgcagccctgggacacagtcgggcaccttccccggacccccaggccttggctgtgcctcaagtcagagagggtcagccttcaggccccggagacgagtgactggccgatcatttcacaataaaatcactcacttttggcaacttcactttttttaaggcacagtcagttccttttctcatgtacctcacaaaagatgaagaccatgtagtactctttttggtaaagttacagtgttcatgttaaatatcacttttttctacattgtgtggtaaaaagaactacgttaatagctatatcttaaatactgtgatttgactttttgaaaaatatcctaatacaaatattttactaacttacaatcactcatttaataagaaacatttggattcttttgaaatcagtgttaattgactcatattcttaaaagcctggctcttgaccctattggaaacacaaaggaagctgaaatcaaacatctaaaatacactgcgtacacgtgtgcgtgcacacacacacacacacacacacacacacagctcttcatttctcctgagccatgcagaatttactttcaatgtggaaatctgttccctttaccacactgtatatgcacagagcacaagagaggctatctctagtcacttccaccagcgaggccttagactccgtattagaggccaccgatttcatacaacagtgtttcgctaaagacccttcactattcttgtttagtaaatagctgtctgctcttcagggaactgttacctatgggttattaccaaagaacgctggcaattggaaatgtcctgatggaaattctttgcacgtgccggttctctggcatcctccaggtggcccaacccaaagcagaaagcagaaaccacagaccccgtgagtctccccataccttgtttccaataacttggcaaaacttcttggtgcatattggttacaccctctgggattcataatgccattaggctaaaaccctaagagagagggttgacagaaacacacgcgagaatgaggcagatcccagagcaaggactgggcccagactctccacatgtgctctactagtgagtgccttatactctcagtattttggggcttacagcttcttatttgtgctaaaaaggtgcagttccaaagtaggaactgccacacaggccccagcatcctctctccaacttcatacctctctcctggtggggggagcgggcatccaggacctccggaatcaaggatgtgcagagaagagcgaaagtaatttttctagtcacatgaactgattggttccaggcaattagaaaatggctataaaataaccttaattttaaaaaaaaatcttgggtcttcgttttcctattaggagactgaactgaccacatgtattgatttatatcctgaatatatgggaacttctgtgtttgggatgtcctactgtaagactgatgaatgtacagagttaatttcagggtacagttttgccttaatggttttaaaaaataaactattttttaaaatttt

SEQ ID NO: 791 - DNA, 8148 bp, Homo sapiens
gcgaattttgggaagttccgttggggaagatggcggcggcctcgagcacccttctcttcttgccgccggggacttcagattgatccttcccgggaagagtagggactgctggtgccctgcgtcccgggatcccgagccaacttgtttcctccgttagtggtggggaagggcttatccttttgtggcggatctagcttctcctcgccttcaggatgaaagctcagggggaaaccgaggagtcagaaaagctgagtaagatgagttctctcctggaacggctccatgcaaaatttaaccaaaatagaccctggagtgaaaccattaagcttgtgcgtcaagtcatggagaagagggttgtgatgagttctggagggcatcaacatttggtcagctgtttggagacattgcagaaggctctcaaagtaacatctttaccagcaatgactgatcgtttggagtccatagcaagacagaatggactgggctctcatctcagtgccagtggcactgaatgttacatcacgtcagatatgttctatgtggaagtgcagttagatcctgcaggacagctttgtgatgtaaaagtggctcaccatggggagaatcctgtgagctgtccggagcttgtacagcagctaagggaaaaaaattttgatgaattttctaagcaccttaagggccttgttaatctgtataaccttccaggggacaacaaactgaagactaaaatgtacttggctctccaatccttagaacaagatctttctaaaatggcaattatgtactggaaagcaactaatgctggtcccttggataagattcttcatggaagtgttggctatctcacaccaaggagtgggggtcatttaatgaacctgaagtactatgtctctccttctgacctactggatgacaagactgcatctcccatcattttgcatgagaataatgtttctcgatctttgggcatgaatgcatcagtgacaattgaaggaacatctgctgtgtacaaactcccaattgcaccattaattatggggtcacatccagttgacaataaatggaccccttccttctcctcaatcaccagtgccaacagtgttgatcttcctgcctgtttcttcttgaaatttccccagccaatcccagtatctagagcatttgttcagaaactgcagaactgcacaggaattccattgtttgaaactcaaccaacttatgcacccctgtatgaactgatcactcagtttgagctatcaaaggaccctgaccccatacctttgaatcacaacatgagattttatgctgctcttcctggtcagcagcactgctatttcctcaacaaggatgctcctcttccagatggccgaagtctacagggaacccttgttagcaaaatcacctttcagcaccctggccgagttcctcttatcctaaatctgatcagacaccaagtggcctataacaccctcattggaagctgtgtcaaaagaactattctgaaagaagattctcctgggcttctccaatttgaagtgtgtcctctctcagagtctcgtttcagcgtatcttttcagcaccctgtgaatgactccctggtgtgtgtggtaatggatgtgcaggactcaacacatgtgagctgtaaactctacaaagggctgtcggatgcactgatctgcacagatgacttcattgccaaagttgttcaaagatgtatgtccatccctgtgacgatgagggctattcggaggaaagctgaaaccattcaagccgacaccccagcactgtccctcattgcagagacagttgaagacatggtgaaaaagaacctgcccccggctagcagcccagggtatggcatgaccacaggcaacaacccaatgagtggtaccactacaccaaccaacacctttccggggggtcccattaccaccttgtttaatatgagcatgagcatcaaagatcggcatgagtcggtgggccatggggaggacttcagcaaggtgtctcagaacccaattcttaccagtttgttgcaaatcacagggaacggggggtctaccattggctcgagtccgacccctcctcatcacacgccgccacctgtctcttcgatggccggcaacaccaagaaccacccgatgctcatgaaccttcttaaagataatcctgcccaggatttctcaaccctttatggaagcagccctttagaaaggcagaactcctcttccggctcaccccgcatggaaatatgctcggggagcaacaagaccaagaaaaagaagtcatcaagattaccacctgagaaaccaaagcaccagactgaagatgactttcagagggagctattttcaatggatgttgactcacagaaccctatctttgatgtcaacatgacagctgacacgctggatacgccacacatcactccagctccaagccagtgtagcactcccccaacaacttacccacaaccagtacctcacccccaacccagtattcaaaggatggtccgactatccagttcagacagcattggcccagatgtaactgacatcctttcagacattgcagaagaagcttctaaacttcccagcactagtgatgattgcccagccattggcacccctcttcgagattcttcaagctctgggcattctcagagtaccctgtttgactctgatgtctttcaaactaacaataatgaaaatccatacactgatccagctgatcttattgcagatgctgctggaagccccagtagtgactctcctaccaatcatttttttcatgatggagtagatttcaatcctgatttattgaacagccagagccaaagtggttttggagaagaatattttgatgaaagcagccaaagtggggataatgatgatttcaaaggatttgcatctcaggcactaaatactttgggggtgccaatgcttggaggtgataatggggagaccaagtttaagggcaataaccaagccgacacagttgatttcagtattatttcagtagccggcaaagctttagctcctgcagatcttatggagcatcacagtggtagtcagggtcctttactgaccactggggacttagggaaagaaaagactcaaaagagggtaaaggaaggcaatggcaccagtaatagtactctctcggggcccggattagacagcaaaccagggaagcgcagtcggaccccttctaatgatgggaaaagcaaagataagcctccaaagcggaagaaggcagacactgagggaaagtctccatctcatagttcttctaacagaccttttaccccacctaccagtacaggtggatctaaatcgccaggcagtgcaggaagatctcagactcccccaggtgttgccacaccacccattcccaaaatcactattcagattcctaagggaacagtgatggtgggcaagccttcctctcacagtcagtataccagcagtggttctgtgtcttcctcaggcagcaaaagccaccatagccattcttcctcctcttcctcatctgcttccacctcagggaagatgaaaagcagtaaatcagaaggttcatcaagttccaagttaagtagcagtatgtattctagccaggggtcttctggatctagccagtccaaaaattcatcccagtctggggggaagccaggctcctctcccataaccaagcatggactgagcagtggctctagcagcaccaagatgaaacctcaaggaaagccatcatcacttatgaatccttctttaagtaaaccaaacatatccccttctcattcaaggccacctggaggctctgacaagcttgcctctccaatgaagcctgttcctggaactcctccatcctctaaagccaagtcccctatcagttcaggttctggtggttctcatatgtctggaactagttcaagctctggcatgaagtcatcttcagggttaggatcctcaggctcgttgtcccagaaaactcccccatcatctaattcctgtacggcatcttcctcctccttttcctcaagtggctcttccatgtcatcctctcagaaccagcatgggagttctaaaggaaaatctcccagcagaaacaagaagccgtccttgacagctgtcatagataaactgaagcatggggttgtcaccagtggccctgggggtgaagacccactggacggccagatgggggtgagcacaaattcttccagccatcctatgtcctccaaacataacatgtcaggaggagagtttcagggcaagcgtgagaaaagtgataaagacaaatcaaaggtttccacctccgggagttcagtggattcttctaagaagacctcagagtcaaaaaatgtggggagcacaggtgtggcaaaaattatcatcagtaagcatgatggaggctcccctagcattaaagccaaagtgactttgcagaaacctggggaaagtagtggagaagggcttaggcctcaaatggcttcttctaaaaactatggctctccactcatcagtggttccactccaaagcatgagcgtggctctcccagccatagtaagtcaccagcatataccccccagaatctggacagtgaaagtgagtcaggctcctccatagcagagaaatcttatcagaatagtcccagctcagacgatggtatccgaccacttccagaatacagcacagagaaacataagaagcacaaaaaggaaaagaagaaagtaaaagacaaagatagggaccgagaccgggacaaagaccgagacaagaaaaaatctcatagcatcaagccagagagttggtccaaatcacccatctcttcagaccagtccttgtctatgacaagtaacacaatcttatctgcagacagaccctcaaggctcagcccagactttatgattggggaggaagatgatgatcttatggatgtggccctgattgggaattaggaaccttatttcctaaaagaaacagggccagaggaaaaaaaactattgataagtttataggcaaaccaccataaggggtgagtcagacaggtctgatttggttaagaatcctaaatggcatggctttgacatcaagctgggtgaattagaaaggcatatccagaccctattaaagaaaccacagggtttgattctggttaccaggaagtcttctttgttcctgtgccagaaagaaagttaaaatacttgcttaagaaagggaggggggtgggaggggtgtagggagagggaagggagggaaacagttttgtgggaaatattcatatatattttcttctccctttttccatttttaggccatgttttaaactcattttagtgcatgtatatgaagggctgggcagaaaatgaaaaagcaatacattccttgatgcatttgcatgaaggttgttcaactttgtttgaggtagttgtccgtttgagtcatgggcaaatgaaggactttggtcattttggacacttaagtaatgtttggtgtctgtttcttaggagtgactgggggagggaagattattttagctatttatttgtaatattttaaccctttatctgtttgtttttatacagtgtttcgttctaaatctatgaggtttagggttcaaaatgatggaaggccgaagagcaaggcttatatggtggtagggagcttatagcttgtgctaatactgtagcatcaagcccaagcaaattagtcagagcccgcctttagagttaaatataatagaaaaaccaaaatgatatttttattttaggagggtttaaatagggttcagagatcataggaatattaggagttacctctctgtggaggtattgacttgtaatctcattttcctttcaaaaaaaaaaaaaaaagctaaggtggcttgttgggatgtaaacatgttttcagatgcagtaaggtttagtgtaggacagccttcctgacccagtggcatgaaaaccattacaggattaatagttctcctacttccacaatgtgccaaaagtctgcatcccagcattttgtttgcaggagaactgatgccattcctaagagctggactcactgtttctcttcatcacaaggagaaggagtccaaactttaatcactccactgtatgctccctgagataaaacagtaaaaaatccgcagccatagttcacttaaaacaatttcaagctcacttttgaagtaatgggggcctggaatgctaggtgagcatgaagataaacccttgctactatgtagcaacccaattggacctttttggagaaataggtctgagtctggattctgggggacatcaataagagcccttcacataaaaatatagaaatccaggagactgtttcgagtgcaacagaagttctcagtatttggagggtcctctcaaaaattctgcggccttactttgatattgacacctgcactgtgccattcctgattattccattcaggatctgtatcagcgggatggggcatggtccccagcacaactcttctgggttaaaaaaaaaaagccaggtgattcctttgtgtgttatgtcgtaagtggagtgacttcatcatatatggaagaagatttctatattcagctttttctgcaggttggagtcagcatagagttggaaaatcagctttggctttctttcctgtctcatttcctctagtgttctcctttttattgtcatcagctctcaacaactctgccacttttgtgtcccaaggtaataagatgtaggaaacaaaacattgtaaagtggagcaagaaaagttatcaattaaccacatcagagtcaaatgtcttgggtgacactaaggaggatatgggcaggtgataccagagtgctttatcttgtgatgttgatacagtagcagcctctcagacattcagccaggttggatttctcatgagtttgtcacctagttttgaatcctatcccgttggtttctgcaggaaaaaaaaaaaaatttatgtggtttttaaaatttgttctgagtggggagaatcttagggggaatgtactgaatagtatcatgggctcagctcccccatgcagggccaacaaataccaaaatgagtaaactgggaagcttttctctctttctgtcttcatcccagatcaaagaatcccgagttaggatctggatgaaggataagcccctgaattgtcgatgggctcacccccacactgacccagcatctgaacttgcttaacagggagccggggctaaactgcttcaccctgcctgagaaccagggagcactgcatttctccacagggtggaggagaagaggcagaataaaccaagcctgggacacctccctcctgtctaggtgtactcattcttctgtttcaaaagaaggcaaggacatgaagtcaacttctacctatcttctgctgctggtgtcttatgtattctcagtttgacctgattcctcttctgtcttttgacttaacattaggggttcttggtcataacctgctctgatgtacataaagatttcaggttcaatatcaatgtgtcttaaaacagaagtattttagcgggtggggggtggggtggtggggacaaacaacgcaggatataattgccaaaaccaggcttgaggttggtgactcttgaaagattttctttcttcaggcctagatcagaaaattaagtgcagcaatatcatgaattctcagaagccctttcagggagccagtgagtcatacagtatccacagttgagtcacttaaagatgtcagtatacgaaacattattcacaatccttgggcaatctcatttttttttccttctcccctcctcccctgccccccatacatttctatccttgagttagttttggaggggcaggaagtacttaacatctcagaagctagattgggaaacatgctcagctataagaactgagctttaaattttgagtttaaaaatgtacatcaggagcagctggggagggtctttttttaaaaaaatctttcaaatttggttttctgtgcatatggccgttttgtaaatactttggggtttttcatttttttgaaagtagatgaaatctgttgtgggatttttttcccgaaacattacaaaataacctgtttatttacatgcaaataaacttctttgataaaaagtaa

SEQ ID NO: 792 - DNA, 3749 bp, Homo sapiens
gcggagcgtgtgacgctgcggccgccgcggacctggggattaatgggaaaagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaagagctgactggaaaa

SEQ ID NO: 793 - DNA, 1818 bp, Homo sapiens
ggcgcccgcgcccgcccccgcgccgggcccggctcggcccgacccggctccgccgcgggcaggcggggcccagcgcactcggagcccgagcccgagccgcagccgccgcctggggcgcttgggtcggcctcgaggacaccggagaggggcgccacgccgccgtggccgcagaaatgaccatggttgacacagagatgccattctggcccaccaactttgggatcagctccgtggatctctccgtaatggaagaccactcccactcctttgatatcaagcccttcactactgttgacttctccagcatttctactccacattacgaagacattccattcacaagaacagatccagtggttgcagattacaagtatgacctgaaacttcaagagtaccaaagtgcaatcaaagtggagcctgcatctccaccttattattctgagaagactcagctctacaataagcctcatgaagagccttccaactccctcatggcaattgaatgtcgtgtctgtggagataaagcttctggatttcactatggagttcatgcttgtgaaggatgcaagggtttcttccggagaacaatcagattgaagcttatctatgacagatgtgatcttaactgtcggatccacaaaaaaagtagaaataaatgtcagtactgtcggtttcagaaatgccttgcagtggggatgtctcataatgccatcaggtttgggcggatgccacaggccgagaaggagaagctgttggcggagatctccagtgatatcgaccagctgaatccagagtccgctgacctccgggccctggcaaaacatttgtatgactcatacataaagtccttcccgctgaccaaagcaaaggcgagggcgatcttgacaggaaagacaacagacaaatcaccattcgttatctatgacatgaattccttaatgatgggagaagataaaatcaagttcaaacacatcacccccctgcaggagcagagcaaagaggtggccatccgcatctttcagggctgccagtttcgctccgtggaggctgtgcaggagatcacagagtatgccaaaagcattcctggttttgtaaatcttgacttgaacgaccaagtaactctcctcaaatatggagtccacgagatcatttacacaatgctggcctccttgatgaataaagatggggttctcatatccgagggccaaggcttcatgacaagggagtttctaaagagcctgcgaaagccttttggtgactttatggagcccaagtttgagtttgctgtgaagttcaatgcactggaattagatgacagcgacttggcaatatttattgctgtcattattctcagtggagaccgcccaggtttgctgaatgtgaagcccattgaagacattcaagacaacctgctacaagccctggagctccagctgaagctgaaccaccctgagtcctcacagctgtttgccaagctgctccagaaaatgacagacctcagacagattgtcacggaacacgtgcagctactgcaggtgatcaagaagacggagacagacatgagtcttcacccgctcctgcaggagatctacaaggacttgtactagcagagagtcctgagccactgccaacatttcccttcttccagttgcactattctgagggaaaatctgacacctaagaaatttactgtgaaaaagcattttaaaaagaaaaggttttagaatatgatctattttatgcatattgtttataaagacacatttacaatttacttttaatattaaaaattaccatattatgaaattgctgatagta

SEQ ID NO: 794 - DNA, 6318 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgacttggatacagacagctttctgggtggactcaagtggtgcagtgaccaatcagaaataatatccaatcagtacaacaatgagccttcaaacatatttgagaagatagatgaagagaatgaggcaaacttgctagcagtcctcacagagacactagacagtctccctgtggatgaagacggattgccctcatttgatgcgctgacagatggagacgtgaccactgacaatgaggctagtccttcctccatgcctgacggcacccctccaccccaggaggcagaagagccgtctctacttaagaagctcttactggcaccagccaacactcagctaagttataatgaatgcagtggtctcagtacccagaaccatgcaaatcacaatcacaggatcagaacaaaccctgcaattgttaagactgagaattcatggagcaataaagcgaagagtatttgtcaacagcaaaagccacaaagacgtccctgctcggagcttctcaaatatctgaccacaaacgatgaccctcctcacaccaaacccacagagaacagaaacagcagcagagacaaatgcacctccaaaaagaagtcccacacacagtcgcagtcacaacacttacaagccaaaccaacaactttatctcttcctctgaccccagagtcaccaaatgaccccaagggttccccatttgagaacaagactattgaacgcaccttaagtgtggaactctctggaactgcaggcctaactccacccaccactcctcctcataaagccaaccaagataacccttttagggcttctccaaagctgaagtcctcttgcaagactgtggtgccaccaccatcaaagaagcccaggtacagtgagtcttctggtacacaaggcaataactccaccaagaaagggccggagcaatccgagttgtatgcacaactcagcaagtcctcagtcctcactggtggacacgaggaaaggaagaccaagcggcccagtctgcggctgtttggtgaccatgactattgccagtcaattaattccaaaacagaaatactcattaatatatcacaggagctccaagactctagacaactagaaaataaagatgtctcctctgattggcaggggcagatttgttcttccacagattcagaccagtgctacctgagagagactttggaggcaagcaagcaggtctctccttgcagcacaagaaaacagctccaagaccaggaaatccgagccgagctgaacaagcacttcggtcatcccagtcaagctgtttttgacgacgaagcagacaagaccggtgaactgagggacagtgatttcagtaatgaacaattctccaaactacctatgtttataaattcaggactagccatggatggcctgtttgatgacagcgaagatgaaagtgataaactgagctacccttgggatggcacgcaatcctattcattgttcaatgtgtctccttcttgttcttcttttaactctccatgtagagattctgtgtcaccacccaaatccttattttctcaaagaccccaaaggatgcgctctcgttcaaggtccttttctcgacacaggtcgtgttcccgatcaccatattccaggtcaagatcaaggtctccaggcagtagatcctcttcaagatcctgctattactatgagtcaagccactacagacaccgcacgcaccgaaattctcccttgtatgtgagatcacgttcaagatcgccctacagccgtcggcccaggtatgacagctacgaggaatatcagcacgagaggctgaagagggaagaatatcgcagagagtatgagaagcgagagtctgagagggccaagcaaagggagaggcagaggcagaaggcaattgaagagcgccgtgtgatttatgtcggtaaaatcagacctgacacaacacggacagaactgagggaccgttttgaagtttttggtgaaattgaggagtgcacagtaaatctgcgggatgatggagacagctatggtttcattacctaccgttatacctgtgatgcttttgctgctcttgaaaatggatacactttgcgcaggtcaaacgaaactgactttgagctgtacttttgtggacgcaagcaatttttcaagtctaactatgcagacctagattcaaactcagatgactttgaccctgcttccaccaagagcaagtatgactctctggattttgatagtttactgaaagaagctcagagaagcttgcgcaggtaacatgttccctagctgaggatgacagagggatggcgaatacctcatgggacagcgcgtccttccctaaagactattgcaagtcatacttaggaatttctcctactttacactctctgtacaaaaacaaaacaaaacaacaacaatacaacaagaacaacaacaacaataacaacaatggtttacatgaacacagctgctgaagaggcaagagacagaatgatatccagtaagcacatgtttattcatgggtgtcagctttgcttttcctggagtctcttggtgatggagtgtgcgtgtgtgcatgtatgtgtgtgtgtatgtatgtgtgtggtgtgtgtgcttggtttaggggaagtatgtgtgggtacatgtgaggactgggggcacctgaccagaatgcgcaagggcaaaccatttcaaatggcagcagttccatgaagacacgcttaaaacctagaacttcaaaatgttcgtattctattcaaaaggaaatatatatatatatatatatatatatatatatatatataaattaaaaaggaaagaaaactaacaaccaaccaaccaaccaaccaaccacaaaccaccctaaaatgacagccgctgatgtctgggcatcagcctttgtactctgtttttttaagaaagtgcagaatcaacttgaagcaagctttctctcataacgtaatgattatatgacaatcctgaagaaaccacaggttccatagaactaatatcctgtctctctctctctctctctctctctcttttttttttctttttccttttgccatggaatctgggtgggagaggatactgcgggcaccagaatgctaaagtttcctaacattttgaagtttctgtagttcatccttaatcctgacacccatgtaaatgtccaaaatgttgatcttccactgcaaatttcaaaagccttgtcaatggtcaagcgtgcagcttgttcagcggttctttctgaggagcggacaccgggttacattactaatgagagttgggtagaactctctgagatgtgttcagatagtgtaattgctacattctctgatgtagttaagtatttacagatgttaaatggagtatttttattttatgtatatactatacaacaatgttcttttttgttacagctatgcactgtaaatgcagccttcttttcaaaactgctaaatttttcttaatcaagaatattcaaatgtaattatgaggtgaaacaattattgtacactaacatatttagaagctgaacttactgcttatatatatttgattgtaaaaacaaaaagacagtgtgtgtgtctgttgagtgcaacaagagcaaaatgatgctttccgcacatccatcccttaggtgagcttcaatctaagcatcttgtcaagaaatatcctagtcccctaaaggtattaaccacttctgcgatatttttccacattttcttgtcgcttgtttttctttgaagttttatacactggatttgttaggggaatgaaattttctcatctaaaatttttctagaagatatcatgattttatgtaaagtctctcaatgggtaaccattaagaaatgtttttattttctctatcaacagtagttttgaaactagaagtcaaaaatctttttaaaatgctgttttgttttaatttttgtgattttaatttgatacaaaatgctgaggtaataattatagtatgatttttacaataattaatgtgtgtctgaagactatctttgaagccagtatttctttcccttggcagagtatgacgatggtatttatctgtattttttacagttatgcatcctgtataaatactgatatttcattcctttgtttactaaagagacatatttatcagttgcagatagcctatttattataaattatgagatgatgaaaataataaagccagtggaaattttctacctaggatgcatgacaattgtcaggttggagtgtaagtgcttcatttgggaaattcagcttttgcagaagcagtgtttctacttgcactagcatggcctctgacgtgaccatggtgttgttcttgatgacattgcttctgctaaatttaataaaaacttcagaaaaacctccattttgatcatcaggatttcatctgagtgtggagtccctggaatggaattcagtaacatttggagtgtgtattcaagtttctaaattgagattcgattactgtttggctgacatgacttttctggaagacatgatacacctactactcaattgttcttttcctttctctcgcccaacacgatcttgtaagatggatttcacccccaggccaatgcagctaattttgatagctgcattcatttatcaccagcatattgtgttctgagtgaatccactgtttgtcctgtcggatgcttgcttgattttttggcttcttatttctaagtagatagaaagcaataaaaatactatgaaatgaaagaacttgttcacaggttctgcgttacaacagtaacacatctttaatccgcctaattcttgttgttctgtaggttaaatgcaggtattttaactgtgtgaacgccaaactaaagtttacagtctttctttctgaattttgagtatcttctgttgtagaataataataaaaagactattaagagcaataaattatttttaagaaatcgagatttagtaaatcctattatgtgttcaaggaccacatgtgttctctattttgcctttaaatttttgtgaaccaattttaaatacattctcctttttgccctggattgttgacatgagtggaatacttggtttcttttcttacttatcaaaagacagcactacagatatcatattgaggattaatttatcccccctacccccagcctgacaaatattgttaccatgaagatagttttcctcaatggacttcaaattgcatctagaattagtggagcttttgtatcttctgcagacactgtgggtagcccatcaaaatgtaagctgtgctcctctcatttttatttttatttttttgggagagaatatttcaaatgaacacgtgcaccccatcatcactggaggcaaatttcagcatagatctgtaggatttttagaagaccgtgggccattgccttcatgccgtggtaagtaccacatctacaattttggtaaccgaactggtgctttagtaatgtggatttttttcttttttaaaagagatgtagcagaataattcttccagtgcaacaaaatcaattttttgctaaacgactccgagaacaacagttgggctgtcaacattcaaagcagcagagagggaactttgcactattggggtatgatgtttgggtcagttgataaaaggaaaccttttcatgcctttagatgtgagcttccagtaggtaatgattatgtgtcctttcttgatggctgtaatgagaacttcaatcactgtagtctaagacctgatctatagatgacctagaatagccatgtactataatgtgatgattctaaatttgtacctatgtgacagacattttcaataatgtgaactgctgatttgatggagctactttaagatttgtaggtgaaagtgtaatactgttggttgaactatgctgaagagggaaagtgagcgattagttgagcccttgccgggccttttttccacctgccaattctacatgtattgttgtggttttattcattgtatgaaaattcctgtgattttttttaaatgtgcagtacacatcagcctcactgagctaataaagggaaacgaatgtttcaaatcta

SEQ ID NO: 795 - DNA, 5165 bp, Homo sapiens
gggaagccagacggttaacacagacaaagtgctgccgtgacactcggccctccagtgttgcggagaggcaagagcagcgaccgcggcacctgtccgcccggagctgggacgcgggcgcccgggcggccggacgaagcgaggagggaccgccgaggtgcgcgtctgtgcggctcagcctggcgggggacgcggggagaatgtggactgggtagagatgaacgagacttttctcagatgttggatatttgcttggaaaaacgtgtgggtacgaccttggctgcccccaagtgtaactccagcactgtgaggtttcagggattggcagaggggaccaaggggaccatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggctttaccaacctgtctctccctccaaaagagcagaatcctcccaccgccctgccctccccaccgagtcctgtggccattcagagcggccacatgacttttgcatccattgtattatcagaaaatgtgaagaagaaaaaaatgccatgttttaaaaccactgcgaaaatttccccaaagcataggtggctttgtgtgtgtgcgatttgggggcttgagtctgggtggtgttttgttgttggtttttgttgctttttttttttttttttttttaatgtcaaaattgcacaaacatggtgctctaccaggaaggattcgaggtagataggctcaggccacactttaaaaacaaacacacaaacaacaaaaaacgggtattctagtcatcttggggtaaaagcgggtaatgaacattcctatccccaacacatcaattgtattttttctgtaaaactcagattttcctcagtatttgtgtttttacattttatggttaatttaatggaagatgaaagggcattgcaaagttgttcaacaacagttacctcattgagtgtgtccagtagtgcaggaaatgatgtcttatctaatgatttgcttctctagaggagaaaccgagtaaatgtgctccagcaagatagactttgtgttattctatcttttattctgctaagcccaaagattacatgttggtgttcaaagtgtagcaaaaaatgatgtatatttataaatctatttataccactatatcatatgtatatatatttataaccacttaaattgtgagccaagccatgtaaaagatctactttttctaagggcaaaaaaaaaaaaaaaaaaaaaagaacactcctttctgagactttgcttaatacttggtgacctcacaatcacgtcggtatgattgggcacccttgcctactgtaagagaccctaaaaccttggtgcagtggtggggaccacaaaacaaccagggaggaagagatacatcattttttagtattaaggaccatctaagacagctctattttttttttgccactttatgattatgtggtcacacccaagtcacagaaataaaaaactgactttaccgctgcaatttttctgttttcctccttactaaatactgatacattactccaatctattttataattatatttgacattttgttcacatcaactaatgttcacctgtagaagagaacaaatttcgaataatccagggaaacccaagagccttactggtcttctgtaacttccaagactgacagctttttatgtatcagtgtttgataaacacagtccttaactgaaggtaaaccaaagcatcacgttgacattagaccaaatacttttgattcccaactactcgtttgttctttttctccttttgtgctttcccatagtgagaatttttataaagacttcttgcttctctcaccatccatccttctcttttctgcctcttacatgtgaatgttgagcccacaatcaacagtggttttattttttcctctactcaaagttaaaactgaccaaagttactggctttttactttgctagaacaacaaactatcttatgtttacatactggtttacaatgttatttatgtgcaaattgtcaaaatgtaaattaaatataaatgttcatgctttaccaaaat

SEQ ID NO: 796 - DNA, 6341 bp, Homo sapiens
actctgcggcgggaagaaccacctggaggtggcggggggggttgatttctatcacccctagggagagaggatcggggacccgctgatcttccagctcccctcacccaacgtcgtgcatgctgcagacagacctttccgtccttcatgaacacacgtgtggtagacagatgactgtcctgtaccctgtgctgctctaggtgtgccagacgtggagctgtccagttgggagaagatggattccaaagatgaaagctcgcatgtgtggccgacatctgcagagcatgaacagaatgccgcacaggtgcactttgttccggacacaggaacagtggctcagattgtctataccgatgaccaggttcgccccccacagcaggtggtgtacacggcagatggtgcctcctacacatcagtggatggtccagagcacacgctggtgtacatccacccggtggaagctgcacagactctgtttacagaccccggccaggtagcttatgtccaacaggatgctacagctcagcaggcctcattgccagttcataaccaggtgctgccttccatcgagagtgtagatgggtccgaccctttggcaactctgcagacccctctaggcagactggaggccaaagaggaagaggatgaggatgaggacgaggacactgaggaagatgaggaagaagacggtgaggacacggatctggatgactgggagccagacccgccccggcccttcgacccacacgacttgtggtgtgaggagtgcaataacgcgcatgcttcagtgtgtccgaagcacggccccttgcacccgatccccaaccggccggtgctcacccgggccagggcgagcctccccctggtgctctacatagacaggtttctgggcggggtgttctccaagcggcgcatccccaagcgcacccagtttggccccgtggaggggcctctcgtcaggggctcggagctgaaagactgttacattcacctcaaggtttctcttgataaaggggacaggaaagaaagggatttacatgaagacctatggtttgagttgtctgatgagacgctttgtaactggatgatgtttgtacggccagcccagaatcacctggagcagaacctggtggcttaccagtatggccaccatgtgtattatacaaccataaaaaatgtggagcccaagcaggaactgaaggtgtggtatgccgcatcctatgctgagttcgtgaaccagaaaattcatgacatttctgaggaagaaaggaaagttcttcgagagcaagagaagaattggccctgctatgaatgtaaccgccgatttataagctcggagcagttgcaacagcatctcaattctcatgatgagaaactagatgtgtttagcagaacaagaggcagaggaaggggacgaggcaagaggcgattcggtccaggtcgacggccggggcgtcctccaaaatttatccgcctggaaatcaccagcgaaaatggggaaaagagtgacgatgggacacaggacttgctacattttcccacaaaggagcaatttgatgaggctgaaccagccactctgaatgggctggatcaaccagaacagaccactatcccaatccctcagctgccacaggaaacccagtcttccctggaacatgaaccagaaactcacaccctgcacctgcagccgcagcatgaagagagcgtggtgcccacccagagcacgctgacagccgacgacatgcgcagagccaagcgcatccgattggagctgcagaatgcagctcttcagcatctgtttattcggaagtccttccggccttttaaatgcttgcagtgtgggaaggccttccgggaaaaggacaaactggaccagcacttacgcttccatgggcgggaggggaactgcccactgacctgtgatctctgtaacaagggcttcatcagcagcacatccttggagagccacatgaagctccactcagaccagaagacttactcttgcattttttgcccagaatcctttgaccgccttgatttgttgaaagatcatgtggccattcatatcaatgatggctacttcacctgcccaacttgtaagaaacggttcccagattttatccaggtgaaaaaacacgtgcgcagcttccactcagaaaagatctaccagtgcacagagtgtgacaaggccttctgtcgccccgataaactgcgactccacatgctccggcattcggaccgcaaagacttcctgtgttccacctgtgggaagcaatttaagcgaaaagacaaactacgggaacacatgcagaggatgcataatcctgagagggaggccaagaaagccgaccgcatcagccgctccaagacgttcaagccccgcatcacgtccacagactacgacagcttcacgttcaagtgccgcctgtgcatgatgggcttccggcggcgcggcatgctggtaaatcacttatcgaagagacacccagacatgaagatagaagaggtgccagagttaactctacccatcataaaacccaatcgtgattacttttgtcagtattgcgataaggtttataaaagtgccagcaagcgcaaagcccacattctgaagaaccacccaggagcagagctcccaccgagcattcggaagctccgacccgctggtcctggagagccagaccccatgctgagcacacacacccagctgacgggcaccatcgccacccctcccgtctgctgtccccactgctccaagcagtacagcagcaagaccaagatggtccagcacattcgaaagaagcatccagagttcgcccagctctccaacaccatacacacaccactgacgacagctgtgatcagtgccaccccagcggttttgactacagacagcgccactggagagactgtggtgacgacggacctgctcacccaagcaatgacagaactgtcccagaccttaacgacagactaccgaacgccacaaggggattaccagagaattcagtacatccctgtgtcgcagtcggcgtctggcctccagcagcctcagcacatacagctgcaagtggttcaagtggcctcggccacttcccctcaccagtcacagcagtccactgtggatgttggccagctccatgatcctcagccctacccccagcacgccatccaggtgcagcacatccaggtcagcgagcctaccgcctcggccccgtcctccgcccaggtatctgggcagccgttgagtccctcagcccagcaggctcagcaggggctcagcccctcccacatccagggcagttcttccacacaggggcaggctctgcagcagcagcagcagcagcagcagaattcctctgtgcagcacacgtacctgcccagtgcttggaattccttccgtggctattcatctgagattcaaatgatgacgcttcctccgggtcagtttgtgattacagacagtggtgtggcaactccagttactactggccaggtgaaggcggttacttcgggtcattatgtgttatcagaaagtcaatcagaattggaagaaaagcaaacttctgccctctctggtggagtccaggtcgagccacctgcacacagtgactccctggacccccagaccaacagccaacagcagaccacacagtacatcatcaccaccaccaccaacgggaacggaagcagcgaagtgcatatcaccaaaccatgacttccaccctggagcttgaatccagcacccacctcatgtctgttctcataagtctgaaagctctgacacgtagagctcttttgtaagatttattattcactcaagagttcggaaaccacagttttgtctctcatccatacactggggtttattttgccaaggtcatctttatcaaattgactcttcaaaccctcggtttttgccacagaacagagatctttcaggggaaagtagatttcgaggtggagagaatttgccttgctcttgagctggtcttttaacatactgacgagccttacttttcctttgtggaaatattaagtggcatattgtgttcataccaaaggtggagacaggatgtgccaagttcatggttactggacttcttattccaagccatggcaccaaaggagaaggggcattttgtgggtgtgcattaggtctgaactgctttatcttgttttagttttcagtaatttaacaaagggagcctgctgaataacaaaattaaaatgatgaaacaaaagtttgacagtgatattctgaagcaaaaactgtcatctaaatttttcttgctgattttttttaacttccctattttagaaaactattgttgggctgttggtagtgctttccacagatgctggtcctcagtggattaggtcagaagctcatgttctgatagttcttcattatttcacaaaggtggacaacctgaaagagaaaaggctgcttgatgtcagcagaatctaaacccctacattaaagctttgcctcccattctgtggttgtggtggtggtaagaaggagatattggtaccaagaaaaatttccaaaactattgagagagagagagagaaagtattgaaattttgttctgccttgcaggatccatttatcattcattggtaaaggatatattccttgttcttaccaagtgtacatttaactcttgctgacatgttcagtgtattttattacttttaatgctgtcttaaaatgaacattctttaaagttggacaggaaggtggcatttcttatttattaacatttttaactttaaacatattgtgactcatctagaccttttaataagacgatcaacttcacacttagggaaaaaattaaaatgtgatggccacttctaataattcaggtagttataagggatctggaagaaatccagtctttatgaatatactattagttgggcattaaaaaatcagtatatattttaactttttgtgacatgctaacacattttcagaataattattgcatagtagaatttattactccagaacagaaagaccttacttcatttcaaatgaagttaattaatttacatttctgggtaaaaactggttctataaattaagtagagtagcttctttatgataaagacaattttctgaaaagtgaacaattctgttaaaagaactttattgatgtgtagatttcgcactttatttctgagactgcgttcatgtagttgttccccaatgtttgagtactaagagaacttgagaaaattacttcataaacatatggaaactgaaaatggactctctttgtgacaaagatattcaacagaaaatattgaccctgcattgcaaaacacaggttcgggttccctaagtcccacagtgtaatgattacaaatatcctagtgtccggtctagaaagactttctaggagaagactagtggaattttctaaaggttcagttttagcttttataacttaaatttggccctgttacgttctttttaatttgaaccataaggtatctcccctcccttcaggaataacttattggaaaactgaaaagaatcactgaatggaatgttcattttatggcagttgttttaagttttaaaatacacagaggaaaatattgtggaaggacctctttgttgctttcccttctaagttgtcttcttcttcttcttcttcttcttcttctttggtccttaagtgaaataaagactctaaaactaatttgtatattatcagccagagatgcggatggcagtcgagccaaatcgcatggctttcagatcaggtattctgcacattcattccaaggtcatagatttttaaaaggacctggatttgaagagatggcaaatgatgagccatcagaaaacttaatttggaaaacatgtatgtagccagtgtggatattgtggcctctctcaagacacattgacactgtagacttcattcagtccagtgtgagtattttggagtaggttggatgtagattttgtttttatcattgatttgtaccgacagaaatagacatttcatcatgtaaaattcctgttattctggaaaaacctattgttttgatcttcttgttttctgacttggaagtatcctttcaaaaaaactcttaagatatctaggtctaaaaagcacttcatgagatgctaaagctgacccactggttgaaaatgttgaccctatcctgttatttaaatgtgaacatttattgtacattcagtgagttatagtgttaatagtcttgtgctatgcagcaggtgtaaaaattaataaatatattttttaataaacatgtttgtatgtgtgaagctacaagaaaaaaaaaaaaaaaaaaaa

SEQ ID NO: 797 - DNA, 2229 bp, Homo sapiens
gtcttgaggaccatctctcccggcagcataccgtgtggcttcacactgctctgcctctctgaacctcggtttcttcatctataaaatgggaataagagtaagccacctcaatggactgtgggaggcttaagtaaattgaagtgccatgcaagtagctagcatgcagttgcagctcaatgaatattatgatggccgcagatacgatggctacagctggggcacccatttcgggtcacaaggtagggttcaatgttgaagatggcagagccaattgcatccctgatgatcgtggagtgccgggcctgcctgagatgctcacctctcttcctttaccagagagagaaagacagaatgaccgagaacatgaaggagtgcttggcccagaccaatgcagccgtgggggatatggtgacggtggtgaagacggaggtctgctcaccactccgagaccaggagtatggccagccctgctctaggagaccggactcctcggccatggaagttgagcccaagaaactgaaggggaagcgcgacctcatcgtgcccaaaagcttccagcaagtggacttctggttctgtgagtcctgccaggagtacttcgtggatgaatgcccaaaccatggccccccggtgtttgtgtctgacacaccggtgcccgtgggcatcccagaccgggcggcgctcaccatcccacagggcatggaggtggtcaaggacactagtggagagagtgacgtgcgatgtgtaaacgaggtcatccccaagggccacatcttcggcccctatgaggggcagatctccacccaggacaaatcagctggcttcttctcctggctgattgtggacaagaacaaccgctataagtccatagatggctcagacgagaccaaagccaactggatgaggtacgtggtcatctcccgggaggagagggagcagaacctgctggcgttccagcacagtgagcgcatctacttccgggcgtgcagggacatccggcctggggagtggctgcgggtctggtacagcgaggactacatgaagcgcctgcacagcatgtcccaggaaaccattcaccgcaacctggccagaggagagaagaggttgcagagggagaagtctgagcaggttctggataacccagaagacctgaggggtcccattcatctctctgtgctgagacagggcaaaagtccctacaagcgtggctttgatgagggggatgtacacccccaagctaagaagaagaaaattgacctgattttcaaggatgttctggaggcctcactggaatctgcgaaggtggaagcccaccagttggccctgagcacctcactggtcatcaggaaagtccccaaataccaggatgacgcctacagtcagtgtgcaacaacaatgacccatggtgtgcagaatataggccagacccagggggagggggactggaaggtcccccagggggtctccaaggagccaggccaattggaggatgaagaagaggagccttcatcattcaaggccgacagtcctgccgaggcctcccttgcatctgaccctcatgaacttcccaccacctctttttgccctaactgtattcgcctaaagaagaaggttcgggagctccaggcagaattagacatgcttaagtctgggaaacttcctgagccccccgtattgccaccacaggtactggagctcccagagttctcggaccctgcaggtaagttggtttggatgagattattgtcggagggcagagtacgcagtgggctgtgtggagggtagcctaaagctctctgtggaaaccaccttccgggagacctgaggagtgtaacgtggaggcggctacctccgtgggtgggagcccaggtcctcagtgtctctggcagacccatcggcagctctgccaggtgctccatgtgttgcccttgtatcctccttgtcaataaaggaagttccgctgcagaaggggtgtgtgctgtgttcttgacccgttgcctttctctggtactggtgtcttaccccaaagcccaatttctaaacccagtctttctctgtccccagtctcaagcagggtgtcccactggagagatctcttggcttccctaacttagtccaggaacacagccttgttcttctcttcctgaatctctgtcctgccacacatggtcccagttccctagcctggagttctagaaggatggagagtgaggggatccaggccattca

SEQ ID NO: 798 - DNA, 2492 bp, Homo sapiens
cccgcccacctcccccgtcggcccggccgtcccccggcgccggggagctccgggccgcccatgatgggctccgtgctcccggctgaggccctggtgctcaagaccgggctgaaggcgccgggactggcgctggccgaggttatcacctccgacatcctgcacagcttcctgtacggccgctggcgcaacgtgctcggggagcagctcttcgaggacaagagccaccacgccagccccaagacagccttcaccgccgaggtgctggcgcagtccttctccggcgaagtgcagaagctgtccagcctggtgctgcctgcggaggtgatcatcgctcagagctccatccctggcgagggcctcggcatcttctccaagacgtggatcaaggcgggaaccgagatgggccccttcaccggccgcgtgatcgccccggagcacgtggacatctgcaagaacaacaacctcatgtgggaggtgttcaatgaggatggcacggtgcgctacttcatcgatgccagccaggaggaccaccggagctggatgacctacatcaagtgtgcacgtaacgaacaggagcagaacctggaggtggtccagatcggcaccagcatcttctacaaggccattgagatgatcccacctgaccaggaactgctggtgtggtacggaaactcacacaacaccttcctggggatcccaggtgtgcccgggctagaggaggaccagaaaaagaacaagcatgaggacttccacccggcggactcggcggctggccccgcgggccgcatgcgatgcgtcatctgccaccgcggcttcaactcgcgcagcaacctgcgctcgcacatgcgcatccacacgctggacaagcccttcgtgtgccgcttctgcaaccgccgcttcagccagtcgtccacgctgcgcaaccacgtgcgcctgcacacgggcgagcgcccctacaagtgccaggtgtgccagagcgcctactcgcagctggccggcctgcgcgcccaccagaagagcgcgcggcaccggccgcccagcaccgcgctgcaggcacactcgcccgcgctgcccgccccgcacgcgcacgcgcccgcgctcgccgccgccgccgccgccgccgccgccgccgccgcgcaccacctgccggccatggtgctgtgagcgcgcccgcgcccccgccgggccccgcgcgctcctgggtccccggcaccccggccccgcagcgcgactcgccctccagccccaacccccggcccggcgccgccgcggagccccgcgcgctggggttgcgccccggaggcggatctcaggcacccccgccttggcccgtgtcgcagatgaggacactgagggcggcgtccctcacccaggccacgcagctggtgcggctgttcggccgcctcctctgggagggggtccccctgcctggcctcgcccccgagtctccctgctgctgtagagccgggcgcccaggccggcatccccctcgtgggtggcaggagagcggacttagagcccccgagggcccctcagcagaggaaggggagtcccctcctccgccaccgagagtcctgtgcttcggaatgaagggagggcgacctccttgtccgggtgtggtcgggcgcgggggttgtgggggcgccatctcctcttccggcccctgggactggtgtcctgaagtgtcgggagtccttacgcaaccttgacatgtgcgggctactggggtccatcggcagcgggaagagacccggagagatgcatcttctgggcccttctctcctttaggccagcttacccccaaacctggctcctggggacggatgaggaaggagctctttgcagtgcaccaggcacgttgagagtggaggcacaatggaaatcctctgtgggaccccgagcaagaccctgcacctctttgggcctcagtttccccatctgtaaaatgaaggagttggaccaatgccccctccccttcagctgtgacatcgtgcctgggaaggcgaaatatacccccagccccttccaacacacacactccagcgagaggagggcaagactggaaccgctgcccgagaggttaaggtggcttctgtggccacgaagcgcttccgagctgtgcccagtcccgggaattccgcccagtctgcccacacttccctcggtccctgcccgtttcctcaaattcgggccgtgcgcgccctctggtgtcgcctctcacactttgcagtcatttaccaggattcccgtagggcgttttgtaaaataaactataatattaatgaaaagtataaaatgtatagagttttcaagaaactgcgttctacttccagaagatggtcactttaaccttgtaaatatttatctaaaatgatatttacaaaactgtaatatattattatttgattgtatatgtacaactgtaaatacatttgtacctctcttgtattctaaaataaaaattacttggaacatttatcatttagcatctg

SEQ ID NO: 799 - DNA, 3204 bp, Homo sapiens
ccatgtgaccctctcgggtgggactctgcagctgcttcgcagcgcaactctctcaccaaactccgcgcccttgcgctagcggtgccaaaaggctcccgccccgattgaaaaggcgcagtgcatgcccgcccgcgtcactccgcgggcggaggacgcacgtcggggcgcggctctctggctagcgcgcagctccagctctgtcactcgcgcccttccaaggacctggagcacccgagcgcctgcctggtggcggcggcaacaatgcacggagccgccagagcgccagccaccagcgtgagtgccgactgctgcatcccggccggcttgcgcctcggaccggtgcctggtaccttcaagctgggcaagtacctgtcagaccgcagggagcccgggcctaagaaaaaggtgcgcatggtgagaggggagctggtggacgagtcggggggctcccctctggagtggatagggttaatccgggcagccagaaactcccaggaacagactctggaagctattgcagacttacccggaggacagatcttctaccgagcattgcgagacgtccagccaggggaggagctgacagtgtggtattctaactccttggctcagtggttcgacatccccaccacagcgactccgactcacgacgagaaaggggaggagcgctacatctgctggtactgctggaggacgtttagataccccaacagccttaaggcacacctgcgtttccactgcgtgttcagcggcggtggaggcggcgccttcctgcaccacgaacacgcggctcgccaaggcgccgtcccagcggctgatggcctcggtctctccccaaaacccccggcgcccgatttcgccgcgccttcccaggcaggaactttgcgaccccaccccctgggcccgccaccagttcaggcctgcggtgcgcgggagggcatcaagcgcgaggcctcttccgcgccctcggccacctcgccgaccccaggcaagtgggggcagcccaagaagggcaaggagcagctggaccgtgccctggacatgagcggagccgcccgaggacaagggcacttcctcggcatcgtgggcggctcctcggcgggggtcggcagcctggctttctaccccggcgtgcgctcagctttcaagcccgccggcctagcgagggcggcggcggccgctcacggcgacccctaccgggaggagagcagcagcaagcaaggagccggcctcgctttgggcaggctgctgggcgggggccgggcgtgcgggcgccccgggagcggggagaactcggcggcgggcggcgcgggtcaccaccatcaccaccacgcgcaccaccaccaccatcccaagtgcctgctcgctggggacccgccgccgccgccgccgcctggcctgccctgctctggggccctgcgcggcttccctctgctctccgtccccccggaagaggcgtccgccttcaagcacgtggagcgcgccccgcccgcagccgccgcgctgccaggagcgcgttatgcgcagctgccccctgcgccggggttgcccctcgagcgctgcgcgctgccgcccctcgacccgggcggtctcaaagcctatccgggtggtgagtgcagccacctgcccgccgtcatgccggcctttacagtctacaacggggagctgctctacggctcaccggccaccaccgcttattacccgctcaaattgcacttcggcgggctgctgaagtatccggagtccatctcctacttcagcgggcctgcagcggccgccctaagccccgccgagctggggtcgctggccagcatcgaccgagagatcgccatgcacaatcagcagctgtccgagatggctgccgggaagggtcgcggacgcctggactcggggacgttgccaccggccgtcgcggcggcgggaggcaccgggggcggcggcagcggaggcagcggcgcaggtaagcccaagaccggccacctgtgcctctactgtggcaagctgtactcgcgcaagtatgggctcaagatccacatgcggacgcacacgggctacaagccactcaagtgcaaagtctgtctgcggcccttcggcgaccccagcaatctcaacaagcacatccggctgcacgccgagggcaatacgccctaccgctgcgagttctgcggcaaggtacttgtgcgccgccgggacctggagcgacatgtcaagtcccgccaccctggccagagtctgctcgccaaagcgggcgacggcccgggtgccgagcccggctatcccccggagcctggggatcccaagagcgacgacagtgacgtggacgtctgcttcacagacgaccagagcgaccccgaggttgggggcggcggggagcgcgacttgtaacgagtcttcccgggaaggggcggggtgaggacagagaggagtcgagggtttattctcgcagtagaggaactcctggtggtgggaagagggacccaatggacaaaaccgtttttgtttttgagagggcgccagatttgaaacagtgagaggtcccacatctggtgctgaaactcagagcaacagttcagaggtggcgtaaatctggccacctggagagctcgagtgccaccagtacctccgcaccccgggcctctggacttcttggatgagctcaccctgaaccgcccaggcggtctgctcttggtgttcagaatcacatcaatgcgaacgtcacagcgccttcgagggcgcagattttaactgccacgtatttttaagttgtacttttctgtggaggaaattgtgccttttgaaacgacgttttgtgtgtgtatttcacgttagcatttcattgcataggcaaaacactagtcacaattgggtagatgtgacatccatatacttgtttacattttatctgttctcatgtcaaagactactccttgccccattgaatatatagtggtagcaggtgtacaaattggtcaagttgcaattatttatgagaaaataatgataaatgtaaaatatctaaagcatgaatctaagagcacgcaatatataattttaaagaaaatattctatttggtagaatacaaatgtggtgtgtgttgttttataatgactgctgtacagtgggtatagtattttggttttggttccagattgtgcaatctttaagaaaaataaagatacaaacgagagttttgttcacttagt

SEQ ID NO: 800 - DNA, 2221 bp, Homo sapiens
aattccctaccctcgacctgtcgatgccccgcggccccgcccgccctcttaagcctggctcagccctcagggcccgcccgaagtctaccgagcccgagtggcctaccgagcccgagtggccccgcagcgtccaggaggcgcccgctccgcggtggcgctcttggaggtggtgtcggagagccgccgagcgtgcggtcccgggatggctctaccccggccaagtgaggccgtgcctcaggacaaggtgtgctacccgccggagagcagcccgcagaacctggccgcgtactacacgcctttcccgtcctatggacactacagaaacagcctggccaccgtggaggaagacttccaacctttccggcagctggaggccgcagcgtctgctgcccccgccatgccccccttccccttccggatggcgcctcccttgctgagcccgggtctgggcctacagagggagcctctctacgatctgccctggtacagcaagctgccaccgtggtacccaattccccacgtccccagggaagtgccgcccttcctgagcagcagccacgagtacgcgggtgccagcagtgaagatctgggccaccaaatcattggtggcgacaacgagagtggcccgtgttgtggacctgacactttaattccaccgccccctgcggatgcttctctgttacctgaggggctgaggacctcccagttattaccttgctcacccagcaagcagtcagaggatggtcccaaaccctccaaccaagaagggaagtcccctgctcggttccagttcacggaggaggacctgcacttcgttctgtacggggtcactcccagcctggagcacccagccagcctgcaccatgcgatttcaggcctcctggtccccccagacagctctggatctgattctcttcctcaaactctggataaagactcccttcaacttccagaaggtctatgcctcatgcagacggtgtttggtgaagtcccacattttggtgtgttctgcagtagttttatcgccaaaggagtcaggtttgggccctttcaaggtaaagtggtcaatgccagtgaagtgaagacctacggagacaattctgtgatgtgggagatctttgaagatggtcatttgagccactttatagatggaaaaggaggtacggggaactggatgtcctatgtcaactgtgcccgcttccccaaggagcagaacctagttgctgtgcagtgtcaagggcatatattttatgagagctgcaaagagatccatcagaaccaagagctccttgtgtggtatggagactgctatgagaaatttctggatattcctgtgagccttcaggtcacagagccggggaagcagccatctgggccctctgaagagtctgcagaaggctacagatgtgaaagatgtgggaaggtatttacctacaaatattacagagataagcacctcaagtacaccccctgtgtggacaagggcgataggaaatttccctgttctctctgcaaacgatcctttgagaagcgggaccggcttcggatccacattcttcatgttcatgagaagcaccggcctcacaagtgttctacatgtgggaaatgtttctctcaatcttccagcctaaacaaacacatgcgagtccactctggagacagaccataccagtgtgtgtattgtactaagaggttcacagcctccagcatactccgcacacacatcaggcagcactccggggagaagcccttcaaatgcaagtactgtggtaaatcttttgcatcccatgctgcccatgacagccatgtccggcgttcacacaaggaggatgatggctgctcatgcagcatctgtgggaaaatcttctcagatcaagaaacattctactcccacatgaagtttcatgaagactactagccctgccaggcacaatgactcacgcctgtaatcccagcactttgggaggcagaggtgggtggatcactcaagtccaggagttcgagaccagcctgggcaacatggtgaaatcctgtctctaccaaaaaaatacaaaaatcagctgggggtggtggcacatgcctgtggttccagccactcaggaggtcgaggtggcaggatggtttgagcacaggagacggaggttgctgtgagctgagatcgccccactgcttttcaacctgggtgacagaaccagaccctgtctcaaaaaaaaaaaaaaaa

SEQ ID NO: 801 - DNA, 2627 bp, Homo sapiens
ggcatcaaggagtacgagtgcaaggagtgccacggcaggttcgcgcagaaggtcaacatgctcaagcactgcaagcggcacacggggattaagattttcatgtgtgaattgtgtgggaagacattcagcgagaggaacaccatggagacccacaagctcatccacacagtgggcaagcagtggacgtgctccgtgtgcgacaagaagtacgtgaccgagtacatgctgcagaagcacgttcagctcacacacgacaaggtggaggcgcagagctgccagctgtgcgggaccaaggtgtccaccagggcctccatgagccgacacatgcggcgcaagcaccccgaggtgctcgcggtgaggatcgatgacctggaccacctcccggagaccaccaccatcgacgcctcctccattggcatcgtccagcctgagctgactctggagcaggaggatttggccgaagggaagcacgggaaagctgccaagcgaagtcacaagagaaagcagaagccagaagaggaggcgggtgctccggtgcccgaggacgccaccttcagcgaatactcagagaaagagacggagttcacaggcagtgtaggcgacgagaccaattccgcagtacagagcattcagcaggtagtggtgaccctgggtgacccaaatgtgaccacaccatcgagctcagtcggcttgaccaacatcaccgtgacccccatcaccactgcggccgcgactcagtttaccaatctccagccggtggccgtggggcaccttaccacccctgaacgccagttacagctggacaactcaatcctgaccgtgacctttgataccgtcagcggctctgccatgttgcacaaccgccaaaatgacgtccagatccacccccagccggaagcctcgaacccacagtctgtggcccatttcatcaacctgacgaccctggtcaactccatcacgcccctggggagccagcttagtgaccagcacccgctcacgtggcgggcagtgccccagactgacgtcttgccacccccgcagccgcaggcacccccacagcaggcggcccagccccaggtgcaggcggagcagcagcagcagcagatgtacagctactgagctgcgttccgggagactcggggcaagaactgcagagggatgtttgggatttgtttagatgtgtttgctggataccaaacaaacaaaaagtcatacattgcaatgtaaggttgacttagctttgcagagtatctccagatcccccgccagcaaccattacggtctgtcagcttaactctagaagggacctctggcaggccagagttttaaactggatggggctccacaccatgccttaccaaggcagtaagtcctgggccggggccgcatctgcctccccttacagaaccagtgttcgcccgacacagggttcgggaaagtgaagctgagagagaagcaggattttaagaggcaggagataagttattaggaacacaaatggttcattttcttttttcttttagagctcggttcctatgagaacacagacagtattcacaggtggcagcaggcagcagggaacattttctcctcacttctggatttttttgcaagcgagcacatagaagttaaagtaacgtgtattctctttgaactaggagtggagtcggttcttatacaactatgggctgaaaccatgaggcgtgctgagccgcacctgatcctgcaaccttcgaggtcatcacggtcatcatgtgcaaggggtcacgtgaggtcactgactccagctcaaaaggcatcttagtaatatccatgaatcgatttccaatagagtttttttccttttttttttttaactttatttcaaacatacattatgtgttcaagactgttatggccaatattgtgttttagttttatgttaacatgataaagtcatgtgcactgtaggaccatctgtccctgtccacccttcacagctgcccagatgcagagggtcgcgcggctgtgtgtgaggagtgagcctccctgctgcccccaggggctcctccgggttgtctcaggattctctgcaatccaaatgtatccattctggctgaagcccagccagaatcccgagtggaagaaacgggggaaaagtcatattttccttctgtttaaacttcaattccaaaggtgcacagatgtattcataaaggaagacattagatccagccattgtggccaccaggctctgtggacccatctcagtggagaattcgttttggacccgtggctccgtgcagctgtggactcgagtgccatccactggtgtgagtcttgcggggaggccacaggaaaacgttctgtgccaagtgccgcctcgctgtgtccggcatgggactgcgctggagggtccggcgtggaaggcagacctcctgtacctctatcgttcccatttgtggcatccaaaggcggaaggctcatggcttccccactagaggcggcgtcttgggctttcccattggattgtgaaaggcattaagactgtttggagatgttggctgtatttcctgtcacatcaggttgtatgatgacgaataaaaggtgctgtgacccgtgttttcaaaaaaaaaaaaaaaaaaaaa

SEQ ID NO: 802 - DNA, 8738 bp, Homo sapiens
ctgacaatgctggggagatgaagatagtgtgtggctgcttctggactcaaggaggaggagagagattccgcgagccgacaccatgcgatccaaggcgagggcgaggaagctagccaaaagtgacggtgacgttgtaaataatatgtatgagcccaaccgggacctgctggccagccacagcgcggaggacgaggccgaggacagtgccatgtcgcccatccccgtggggccaccgtcccccttccccaccagcgaggacttcacccccaaggagggctcgccgtacgaggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggagcaaatactgacggacgtggaagtgtcgccccaggaaggctgcatcacaaagatctccgaagacctgggcagtgagaagttctgcgtggatgcaaatcaggcgggggctggcagctggctcaagtacatccgtgtggcgtgctcctgcgatgaccagaacctcaccatgtgtcagatcagtgagcagatttactataaagtcattaaggacattgagccaggtgaggagctgctggtgcacgtgaaggaaggcgtctaccccctgggcacagtgccgcccggcctggacgaggagcccacgttccgctgtgacgagtgtgacgaactcttccagtccaagctggacctgcggcgccataagaagtacacgtgtggctcagtgggggctgcgctctacgagggcctggctgaggagctcaagcccgagggccttggcggtggcagcggccaagcccacgagtgcaaggactgcgagcggatgttccccaacaagtacagcctggagcagcacatggtcatccacacggaggagcgcgagtacaaatgcgaccagtgtcccaaggccttcaactggaagtccaacctcatccgccaccagatgtcccacgacagcggcaaacgcttcgaatgtgaaaactgcgtgaaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgaggtctgccacaagtcctacacgcagttctccaacctgtgccggcacaagcggatgcacgccgactgccgcacgcagatcaagtgcaaggactgtggccagatgttcagcactacctcctccctcaacaagcaccggcgcttctgcgagggcaagaaccattacacgccgggcggcatctttgccccgggcctgcccttgacccccagccccatgatggacaaggcaaaaccctcccccagcctcaatcacgccagcctgggcttcaacgagtactttccctccaggccgcacccggggagcctgcccttctccacggcgcctcccacgttccccgcactcacccccggcttcccgggcatcttccctccatccttgtacccccggccgcctctgctacctcccacatcgctgctcaagagccccctgaaccacacccaggacgccaagctccccagtcccctggggaacccagccctgcccctggtctccgccgtcagcaacagcagccagggcacgacggcagctgcggggcccgaggagaagttcgagagccgcctggaggactcctgtgtggagaagctgaagaccaggagcagcgacatgtcggacggcagtgactttgaggacgtcaacaccaccacggggaccgacctggacacgaccacggggacgggctcggacctggacagcgacgtggacagcgaccctgacaaggacaagggcaagggcaagtccgccgagggccagcccaagtttgggggcggcttggcgcccccgggggccccgaacagcgtggccgaggtgcctgtcttctattcccagcactcattcttcccgccacccgacgagcagctgctgactgcaacgggcgccgccggggactccatcaaggccatcgcatccattgccgagaagtactttggccccggcttcatggggatgcaggagaagaagctgggctcgctcccctaccactcggcgttccccttccagttcctgcccaacttcccccactccctttaccccttcacggaccgagccctcgcccacaacttgctggtcaaggccgagccaaagtcaccccgggacgccctcaaggtgggcggccccagtgccgagtgcccctttgatctcaccaccaagcccaaagacgtgaagcccatcctgcccatgcccaagggcccctcggcccccgcatccggcgaggagcagccgctggacctgagcatcggcagccgggcccgtgccagccaaaacggcggcgggcgggagccccgcaagaaccacgtctatggggaacgcaagctgggcgccggcgaggggctgccccaggtgtgcccggcgcggatgccccagcagcccccgctccactacgccaagccctcgcccttcttcatggaccccatctacagcagggtagaaaagcggaaggtcacagaccccgtgggagccctgaaggagaagtacctgcggccgtccccgctgctcttccacccccagatgtcagccatagagaccatgacagagaagctggagagctttgcagccatgaaggcggactcgggcagctccctgcagcccctcccccaccaccccttcaacttccggtccccacccccaacgctctccgaccccatcctcaggaagggcaaggagcgatacacgtgcaggtactgtgggaagatcttccccagatcagccaatctcaccagacacctgaggacgcacactggggagcagccgtacaggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccagtgagccagcaccccggggtcctcacgaaccacctggggaccagcgcgtcctctcccacctcagagtcggacaaccacgcacttttagacgagaaagaagactcttatttctcggaaatcagaaactttattgccaatagtgagatgaaccaagcatcaacgcgaacagagaaacgggcggacatgcagatcgtggacggcagtgcccagtgtccaggcctagccagtgagaagcaggaggacgtggaggaggaggacgacgatgacctggaggaggacgatgaggacagcctggccgggaagtcgcaggatgacaccgtgtcccccgcacccgagccccaggccgcctacgaggatgaggaggatgaggagccagccgcctccctggccgtgggctttgaccacacccgaaggtgtgctgaggaccacgaaggcggtctgttagctttggagccgatgccgacttttgggaaggggctggacctccgcagagcagctgaggaagcatttgaagttaaagatgtgcttaattccaccttagattctgaggctttaaaacatacactgtgcaggcaggctaagaaccaggcatatgcaatgatgctgtccctttccgaagacactcctctccacaccccctcccagggttctctggacgcttggttgaaggtcactggagccacgtcggagtctggagcatttcaccccatcaaccacctctgacgggctgggcagccgggggccggtggccagagcgagggcaccagccacgaaggacggaggcgggcggggccccggagaaccctgtccctgcgtgtggccactcctcagcatcctccccacccaccatggttcattccgacttttccaatggaaactcagatcccaaaagtccctaaagcagtcgtagagtctcaccatctccaaggattggtcttgagaacactgttcagtgacggccatgcaggtggccgtccaaagacagccaacggagctgcctcgcagaatcagccagtgggcaggtggacgctctgctgagacagaagctggtggccactgccgggtgcccgcgtggggtcgcggaagggaatggatagactggtgtgctcaaaagagagagatcactcaaatgatttttataatgaaatgacaagaataacccttttggtaaccgtattgactgcagagtctatttaagcatgtggttttaaaaatagacagtattttttaaaaatcaaaaaatgacttgcaaattgttttttaaaagtaattttgcattgctttgaaatttgagctcatttgcaaacccgagtctgcctgggaacccgcactgtgcctgggtgtattctttatactgtagataatggagaaattttctatctctgtccctatttgtataagccaaggtgatgctgggtgccccgaggcagaacaagaggcgcggggccacacccgtgaaccatgcagacggccgaagaagtcttaggcagggcgccctgggctgcaggcctgcccgaggctgggatgggaagtgtgcctgccctcgtgtgacatggaattggtgtcaggaccgccacgtggccttcagaggaatccacaggtccccacccaagatccctcaattatatggggaagtcgagggcctgtggcttggatccgccatgcagagatgtggccgggcacccatcttccttccctcctctgtccctgcctcggccaccccacgcgggaacccagcgccgtcctctgaaggcagggccttggccacgtcctgggtctcccacctcccacctgaccccagcggctccggtgtcctccacgtggctgccctggggagcaatcccagcggatcgctccgggccaccaagccgcacctgtgcctgagactccggatggacgacacagtcgtcacgtcgctcttcctgcgggttcttggcgagacacagcttgagaacagaagggcgtcgggggaacctgccgcaaggagcagagacagcacagccccccgggcccagccgcctccctctcttgggacgcaacttcttccccactcggatgggctttaaattattcccataggggccaatttcaaataataatttttttccctgatggaatttaccttaatctgtatataacttgtaattttttctaattcatttcttttcttattttatttcctccttaacagtatttttggcattagacattcttattgtgaagaaataatgttaatataagtatctggtgaaggaccaaaaccgtgtgataaggttgtgtgtcgtgtgggagtggggcgattttttatgtgccaaatacccccgtcccccccatgaatcctgctgtccctgctgccgtttaccagacaatcatatgtttttgttaaatttgcgtttcagttacatttgcatttaagacaagtgttctatttatttcttgtattgtttggaagaaaaaatgatgatagagtcccaaaaagaagagaaaaaaaatgcccaagttgccctttaaaaaaaaagagcgtaaatacaaacaggagtggtgcaagccgccttggtgtgggtttgtgtcacgtgtggacatctcctcaggctttgtgtcacgcgtggacatctcctcaggctgtccccagcggtgacgggaggtgtcctggctgctccaggacaaaagacaatcgtctctgtgggtgccgggtggtccaggcttgcactgaagacgtgccacggggaggctcctgcaggaggctcaacccgacggatcacagtgaaagggattcctcccacgccagatctgcacaacgaggcaagacaggacccacctgtgcgtgcgctggggccatggggtggccccgccggggcagcgggggagctgcctgcagaagagccagctggcgtgtcgggaaggatccaggatctgcaaacacaactgctcaggccttctcacgcgtttccacaacatcccctgggtcagacccaccaggtaccccgtaggaatttccagtttcccttgatctagatgggattcttataaaaattcaacctcagacataaacaccccatttctgtaaacccaaattatatggtttcttctgcgaaagagtaaggtgtgtgcttttttttttttgcaatatgaccccgtctctctgaagtgggacattcggacggatggagccctcagcgtgtcttttcagcaggagcagaaccgatgagagccgcccttaccgttggtctccggatcccccagtcccatcccgccgttttcggctgtcttcctaaccgtcctgtcttctcttggcgctctttccttccacctttcccaagagtcctggttgcacgttttaagtcatatattttcgtccccctgaaaatgatggcaagcccagtttctcctgagcattcagacccccaggccccagcacttggcgttttcaggaggccctgttcttagagcccctgacaaaggcagcacttatttcctgggctggtgcgccccaaaacacggccccgacacttagtgtggccccaggccccagcgagcctcgccctcccagttttgctctgcccagcagtgttggtgcccagagatgacaagggccagggagcctggcccgggtgtgagaattcagagattctggcctccagctgtcaccacaccgtaacggggccatgtaactgtgcagcatggacagggatgcgacggggcagctggctgtgtccatggccaggtggccagggtcagggctgcaagccaggggtccagggcccttccgttcagcccaaatgctgccccaatgctaactccttggattgtcaacccccatcccccaaatggaaattccgaaggaggcctcctcgcacctgccctccgctgctcctcagaccccagcccccagcgagccgacgtccccacccgttcctgctctcatccccaggttgggcacgtggggttcctcctctgtgggcctggcagacccttcatgagtgggacccaagatatcactgacttcaacccagaggatcgagcccctgcaccctgcctggggccctggggtgtggagcagtggctggggtgggcgtggtgtggcctgagagactgcccagctggagaggccttcctttacaaggccacgcgtgcagctgtcccatccagaccccgactggccaagacctccacgtccccagagtccagccctggaaattccaagggccctggcgtcctctgccttccccgcttccccatgagcgtctgcaaaacacttgcctgaatacatatcacgtattttagactcgaagcctcaaagcactggattgtggtcccctgccccctctgtcccgtccccctgcccaagtgactgaaacctactgagctatattcactgtgctgtcctagggggagggagagcagagctcgcccctgcactgcagccttgtgggggagggcaaggctctcctcccagccagggacgccaggacatagctgctcctggtcagtggaggtcagccgggtatcaaaagccatgaaactgtgtctctgtagcaatgagtgatactgtgacaaaaccatccttgcattcttcctagaagagttcctctgctccttccattccatttttgtgtttgttttgttcttttctgtcactgatccgtattaccacttttggaaaaaaataaataaataaataaataaaaggcagcttgagtttccaaacgtgtgattcacttgtgaacaaaagtcattctaacaattgccttcagcgtcacgtgcattgccactgcgctttcggcacgagggatgctgagccctggtgtcagagtcgtaatttaaagcgtgtgtgtatatggactttgtcccttaaggtcgatataaagaatcctcgcagaatcacagacctgtgccgcccgccaccttctgccattgttacattacagatttggtttagttttgttttgttttgttttttcttttagaactgtatagtattgaaaaagaaatcaaatgtaaatgtctggttttcatataatgtttaaaaagaccattgagaaggaggctggcgctcgccccatgtcccccttgattgtaaattgcttctgttctgtttataagtaaactgtgcatgactcctgcttagcggtcattatcgtgtctgttggtgaaatttttattaaaaggaaaattctgtagatgcacttattgaatatgtgattaggatctacgtctgagactaggagtcctgaactgctgacgcgaaagaggcgcagttcccaattaatacggaaatcgctgtgggagaagaatgaaataagacgtgaagtgtaggaaatcatgaaaagaacaattttgcaaattgcattctgatgcttgtgatgaacacaaatgtacttgtgtagagacatttccttaagagaaagcctaggagaagccgatttggaggttaatgctgtagaataggactgtataccaaatgtaatctttccaatgctccaatgaatttatacatgagattgatatgcaataaatctgtgtgcttttctaaaaaaaaaaaaaaaaa

SEQ ID NO: 803 - DNA, 7970 bp, Homo sapiens
gtaaaagtgacattctaaatgttcctcactctgcgaggcttattttttagggactttgctataattctgaaagacttagttttacagtacatctgaaagtaggagttttcagaagtatggctcttgggataaatttagattcttaattgtgaagctctgttaccacttgttagaaggcaggtcagctcacctgcttggggaggtaaatatatgaatgcactctcgagtaatttaatggagccctacctcaatgtacagaatgacagtatcacagatcaagaatggagtacgagtgattttcggctatggtgggggtaggtaggtcacttgtcccctgttgtctcttactatttgtaaagtgaagactatgattagtctttttgatcgggatggtttgagatgaataaagaataggcaggcaatttggatactttaggcttttcaagaacattagtaacattttttcttagatatttctcctaatacaatgagtgttgtgaaataacatggcagttattgttgagagaaaagccttcccagttatgtattgagtccttaggcgttttgaccttccctccactcttacagaacttggtggaaggggccactatgttttctacctccttccgtgcctttcacaaagccacatcctgcaccgtctacccttctctgtggatatttttccgcttggcaatttcctttcctgaggcacccacttgggacatctgaatctccatctccatgttgatggcccgtttgtgcttggacgtgttcttccacttgagactgagggttcatgtaatcaaagaagtttctttgttgtgtgtatctttacagaacacaacaggaattgaaaatgaatcagaacactactgagcctgtggcggccaccgagaccctggctgaggtacccgaacatgtgctgcgaggacttccggaggaagtgaggcttttcccttctgctgttgacaagacccggattggtgtctgggccactaaaccaattttaaaaggcaaaaaatttgggccatttgttggtgataagaaaaaaagatctcaggttaagaataatgtatacatgtgggaggtgtattacccaaatttgggatggatgtgcattgatgccactgatccagagaagggaaactggctgcgatatgtgaattgggcttgctcaggagaagagcaaaatttattcccactggaaatcaacagagccatttactataaaactttaaagccaatcgcgccgggcgaggagctcctggtctggtacaatggggaagacaaccctgagatagcagctgcgattgaggaagagcgagccagcgcccggagcaagcggagctcccccaagagccggaaagggaagaaaaaatcccaggaaaataaaaacaaaggaaacaaaatccaagacatacaactgaagacaagtgagccagatttcacctctgcaaatatgagagattctgcagaaggtcctaaagaagacgaagagaagccttcagcctcagcacttgagcagccggccaccctccaggaggtggccagtcaggaggtgcctccagaactagcaacccctgcccctgcctgggagccacagccagaaccagacgagcgattagaagcggcagcttgtgaggtgaatgatttgggggaagaggaggaggaggaagaggaggaggatgaagaagaagaagaagatgatgatgatgatgagttggaagacgagggggaagaagaagccagcatgccaaatgaaaattctgtgaaagagccagaaatacggtgtgatgagaagccagaagatttattagaggaaccaaaaacaacttcagaagaaactcttgaagactgctcagaggtaacacctgccatgcaaatccccagaactaaagaagaggccaatggtgatgtatttgaaacgtttatgtttccgtgtcaacattgtgaaaggaagtttacaaccaaacaggggcttgagcgtcacatgcatatccatatatccaccgtcaatcatgctttcaaatgcaagtactgtgggaaagcctttggcacacagattaaccggcggcgacatgagcggcgccatgaagcagggttaaagcggaaacccagccaaacactacagccgtcagaggatctggctgatggcaaagcatctggagaaaacgttgcttcaaaagatgattcgagtcctcccagtcttgggccagactgtctgatcatgaattcagagaaggcttcccaagacacaataaattcttctgtcgtagaagagaatggggaagttaaagaacttcatccgtgcaaatattgtaaaaaggtttttggaactcatactaatatgagacggcatcagcgtagagttcacgaacgtcatctgattcccaaaggtgtacggcgaaaaggaggccttgaagagccccagcctccagcagaacaggcccaggccacccagaacgtgtatgtaccaagcacagagccggaggaggaaggggaagcagatgatgtgtacatcatggacatttctagcaatatctctgaaaacttaaattactatattgatggtaaaattcaaactaataacaacactagtaactgtgatgtgattgagatggagtctgcttcggcagatttgtatggtataaattgtctgctcactccagttacagtggaaattactcaaaatataaagaccacacaggtccctgtaacagaagatcttcctaaagagcctttgggcagcacaaatagtgaggccaagaagcggagaactgcgagcccacctgcactgcccaaaattaaggccgaaacagactctgaccccatggtcccctcttgctctttaagtcttcctcttagcatatcaacaacagaggcagtgtctttccacaaagagaaaagtgtttatttgtcatcaaagctcaaacaacttcttcaaacccaagataaactaactcctgcagggatttcagcaactgaaatagctaaattaggtcctgtttgtgtgtctgctcctgcatcaatgttgcctgtgacctcaagtaggtttaagaggcggaccagctctcctcccagttctccacagcacagtcctgcccttcgagactttggaaagccaagtgatgggaaagcagcatggaccgatgccgggctgacttccaaaaaatccaaattagaaagtcacagcgactcaccagcatggagtttgtctgggagagatgagagagaaactgtgagccctccatgctttgatgaatataaaatgtctaaagagtggacagctagttctgcttttagcagtgtgtgcaaccagcagccactggatttatccagcggtgtcaaacagaaggctgagggtacaggcaagactccagtccagtgggaatctgtcttagatctcagtgtgcataaaaagcattgtagtgactctgaaggcaaggaattcaaagaaagtcattcagtgcagcctacgtgtagtgctgtaaagaaaaggaaaccaaccacctgcatgctgcagaaggttcttctcaatgaatataatggcatcgatttacctgtagaaaaccctgcagatgggaccaggagcccaagtccttgtaaatccctagaagctcagccagatcctgacctcggtccgggctctggtttccctgcccctactgttgagtccacacctgatgtttgtccttcatcacctgccctgcagacaccctccctttcatccggtcagctgcctcctctcttgatccccacagatccctcttcccctccaccctgtcccccggtattaactgttgccactccgccccctcccctccttcctaccgtacctcttccagccccctcttccagtgcatctccacacccatgcccctctccactctcaaatgccaccgcacagtccccacttccaattctgtccccaacagtgtccccctctccctctcccattcctcccgtggagcccctgatgtctgccgcctcacccgggcctccaacactttcttcttcctcctcttcatcttcctcctcctcttcgttttcttcttcatcttcctcctcttctccttctccacctcctctctccgcaatatcatctgttgtttcctctggtgataatctggaggcttctctccccatgatatctttcaaacaggaggaattagagaatgaaggtctgaaacccagggaagagccccagtctgctgctgaacaggatgttgttgttcaggaaacattcaacaaaaactttgtttgcaacgtctgtgaatcaccttttctttccattaaagatctaaccaaacatttatctattcatgctgaagaatggcccttcaaatgtgaattttgtgtgcagctttttaaggataaaacggacttgtcagaacatcgctttttgcttcatggagttgggaatatctttgtgtgttctgtttgtaaaaaagaatttgcttttttgtgcaatttgcagcagcaccagcgagatctccacccagataaggtgtgcacacatcacgagtttgaaagcgggactctgaggccccagaactttacagatcccagcaaggcccatgtagagcatatgcagagcttgccagaagatcctttagaaacttctaaagaagaagaggagttaaatgattcctctgaagagctttacacgactataaaaataatggcttctggaataaagacaaaagatccagatgttcgattgggcctcaatcagcattacccaagctttaaaccacctccatttcagtaccatcaccgtaaccccatggggattggtgtgacagccacaaatttcactacacacaatattccacagactttcactaccgccattcgctgcacaaagtgtggaaaaggtgtcgacaatatgccggagttgcacaaacatatcctggcttgtgcttctgcaagtgacaagaagaggtacacgcctaagaaaaacccagtaccattaaaacaaactgtgcaacccaaaaatggcgtggtggttttagataactctgggaaaaatgccttccgacgaatgggacagcccaaaaggcttaactttagtgttgagctcagcaaaatgtcgtcgaataagctcaaattaaatgcattgaagaaaaaaaatcagctagtacagaaagcaattcttcagaaaaacaaatctgcaaagcagaaggccgacttgaaaaatgcttgtgagtcatcctctcacatctgcccttactgtaatcgagagttcacttacattggaagcctgaataaacacgccgccttcagctgtcccaaaaaacccctttctcctcccaaaaaaaaagtttctcattcatctaagaaaggtggacactcatcacctgcaagtagtgacaaaaacagtaacagcaaccaccgcagacggacagcggatgcggagattaaaatgcaaagcatgcagactccgttgggcaagaccagagcccgcagctcaggccccacccaagtcccacttccctcctcatccttcaggtccaagcagaacgtcaagtttgcagcttcggtgaaatccaaaaaaccaagctcctcctctttaaggaactccagcccgataagaatggccaaaataactcatgttgaggggaaaaaacctaaagctgtggccaagaatcattctgctcagctttccagcaaaacatcacggagcctgcacgtgagggtacagaaaagcaaagctgttttacaaagcaaatccaccttggcgagtaagaaaagaacagaccggttcaatataaaatctagagagcggagtggggggccagtcacccggagccttcagctggcagctgctgctgacttgagtgagaacaagagagaggacggcagcgccaagcaggagctgaaggacttcagctacagcctccgcttggcgtcccgatgctctccaccagcggccccgtacatcaccaggcagtataggaaggtcaaagctccagctgcagcccagttccagggaccattcttcaaagagtagacactctggctgctccctgacagcacctgaagtgacctggaatcagtgaagccaaagggactggcagtctgccctgcagggagtaccgacctatcccagttgtgtgaggctgcgagagaaagggagtgcatgtgcgcgcgtgcatgtgtgcgtgcgtgtgtgttcacgtgttctcgtgcgggcgcgtgagtggtcttcaaacgagggtcccgatccccggggcggcaggaagggggccgactccacgctgtcctttgggatgatacttggatgcagctcttgggaccgtgttctgcagcccagccttcctgttggggtggggcctctcctactatgcaatttttcaagagctccttgaccctgctttttgcttcttgagttgtcttttgccattatggggactttggtttgacccaggggtcagccttaggaaggccttcaggaggaggccgagttccccttcagtaccacccctctctccccaccttccctctcccggcaacatctctgggaatcaacagcatattgacacgttggagccgagcctgaacatgcccctcggccccagcacatggaaaacccccttccttgcctaaggtgtctgagtttctggctcttgaggcatttccagacttgaaattctcatcagtccattgctcttgagtctttgcagagaacctcagatcaggtgcacctgggagaaagactttgtccccacttacagatctatctcctcccttgggaagggcagggaatggggacggtgtatggaggggagggatctcctgcgcccttcattgccacacttggtgggaccatgaacatctttagtgtctgagcttctcaaattagctgcaataggaaaaaaacaaattgggaaatgaaaaaaaaatgggaagattaaaaagcacagggggaagaagaagagatttcggaggccatcctgccaggggcggacggggctgactcctgctctctggaggacggtcagtccatgtctcggagaaacgggtgagctgagcttggcgtttggacccagttcagtgaggttcttgggttttgtgcctttggggcagaccccaggcaaggatgtctgagaccacttgggcgctgttttctcagctccaatttcaagagtgagctatcaaacccagagcggaaggagggagctctgatgagcacggtttgtcacacgataaagggattttttttttcagggctactacggttgatcttgcaactctgtaaatatgtatgtagacacttttaaaagcacgtatttatgtccctgactgtaaatgctccatttttaaagttttataacttgtgttatttaatgagtcagtcaatcggctgcagtatgggatctgataaggatctaggagaagggtctcatgcggaccctcacatgggcagaaaaatggtggtcattggccgacatcacagttttcctgtttcccacccagctaaaaaccgttgtttgctttaaattttcataaactggaatcctttcacccgctcctacagctaaccctcacaagcatgaagtgctgtggctgttccttatcctaatgatgcgcttttgtcccgtaaatgttaacactcatgaagcataccccggcctctcagttcttgagggcctccccaccgcagcagcaaggaaagctcacgaaccccaaacctggcaagtcacctgcagcccatggtgagctctgggaagtgtggttgaggccttggggtcactccttttttgcatgtgcaaatgtgctggtcacccttcaacgctcccagacggtcaggaaaactgttccaatcatgaaaaggggggatgattttgtaaaagtggcatttcctggtcagtggtggtcttcaagacgacagctctgtatctgccatgtgaagagaattaacaataaaagtgtgaagagcgattgtgaggaacaaaaaaaaaaaaaaa

SEQ ID NO: 804 - DNA, 4225 bp, Homo sapiens
gcagagggtgcggcccagaggaggccgcgggccgggaagggccgggcgggacgggaaacgttagggcagcggcccccggggtgagggggccgagcggacgggcagggccccgaggcgaactctgcccggatgaggaacaaagcagtggggcaggcgcgtgcgcccccagcgcagctggcaggttgggcagcccccttcccgaagcttctggacggaaggccccaggtgttccccgagatgccccaacccgtggcggggtgcacggccaccggccctcgggagaagttgggcggccccgggcgaccccggggacgagtggccgcgtcggtgcagcggttgtgagcaagatgtggtagcacgtgaccctggaacgcaaaccctgatgcctgttccccaccacccgagcgctcctttctctgatatttggccccaagccgatgcatcacaggatgaatgaaatgaacctgagtccagtggggatggagcagctgacttcatcctctgtgagcaatgccttgccagtctcaggaagtcacctgggattggctgcctcacccactcacagtgccatccctgccccaggcctcccagtggcaattccaaacctgggtccctccctgagctctctgccttctgctctgtctttaatgctaccaatgggtattggggatcgaggggtgatgtgtgggttacctgaaagaaactacaccctacctccaccaccttaccctcacctggagagcagttatttcagaaccattctacctggcattttatcttatttagctgacagaccacctccacagtacatccaccctaactctataaatgttgatggtaatacagcattatctatcaccaataacccttcagcactagatccctatcagtccaatggaaatgttggattagaaccaggcattgtttcaatagactctcgctctgtgaacacacatggtgcccaaagtcttcatcccagtgatggccatgaggtggccttggacacagcaatcactatggagaacgtttctagggttaccagcccaatttcgacagatggaatggcagaggagcttacgatggacggtgttgcaggcgagcattcccaaatcccaaatggctccagaagtcatgaacctctgtctgtggattctgtgagcaacaaccttgcagcagacgctgtaggacatggtggtgtgatacccatgcatgggaatggcctggagctccctgtggtcatggagacagaccacattgcaagtcgggtcaatggcatgtctgacagtgccctcagtgactccattcacactgtggccatgagcaccaactctgtaagcgtggcactctctacctcacacaaccttgcctccctagaatctgtttccctccatgaagttggcctcagcctagaacctgtggctgtctcctccatcacccaggaggttgctatggggacaggtcatgtagatgtatcttcagacagtctttcttttgtatcaccttcactgcaaatggaagactccaattcaaacaaggagaacatggcaaccttgtttacaatttggtgtactctgtgtgaccgcgcctatccctcggactgtcccgaacatggaccagtgacttttgttcctgacactccaatagagagcagagcaaggctttctctcccaaagcagcttgttctccgtcagtcaattgtgggagcagaagttggtgtatggactggagaaaccattcctgtgcggacttgctttggacctctaattggccagcagagtcactccatggaagtagcagaatggacagacaaggcagttaaccatatctggaagatataccacaatggtgtcctagaattctgcatcattacaactgatgaaaatgaatgtaattggatgatgtttgtgcgcaaagccaggaaccgggaagagcagaatttggtggcttatcctcatgatggaaaaatctttttctgcacctcacaagatatccctcctgaaaatgaactgcttttttattatagccgagattatgctcaacagattggtgttcctgaacacccagatgtgcatctctgtaactgtggcaaggagtgcaattcttacacagagttcaaagcccatctgaccagccacatccataaccatcttcctacccagggacatagcggcagccatgggccaagtcacagcaaagaaaggaagtggaagtgctcaatgtgcccccaagcttttatctctccttccaaacttcatgtccactttatgggtcacatgggtatgaagccccacaagtgtgatttctgtagcaaggcttttagtgatcccagcaacctgcggacccacctcaagatacatacaggtcagaagaactacaggtgtaccttgtgtgacaagtctttcacccagaaggctcacctggagtcccacatggttatccacactggggagaagaatcttaagtgtgattactgtgacaagttgtttatgcggaggcaggacctcaagcagcacgtgctcatccacactcaagaacgccagatcaagtgtcccaagtgtgataagctgttcttgagaacaaatcacttaaagaagcatctcaattctcatgaaggaaaacgggattatgtctgtgaaaaatgtacaaaggcttatctaaccaaataccatctcacccgccacctgaaaacctgcaaagggcccacctccagttcgtcagcaccagaggaggaagaagaggatgactcagaagaggaagatctagcagactctgtggggacagaagactgtaggattaacagtgctgtgtattcagcggatgagtctctttctgcacataaataaaaggaaaagaaacaagcaattttggatgaaaatgcaaatggaaaaatacacataaccagttatctactataatggtttttatataaaatggttcctgatttattttcagccagtaatcaaaacagactgggaatgaataaagcacttacagaagagtatcctaatgaaaacactttaaaacagattgggaaaactgagcatgtgtcctgttttaagtggtggactgggagggaagtgtcaacttctgaggtctttatttacatgataatctgggagatgcatttatgcctgaatcaaagctgccttctgctcaaacaaatcagatttatttcacattcttccattattccattttcctgctggtcctgtgacttggtaacattctaaacggtccttgccccatagccatcctgattgctgatagtgttttatgcagactcttgtgacttatactcaccacagaatggattgggacacagcagcataagtgtgctacttggcagctagtaagtttaaagcaggacctgccttaactgctcctggccacttggaagtttagggtagatcttgttttccaaagtttcggcaggtgcctggagggcaaataaaaaagcagcagtcagtcagtagtcagtgatggagagaacaagaggagagatgcctggcctctgcccaagaaattagctttgatggaagcctgagcaagtcacctggttattgtaacgtggagatctttgtaggtttagacatggctccctgtctccagtaaacatccagccattcagacaaagggggcctggagatacagagagcccaaataatgcctgctggattgtctcctgatgagtacatgtggactcacctgaggaagggaaggaagggaataatcttttatgtttcatttaccttatgaaaagtgttaaaacattgccaactcaaaataacattatttaatgcatgtgcaaagttaggtcttcccagttgtctcagtgctgaggaacctcatcagagaagcatggaagatgccaaaggatttttggaaggtaaagaaggctgaatagtgaccacatgggcctgttttcagggtcccagcttagttaagtcacccatgcacctggtcattgtgtctcccatgcacatccagcgtttctcagaagcagacccacccttaagttgacaggattgatggaacatgctctcctgctcaaggcacaacctctgggctggagtagaggactctggtgggaaggttttgctgctaatgtatttatggaatgaatgtatttcattcaaatctgtattcctctaggaaggattaaaattaaacttttttaaaatacaggaaaaaaaaaaaaaaaaaaaaaaaaaaaaaaaaaaaaaaa

SEQ ID NO: 805 - DNA, 2492 bp, Homo sapiens
gcgccccccgcgcccccgcagcaggaatggcaggaacggatccgggccgagcccgacccgggacgaggaggggctgagccgcgggggatcctggaatcggcagggaggtggggattctgggaggaaaactccatttcctccttccctgccggtttctcccctctaccctggcaccccaaatttcgatgtgccgcctgccgggcgctaagcgccggtgttgagagaggcggcggccgccgcgcccgggaaaatgctgggcatgtacgtgccggacaggttctccctgaagtcctcccgggttcaggacggcatggggctctacacggcccgcagagtgcgaaagggtgaaaagttcggaccctttgctggagagaagagaatgcctgaagacttggatgaaaatatggattacaggttgatgtgggaggttcgtgggagtaagggagaagttttgtacattttggatgctaccaacccacggcactccaactggcttcgcttcgttcatgaggcaccatctcaggagcagaagaacttggctgccattcaagaaggagaaaacattttctatttggcagttgaagatatagaaacagacacggagcttctgattggctacctggatagtgacatggaggctgaggaggaagaacagcaaattatgacagtcatcaaagaaggggaagttgaaaattctagaagacaatcaacagcgggcagaaaagatcgccttggctgtaaagaggactatgcttgtcctcaatgtgaatcgagttttaccagtgaggatattcttgctgagcatctccagacattgcaccagaaacccacagaggagaaagaatttaagtgcaagaactgtgggaagaaattcccagttaagcaggctttgcaaagacatgttcttcagtgcacagcgaaaagcagtctaaaggagtcttcgcgaagttttcagtgctctgtttgcaattcttccttcagttcagcatcgagttttgagcagcaccaggagacttgccggggggatgccaggtttgtgtgcaaggctgacagctgtggaaagaggctgaagagcaaggatgccctgaaaagacaccaggaaaatgtccacactggagatcctaagaaaaagcttatatgttcagtgtgcaataaaaagtgttcttcagcatcaagcctacaggaacatagaaagattcatgagatatttgattgtcaagaatgtatgaagaaatttatttcagctaatcagctaaaacgtcatatgatcacccactcagaaaaacgaccctataattgcgagatttgtaataagtctttcaagaggcttgatcaagtgggtgctcacaaagtaatacacagcgaagacaaaccttacaaatgcaaactttgtggaaagggatttgcccacagaaatgtttacaagaatcataagaagacccactctgaggagagaccgttccaatgtgaagaatgtaaagctttgttccggaccccattttctttacagagacacctgctaatacataacagtgagaggactttcaagtgccatcactgcgatgctacctttaagaggaaggatacattaaatgttcatgtccaggtggttcatgaaagacacaagaagtataggtgtgagctatgtaataaggcctttgttacaccttcagtgcttagaagtcataagaaaacacatacaggagaaaaggagaaaatctgtccatattgtggccagaaatttgccagcagtggtacactcagagttcatatccggagccacacaggtgagcgtccctatcaatgtccttactgtgaaaaaggattcagtaaaaatgatggactgaagatgcacattcgtactcacaccagggagaagccgtacaagtgctcagagtgcagcaaggccttcagccagaagcgaggcctggatgagcacaagaggacgcacactggagaaaagccttttcagtgtgatgtttgtgatttggcttttagcctgaagaaaatgctgattcgacacaagatgactcataatcccaatcgtcccctggcagaatgccagttttgccataagaagtttacaaggaatgactacctcaaagtgcacatggacaatatccatggtgtagctgacagctaataggggctgtaaaggaattaaactattcagaagggctcctaatatgaatcccagatttttatcacctgatcagcataacagaagtagccaaaagtgacttactggtctcatagttcttatttgcctacatttagagtctgtagatgcatatgcaaccaaaaaaaagtcttacttttaacaagaaatggtataaatggaaaaaaaatacaactccatagccttgcaaaatgcaacttgtgctctgtcttataaaaatggagaaaggagtcatggctctctttcttggccatccctctgtaatgaagtttataatatacttccctaataggcctttttaaaaaaaaaaaaa

SEQ ID NO: 806 - DNA, 2627 bp, Homo sapiens
gcacaatctctctctcacacacacacacacacacacacacacacacactcactcactctattttgtgctgtcgtaaaacccacgtgtccagccgggaagctgccagagcgtggaaccaaggagccaggacgcggcagcggccaagcgcagcagcccacggcggttgagtcgggcgcccaggtccgtccgcactctcgcgccctccgcgggcctcccaattttctcgcttgcaggtcgggaggtttccgggcggcacaatctctaggactctcctcccgcgctgctcaggggcatgtagcgcacgcagggcgcacactctcgcgcacccgcacgctcaccgagacacccgcgctggctggtctctcggccctgccggtgtcgcagctgccggtgttcgcgcctctagccgccgctgccgtcgccgccgagccgctgccccccaaggaactgtgcctcggcgccacctccggccccgggcccgtcaagtgcggtggtggtggcggcggcggcggggagggtcgcggcgccccgcgcttccgctgcagcgcagaggagctggactattacctgtatggccagcagcgcatggagatcatcccgctcaaccagcacaccagcgaccccaacaaccgttgcgacatgtgcgcggacaaccgcaacggcgagtgccctatgcatgggccactgcactcgctgcgccggcttgtgggcaccagcagcgctgcggccgccgcgcccccgccggagctgccggagtggctgcgggacctgcctcgcgaggtgtgcctctgcaccagtactgtgcccggcctggcctacggcatctgcgcggcgcagaggatccagcaaggcacctggattggacctttccaaggcgtgcttctgcccccagagaaggtgcaggcaggcgccgtgaggaacacgcagcatctctgggagatatatgaccaggatgggacactacagcactttattgatggtggggaacctagtaagtcgagctggatgaggtatatccgatgtgcaaggcactgcggagaacagaatctaacagtagttcagtacaggtcgaatatattctaccgagcctgtatagatatccctaggggcaccgagcttctggtgtggtacaatgacagctatacgtctttctttgggatccccttacaatgcattgcccaggatgaaaacttaaatgtcccttcaacggtaatggaagccatgtgcagacaagacgccctgcagcccttcaacaaaagcagcaaactcgcccctaccacccagcagcgctccgttgttttcccccagactccgtgcagcaggaacttctctcttctggataagtctgggcccattgaatcaggatttaatcaaatcaacgtgaaaaaccagcgagtcctggcaagcccaacttccacaagccagctccactcggagttcagtgactggcatctttggaaatgtgggcagtgctttaagactttcacccagcggatcctcttacagatgcacgtgtgcacgcagaaccccgacagaccctaccaatgcggccactgctcccagtccttttcccagccttcagaactgaggaaccacgtggtcactcactctagtgaccggcctttcaagtgcggctactgtggtcgtgcctttgccggggccaccaccctcaacaaccacatccgaacccacactggagaaaagcccttcaagtgcgagaggtgtgagaggagcttcacgcaggccacccagctgagccgacaccagcggatgcccaatgagtgcaagccaataactgagagcccagaatcaatcgaagtggattaacggattgactggttggaattaaactgcaaggaaagtcatgattaaatgtcacggacacttaagcaaaaccaaagatttcctctgagcaactttcaatcagtcccagaaaaccaaaagcagtaataaaataagtaagatgttaagagatattgatcctggcatggaagtcagaccaggaaagagattatttatttatgacttagggatgagacttatttcagtggacaactaacctgggatggtaaacattcccagtcccaccatgtattttgctttgtttctaaaaagctttttaaaaactgttatttaataccaaagggaggaatcgtatgggttcttctgcccaccgttgtgactaagaatgcacagggacttggttctcgttgcacctttttttagtaacatgtttcatggggacccactgtacagcccttcattctgctgtgtcagtttggcctggcctgacactggctgccccagcggggaccacggaagcagagtgagagccttcgctgagtcaatgctaccttcagccccagacgcatcccatttccatgtcttccatgctcactgctcatgcactttttacacggtttcttccaaacagcccggtcttgatgcaggagagtctggaaaaggaagaaaatggtttcagtttcaaaattcaaaggaaaaagttgaggacttattttgtcctgtcaagattgcaagaacatgtaaaatgtacggagcttcataatacgttatattgttccgaagcagctcgttgagaaacatttgttttcaataacattttagct

SEQ ID NO: 807 - DNA, 2504 bp, Homo sapiens
atcattcccttactcgaatgaattaaagtacaggattggggctaaataatgtgagtgccacgctctttctgaagctcttatatcaaggaacatgcattacaactttcctaatccctgcttccctcacttccagattgtgagatgtgtcagaacttcttcattgacagctgtgctgctcatgggccccctacatttgtaaaggacagtgcagtggacaaggggcatcccaaccgttcagccctcagtctgcccccggggctgagaattgggccatcaggcatccctcaggctgggcttggagtatggaacgaggcatctgatctgccactgggtctgcactttggcccctatgagggccgaattacagaagacgaagaggcagccaacagtggatattcctggctaatcaccaaggggagaaactgctatgagtatgtggatggaaaagataaatcctcggccaactggatgagaaccaaagccagagatccatccatgtccctcatgctgtctggccttttcaagtcaaaaatttctcagtcaacatgtggaacgcaatcactcctctcagaacttcccaggaccatctgcaagaaaacttctccaaccagagaatccctgcccaggggatcagaatcaggagcggcaatattctgatccacgctgctgtaatgacaaaaccaaaggtcaagagatcaaagaaaggtccaaactcttgaataaaaggacatggcagagggagatttcaagggccttttctagcccacccaaaggacaaatggggagctctagagtgggagaaagaatgatggaagaagagtccagaacaggccagaaagtgaatccagggaacacaggcaaattatttgtgggggtaggaatctcaagaattgcgaaagtcaaatatggagagtgtgggcaaggtttcagtgataagtcagatgttattacacaccaaaggacacacacaggggggaagccctacgtctgcagagagtgtgggagggctttagccggaagtcagacctcctcagtcaccagaggacacacacaggggagaagccttatgtctgcagagagtgtgagcggggctttagccggaagtcagtcctcctcattcaccagaggacacacaggggagaagccccagtctgcaggaaggatgagtaagtcattagtaataaaaccttatctcaatagccacaagaagacaaacgtgatcaccacacacttgcacaccccagctctgaggtggcttcagcgaaagtctgctaaccccttacattccccgagagtgtaaagagatcggaaataactaattaaacaaatccgccactttcatgactagagttgaggaagaacaggggatagttctgtaagtgttcgggggacgtcaacatgtgtggttgtttcccgcactgatcccctccattttttgtgttttgcctcctgttctaattaattttgtctccatacatatctgaaccccaagtgtgtacctcattcttcccttatcactgaaggaaggaagagtccagaagggccacagagaactcaaacgttcagttcaagtctccacaggaattcaaccccagaaagacataaacttggagtccatctggtttaattattggagaatcgattcccaagtccaggaagagaaatgtagggttttacagagtcgcagcaggaaagagagctccctggtctcctgggaagtgtgacctcttctaatggacccctctcctctgctgccatactcccccttggctccccctgtctcctctcctgatttcctccaatctctgtagccccagaagtgaacgccagacaggaacacgcatgtgtgtatatatgtgttcacgtgtgctatgtgtgttaagcctgcatgcatgggtgtgggggtatgtgccctctgtgtacgtatctgtgtgagtgtgggggtttcaagggtgtattaggaataacgctcaaaatcctaaggaaattgaatactctgagagaagagagacagaccctctcatactgttttatattgttttatactcagaaaaggaaaaagaagcaaaactaaaggcaggtagcctggcgcctaggaaccagacctgaaaccaaggaaccagacccgaaaccaggcctgggccggcctgacctaagcctggtagttaaaattcgacccctgacctagcaactgatgttatctatagattatagaaagacattgtgaaacttcccggtctgttctgttccactctgaccatcggtgcatgcagcccctgtcacctaccccctgcttgctcaatcgatcacgaccctctcacgtggacccccttagagttgtgagcccttaaaagggacaggaattgctcactcggggagctcggctcttgagacagcagtcttgctgatgctcctggccgaataaaccgcttccttctttaaaaaaaaaaaaaaaaaaaaaaaaaaaaaaaaaaaaaaaaaaaaaaaaaaaaaaaaaaaaaaaa

SEQ ID NO: 808 - DNA, 4118 bp, Homo sapiens
aaaagcagcatcagacaagagctttattaatcccttacacgagcaaatgcgatctctgacctactagacttgttttcctacaatttcacaaaaagcctcgctagaggaatgtgcaaggacagaagggaaactgaggagacccgcaactcattagcgaaataatagggtgcacttcaataaaaatgcggtcctgaagtggagcagactcaccggcaaggagcccggaaaatcgtcaggggcggcggcaaaatactatcaaatcagcctgggaagcatcttttcgctcagcaagttcaagagaacaaatatgttacaatccttgcctattcttgcctccacttcataatgtcataaaagccacctggggtgtcatttatcaacctctctccagcccactcttccaaaataacactacagtttcctacatgtgtatttttgccaggactccaaagagccttgctaaagtggaacaagcaaaatcctcccctggcctcctgggactgcagtcaccaggctgtcaaagcctcaataccccactgagttccagagaagggtctcaaagctgggagaggatcaaactaacatggagtagagaattgaactgtgaaaaagaagcccgagattccccagcgacgtggtgttgcagccccgttgaaggagtcaacttgcaggctgttaaagacctcaagtcattagcatcagctgctgcactaaaggggcaagtcagcgcctctaagtggcttagcgcacaaacgaggctcccgagacggcctcggcaactccatcccctcctccaccacccgctggatgtgaaaagctttccggagcccatcttgggggaagcttggtagtgttggcgctcctgaagagagacgacgcccgtttatcacccccaggcaactagctgcgcaaatcagcggtggctccagggctagagaatccctggagctaaccgcacccctctccctttcacggaacgcggactccggggaaatacgcacggggtccgcacgcgctgggtgtccagctctctgtcacagcttctccaagtgcctagtgaaacggggaaaggccctctccaatcattttggaagagcctaaaaggcggcaacaccaacacctcttgacatggaaatacactgatacaataggcaaaaggaaacactcgattgcatcttcccggttccaggtggccttatttgggagattctatactgaccttattcctgtgatggaggatactggcatccagcgaggcatctgggatggagatgccaaggctgtccaacaatgtctgacagatatttttaccagcgtttacaccacctgcgacatccctgagaatgctatatttggtccctgtgtcctgagccatacttccctatatgacagcatagctttcatagctctcaagtctactgacaagagaacagtaccgtatatctttcgggtagacacctcagcagcaaatggttcctcagaaggtctcatgtggctgcggttggtccaatcggccagagataaggaagagcagaaccttgaagcctacataaaaaacggacagctgttctaccgctctctccgcaggattgccaaagacgaggagttactagtttggtacgggaaagaactgactgagttactcttgctctgcccctctagatcccacaacaaaatgaatgggtcgtccccttacacatgcctggaatgcagccaacgtttccagtttgagttcccctatgtggcgcatctgcgtttccgctgccccaagagacttcacagcgctgatataagtccccaagacgaacaaggcggcggcgtgggcaccaaggaccacgggggcggcggcggcggtggcaaagaccagcagcagcagcagcaggaggcacctttaggcccgggtcccaagttttgcaaagccggccccctccaccactacccatccccctccccggaaagcagcaacccatccgctgccgccggcggcagcagcgcgaagccatccacagacttccacaacctggccagggagctggaaaactcccggggaggcagcagctgctccccagcccagagcctcagcagcggtagcggcagcggcggcggcggcggccaccaggaggcggagctgagtcccgacggcatcgccacgggcggcggcaaaggaaagaggaaattcccggaggaggcggcggagggcggcggtggcgctggtctggtagggggccggggccgcttcgtagagcggcccctcccggcctccaaggaggatctggtgtgcacaccgcagcagtaccgagcctcgggcagctacttcggcctggaagagaacggccgcctcttcgcgccgccaagtcccgagacgggcgaggcgaagcgcagcgccttcgtggaggtgaagaaggctgcccgcgcggccagcctgcaggaggaggggacagccgacggcgcgggagtcgcctccgaggaccaggacgctggcggcggcggcggctcctccacgcccgcggccgcgtcaccggtgggcgccgagaagctgctggccccgcggcctgggggcccgctgcccagccggctcgagggcggcagtcctgcgaggggcagcgccttcacttcggtgccgcagctgggcagcgcgggcagcaccagcggtgggggcggaacgggcgccggggccgcaggcggcgcgggcgggggccagggcgccgcgtcggacgagcgcaaaagcgccttctcgcagccagcacgctctttctcgcagctgtccccgctggtgctgggccagaagctgggcgcgctcgagccatgccaccccgccgacggcgtgggccccaccagactctatcccgccgccgcggaccctctagcggtgaagctccagggggccgcggacctgaacggaggttgcgggtccctgccgagcggcggcggcggcctgcctaagcagagccccttcctgtacgccaccgccttctggcccaagagctccgctgccgctgcagccgcggctgcggcggcggccgcggggcccttgcagctgcagctgccctcggcgctcacgctgctgccgccctccttcacctcgctgtgtctgcccgcgcagaactggtgcgccaagtgcaatgcctccttccgcatgacctccgacctggtgtaccatatgaggtcgcaccacaaaaaggagtatgcgatggagcccttggtgaagcggcggcgagaggagaaactcaagtgccccatctgcaatgagtccttcagggagcgccaccacctctccaggcacatgacctcgcataattgactcggaaaggaccccagctttccacgcgcgcgcaagcacagttaagccacctgcaggaataaacacgcgagaacatccaccgcttccttgcaccccgaaaccctgcacaaagacacatacattcaccgcccccccgcccccccaacgcgcacacacacgtcctctcctcccaggaacctcattcaaatatttacccgggacacacacccccccccacacacacacacagacacactcacacacaagagccaggatggtggagttttgattgggtgggttgtttgagggggttttcttttgaatgcacgcattttcactttccccaaaacaaaggtacattttttaaaatgtcatatattgcaacatattgatgcatttgtcatacgtttctacttaaattattaagcacttacgatttagatgtaataattatatgtaagggcaaaatttattttagatataaagtaaaggaggagggtgagatgctttctgcatttcttgatgacagtttgtgttcctacaaaaataaacaaaatgaataaaaagggatcaccattcaatttgagtttccagggggaagtgcatgtataatgaaatgataatggacttcaatgaagaatgtcatcaattatgtacatatgtattttcttttaatacaaagtgtaattttgtgccagtgaaatggagtctgaatagttatgtgtttcttttatccctggaaatatttattaaactttatagtttatccgagtatgttggatgctttgacaataaatgactattttcttcaaagcaaaaaaaaaaaaaaaaaaaaaaa

SEQ ID NO: 809 - DNA, 3088 bp, Homo sapiens
ccccttttccagaatcacttgcactgtcttgttcttgaatgagaaaggaagaaaagagcctcccattactcagacccgtgtaaacattattccccccaggagaaaatggtgttattcaaatgaatcataataaaatagcctctaaacagtttctaagcgggagcctccgtggaactcagcgctccgctcctcccagttcctaagaggtcccgggattcttgagctgtgcccagctgacgagcttttgaagatggcacaataaccgtccagtgatgcctgaccatgacagcacagccctcttaagccggcaaaccaagaggagaagagttgacattggagtgaaaaggacggtagggacagcatctgcattttttgctaaggcaagagcaacgttttttagtgccatgaatccccaaggttctgagcaggatgttgagtattcagtggtgcagcatgcagatggggaaaagtcaaatgtactccgcaagctgctgaagagggcgaactcgtatgaagatgccatgatgccttttccaggagcaaccataatttcccagctgttgaaaaataacatgaacaaaaatggtggcacggagcccagtttccaagccagcggtctctctagtacaggctccgaagtacatcaggaggatatatgcagcaactcttcaagagacagccccccagagtgtctttccccttttggcaggcctactatgagccagtttgatatggatcgcttatgtgatgagcacctgagagcaaagcgcgcccgggttgagaatataattcggggtatgagccattcccccagtgtggcattaaggggcaatgaaaatgaaagagagatggccccgcagtctgtgagtccccgagaaagttacagagaaaacaaacgcaagcaaaagcttccccagcagcagcaacagagtttccagcagctggtttcagcccgaaaagaacagaagcgagaggagcgccgacagctgaaacagcagctggaggacatgcagaaacagctgcgccagctgcaggaaaagttctaccaaatctatgacagcactgattcggaaaatgatgaagatggtaacctgtctgaagacagcatgcgctcggagatcctggatgccagggcccaggactctgtcggaaggtcagataatgagatgtgcgagctagacccaggacagtttattgaccgagctcgagccctgatcagagagcaggaaatggctgaaaacaagccgaagcgagaaggcaacaacaaagaaagagaccatgggccaaactccttacaaccggaaggcaaacatttggctgagaccttgaaacaggaactgaacactgccatgtcgcaagttgtggacactgtggtcaaagtcttttcggccaagccctcccgccaggttcctcaggtcttcccacctctccagatcccccaggccagatttgcagtcaatggggaaaaccacaatttccacaccgccaaccagcgcctgcagtgctttggcgacgtcatcattccgaaccccctggacacctttggcaatgtgcagatggccagttccactgaccagacagaagcactgcccctggttgtccgcaaaaactcctctgaccagtctgcctccggccctgccgctggcggccaccaccagcccctgcaccagtcgcctctctctgccaccacgggcttcaccacgtccaccttccgccaccccttcccccttcccttgatggcctatccatttcagagcccattaggtgctccctccggctccttctctggaaaagacagagcctctcctgaatccttagacttaactagggataccacgagtctgaggaccaagatgtcatctcaccacctgagccaccacccttgttcaccagcacacccgcccagcaccgccgaagggctctccttgtcgctcataaagtccgagtgcggcgatcttcaagatatgtctgaaatatcaccttattcgggaagtgcaatgcaggaaggattgtcacccaatcacttgaaaaaagcaaagctcatgtttttttatacccgttatcccagctccaatatgctgaagacctacttctccgacgtaaagttcaacagatgcattacctctcagctcatcaagtggtttagcaatttccgtgagttttactacattcagatggagaagtacgcacgtcaagccatcaacgatggggtcaccagtactgaagagctgtctataaccagagactgtgagctgtacagggctctgaacatgcactacaataaagcaaatgactttgaggttccagagagattcctggaagttgctcagatcacattacgggagtttttcaatgccattatcgcaggcaaagatgttgatccttcctggaagaaggccatatacaaggtcatctgcaagctggatagtgaagtccctgagattttcaaatccccgaactgcctacaagagctgcttcatgagtagaaatttcaacaactctttttgaatgtatgaagagtagcagtcccctttggatgtccaagttatatgtgtctagattttgatttcatatatatgtgtatgggaggcatggatatgttatgaaatcagctggtaattcctcctcatcacgtttctctcattttcttttgttttccattgcaaggggatggttgttttctttctgcctttagtttgcttttgcccaaggcccttaacatttggacacttaaaatagggttaattttcagggaaaaagaatgttggcgtgtgtaaagtctctattagcaatgaagggaatttgttaacgatgcatccacttgattgatgacttattgcaaatggcggttggctgaggaaaacccatgacacagcacaactctacagacagtgatgtgtctcttgtttctactgctaagaaggtctgaaaatttaatgaaaccacttcatacatttaagtattttgtttggtttgaactcaatcagtagcttttccttacatgtttaaaaataattccaatgacagatgagcagctcacttttccaaagtaccccaaaaggccaaattaaaaaaaaaaaaaaaaaaa

SEQ ID NO: 810 - DNA, 1327 bp, Homo sapiens
cgcagcgcgtgcaccagcggctccggagcgagcggccgtggctgagaaggggagggcggaaagtttgtttccccgacgtcagcgccgggcgggccgcgaggctaggaggcggcgggagctgggcagagcgcggggcggccggggctctcgctccgacccgcgcccgcgacccttcctgggacccgagcccgagacccccgccggcccccccggggccgctcgcgggcatggacagcgcggccgccgccttcgccctggacaagccggcgctgggcccggggccgccgccgcctccacccgcgctggggcccggcgactgcgcccaggcgcgcaagaacttctcggtgagccacctcctggacctggaagaggtggcggcggccgggcggctggcggcgcgccccggggccagggccgaggcgcgggagggcgcagcacgggagccgtccgggggcagcagcggcagcgaggcggcgccgcaggatggtgagtgtcccagcccggggcgcggtagcgccgccaagcggaagaagaagcagcggcggaaccgcaccacgttcaacagcagccaactgcaggcgctggagcgcgtgttcgagcgcacgcactaccccgacgcctttgtgcgcgaggagcttgcccggcgcgtcaacctcagcgaggcgcgcgttcaggtctggtttcagaaccgccgcgccaagttccgcaggaatgaaagggccatgctggccagccgctctgcctcgctgctcaagtcctacagccaggaggccgccatcgagcagcccgtggctccccggcccaccgccctgagtccagattatctctcctggacagcctcgtccccctacagcacagtgccaccctacagccctgggagctcaggccccgcaaccccaggggtcaacatggccaacagcatcgccagcctccgtctcaaggccaaggagttcagcctgcaccacagccaggtgcctacggtgaactgaagtccagtcccaccaggacccagacgcctccctgggtggacagcaatagaaaagggggcagacgcccaggaagtgaccttctcctggatgagctctcctggcccgtctgtccagcctggactcccgagcccacgaggctgttgaggcccctgcagccgggcccagctcttctgtccttggccaccagagactgcagcccacaacccttggaggggttgggccggaaggtggaagagcctgccaaggacctcatttagtttgtgtattaaaaccaaaaagcttttgtctttaagaaataaaaccatttttttaagccccaaaaaaaaaaaaaaaaaaaa

SEQ ID NO: 811 - DNA, 1690 bp, Homo sapiens
cgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcaccaaacaacatgtaatctacagtaataaaaaatatatctcattttgggctcaaagcattaatccagttactgaaaagagaatacaagtggagcaaacaagagatgaagatcttgatacagactcattggactgaatttcccccttccccccattgatggaagaatgttccagattctaaattgaggacttcattattaatggcattactgtgttatgattaacaaatttcctgtaaggtacacactacatactaaggtcggccatcattcctgttttttttttttttttttttttttaaccaagcttaaaatgaagctttgtgtttgaaagtaataacaagctcagacgaagatggtggttgtacattattcatctagaaaatataaaaattcattttgttttgaagctagttattaaactggaatagcagttatatccctgagaatggggcccttctcttgacattcctttgttgtttaattctttagaatcttaataaatgtttttttaatcctgagagattaaacagtagtagacttgttaagaatgaaactgtaaccaaaattttaaaataaagttttttttaaaaaaaaaaaaaaaaaaaaaaaaaa

SEQ ID NO: 812 - DNA, 1545 bp, Homo sapiens
gaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgagctctggatgagggggatattgccttgttgaaaacttatggtcagagcacttactctaggcagatcaagcaagttgaagatgacattcagcaacttctcaagaaaattaatgagctcactggtattaaagaatctgacactggcctggccccaccagcactctgggatttggctgcagataagcagacactccagagtgaacagcctttacaggttgccaggtgtacaaagataatcaatgctgattcggaggacccaaaatacattatcaacgtaaagcagtttgccaagtttgtggtggaccttagtgatcaggtggcacctactgacattgaagaagggatgagagtgggcgtggatagaaataaatatcaaattcacattccattgcctcctaagattgacccaacagttaccatgatgcaggtggaagagaaacctgatgtcacatacagtgatgttggtggctgtaaggaacagattgagaaactgcgagaagtagttgaaaccccattacttcatccagagaggtttgtgaaccttggcattgagcctcccaagggcgtgctgctctttggtccacccggtacaggcaagacactctgtgcgcgggcagttgctaatcggactgatgcgtgcttcattcgagttattggatctgagcttgtacagaaatacgtcggtgagggggctcgaatggttcgtgaactctttgaaatggccagaacaaaaaaagcctgccttatcttctttgatgaaattgatgctattggaggggctcgttttgatgatggtgctggaggtgacaatgaagtgcagagaacaatgttggaactgatcaatcagcttgatggttttgatcctcgaggcaatattaaagtgctgatggccactaacagacctgatactttggatccagcactgatgaggccagggagattggatagaaaaattgaatttagcttgcccgatctagagggtcggacccacatatttaagattcacgctcgttcaatgagtgttgaaagagatatcagatttgaactgttagcacgactgtgtccaaatagcactggtgctgagattagaagcgtctgcacagaggctggtatgtttgccatcagagcacggcgaaaaattgctaccgagaaggatttcttggaagctgtaaataaggtcattaagtcttatgccaaattcagtgctactcctcgttacatgacatacaactgaaccctgaaggctttcaagtgaaaactttaaattggaatcctaaccttatatagacttgttaataaccaattcataaacaaataaatggcttcaaaattgtatgcttttttccatatctcttcttgtaatataataaaaggtgatttctaatgttaaaaaaaaaaaaaaaaaaa

SEQ ID NO: 813 - DNA, 1332 bp, Homo sapiens
aagacggctcggatgccggcggtctctgctgaagagagaagatggcgcttgacggaccagagcagatggagctggaggaggggaaggcaggcagcggactccgccaatattatctgtccaagattgaagaactccagctgattgtgaatgataagagccaaaacctccggaggctgcaggcacagaggaacgaactaaatgctaaagttcgcctattgcgggaggagctacagctgctgcaggagcagggctcctatgtgggggaagtagtccgggccatggataagaagaaagtgttggtcaaggtacatcctgaaggtaaatttgttgtagacgtggacaaaaacattgacatcaatgatgtgacacccaattgccgggtggctctaaggaatgacagctacactctgcacaagatcctgcccaacaaggtagacccattagtgtcactgatgatggtggagaaagtaccagattcaacttatgagatgattggtggactggacaaacagatcaaggagatcaaagaagtgatcgagctgcctgttaagcatcctgagctcttcgaagcactgggcattgctcagcccaagggagtgctgctgtatggacctccaggcactgggaagacactgttggcccgggctgtggctcatcatacggactgtacctttattcgtgtctctggctctgaactggtacagaaattcataggggaaggggcaagaatggtgagggagctgtttgtcatggcacgggaacatgctccatctatcatcttcatggacgaaatcgactccatcggctcctcgcggctggaggggggttctggaggggacagtgaagtgcagcgcacgatgctggagttgctcaaccagctcgacggctttgaggccaccaagaacatcaaggttatcatggctactaataggattgatatcctggactcggcactgcttcgcccagggcgcattgacagaaaaattgaattcccaccccccaatgaggaggcccggctggacattttgaagattcattctcggaagatgaacctgacccgggggatcaacctgagaaaaattgctgagctcatgccaggagcatcaggggctgaagtgaagggcgtgtgcacagaagctggcatgtatgccctgcgagaacggcgagtccatgtcactcaggaggactttgagatggcagtagccaaggtcatgcagaaggacagtgagaaaaacatgtccatcaagaaattatggaagtgagtggacagcctttgtgtgtatctctccaataaagctctgtgggccaagtcctctaggaaaaaaaaaaaaa

SEQ ID NO: 814 - DNA, 1339 bp, Homo sapiens
atggacgcggtgttgctggagcacttccccgggggcctagacgcctttccttcttcgtacttcgacgaggacgacttcttcaccgaccagtcttcacgggaccccctggaggacggcgatgagctgctggcggacgagcaggccgaggtggagttccttagccaccagctccacgagtactgctaccgcgacggggcgtgcctgctgctgcagcccgcgcccccggccgccccgctagcgctcgccccgccgtcctcggggggcctcggtgagccagacgacggcggcggcggcggctactgctgcgagacgggggcgcccccaggcggcttcccctactcgcccggctcgccgccctcgtgcctggcctacccgtgcgccggggcggcagtactgtctcccggggcgcggctgcgcggcctgagcggagcggcggctgcggcggcgcggcgccggcggcgggtgcgctccgaggcggagctgcagcagctgcggcaggcggccaacgtgcgcgagcggcggcgcatgcagtccatcaacgacgccttcgaggggctgcgctcgcacatccccacgctgccctacgagaagcgcctctccaaggtggacacgctgcgcctggccatcggctacatcaacttcctcagcgagctcgtgcaggccgacctgcccttgcgcggcggtggcgcgggcggctgcggggggccgggcggcggcgggcgcctgggcggggacagcccgggcagccaggcccagaaggtcatcatctgccatcggggcacccggtccccctcccccagcgaccctgattatggcctccctcccctagcaggacactctctctcatggactgatgaaaaacaactcaaggaacaaaatattatccgaacagccaaagtctggaccccagaggaccccagaaaactcaacagcaaatcttccttcaacaacatagaaaacgaaccaccatttgagtttgtgtcctgagaagtcccagactcggctgaagatctgattatgtctctgtgcatattgtacatgtaaatatctataatgtaaatgtaatttaagaatcaaatttttcgaatggcaatcaactgtttattatttatctatttattatcctgttgagttgatgaaatagatgatttctttttaaatatataatttatataacttatcctgattttctgaaaatatgcaatagcctatgattttcctgaactctgtgttgttgggagaactctggccagaaaacgtcctgcttatttattgccagatatggtttatttctaagcgttgtcaataaatgctatttacaccttttcctgaaaaaaaa

SEQ ID NO: 815 - DNA, 2737 bp, Homo sapiens
ctgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgcgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctga

SEQ ID NO: 816 - DNA, 2614 bp, Homo sapiens
cgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatcgctggatgttgtccactttatccaccatataaaacagtaagcagctgctaaaaacaaaaaaaatacaaaaagtaataacattatatgaactgtgtttcctacttgattaaaaaatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatgaaatttgctaagttgtgatttttatggttggaaccaaagttattcaaatagtaaaaggaaaaagaaagaaaaaggagatctcccataatatttttctgcatctgtttgctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagacctgttaaaaagcagagcaacacaattatagttatcctactgagccatggattctgagttttgttttaaaagtgaaagccaagttggtgtatgtaaaggatttccatgtagctgtggtgctagttattactggctacattatatgctaagtgtatttgtgttccccaagtgtacaagccttctatcaaaagtatgttctataactcatatattcaaggtgtagggtatgaaaatgcaaagtttaggagagcactttaccaagctggtgtcctccaaactgaaattgtttgtaacgatagtcttttacaggttttcctttaaagatgtttgtgtgcttttaattgacaactaacttcttgctgctgtatagtaaaatattaatatatttttatcattaaactgctgcatgactatca

SEQ ID NO: 817 - DNA, 153875 bp, Homo sapiens
gatctgcccgcctcagcctcccaaagtgctgggattacaggcgtgagccaccatgcccggccaacaattttataaataagaataaatttgaaaacctttatgacttcaagacttatgaatgtacggtaattgagagagtaaagtattagctaaaggacagacatagagatgaacagaagagaatagagaacccggaaatacactcacacaacactctattgtcaatctcttttcaacaaagttgcaaaagtagtaaaacaacttcagaaaacagtgtagcagctttaaaggtagcataaacttaccatatagcttaggaatcttacctatagggatatccccaagagaacaaaaacatgtgtcctagaaatacttacacttgcatgctcagcagttttatttataaaagccaaacactagaagctgtttttcacacacacacacacacatacacacatacacacactcaaaactaaaatgtccatgaacagaagaaggaataatcaattatggtatatccttaaaataccattcaacaacataaaaaataaactatgaatacaagcaaaaacagcatagataaaaaaaagccctgagctgagtggaagaagccagacacaaaagttgacatacagtatgattccatttatatgaaatgaagaagctgcaaaactagagtaaaagaatgcagatcactggttattgggcctgtggtctgagggtgaaggttctgactgaaagagtacaggaaaatgttatcaggcaatggtaattttctctatcatgactgtgttggtggtttcatgacagtacagctgacccttaaataacacaggtttgaaatgtacaggtccaattatatgtgaattttatttcaataaatatattggaaagttttttgaatatttgagacaatttccaaaaaccagaattcattgaaataagtatgtcaagaatgcataatacaaaatatatgtaggtactattttatcatttactaccataaaatatacataaatctattatacaaggttaaaattagtcaagagtcacataaacacagactgtacttggtgcttccagagaaatgtaaacaaacacaagatgcagtattttttttttttttttttttttgagatggagtctctctctgtcaccaggctggagtgcagtggcatgatcttggctcaccgcaacctctgcctcccaagttcaagtgattctcctgtctcagtctcctgagtagctggaactacaggtgtgcaccaccacgctgagctaatttttgtattttttagtagagacagggtttcaccacgttggtctgtgttggaggtcaaaagaattagggtcatgaccaactcagtatgccactggagactatatgagcaaacaacaaactagtctcatgaatgcagtatgttggcaagcctacaactgtgtctgcagccagatggaatgctaagggcagtcacaccccaggtgcagtgttccttgtggttatctacaggaacatctggagtctgttgtataaagaaagcaattatgtgagcctgtgataaatcaagcagctgaccaactgttacgtcttcctctctgtggattctacctaataaatacaaagggctgtagaagctcagggcccttgttccctagaagcaaggagccctctgaccccttctttaaaacagatctttttgtcttcatttctgcatttgtccttcttcattcagtcccgaaccgacagccacaagtggcgcccgaacagggacgtgagtgaagaaggtctgctggagcagagaaagtgaaactgaccagaagaatgagaaaccccaggacaagtctgctggcagtggatataaggtcagtgccctaaagaggtactgggagtgggaagtttctgaatcagggtaacatagggcagaatttgtctgctgaagagcaacattatatgcagtcacttaaaggtttacttaaacaatctggtgctcaggttagttctcaaacactagctaagctgctgcaggaggttatcacgcataacccatggtttccacagacagacactcttgatgtggaaaactggggtgaagatttgcttacggcataggatatgagacttacaaattaaactattggcaatccaggatttaaaatgttaaagaaaatgagatatcagagcagacaaggcttaggaaagtccctacaggaaaaccctgatcctatatcaataactgggcaaacagatagaaaagggctaggtcgtcagatttctgatgtgggtcattgatatttctcctccacccactgctttgccactagagtggctaacaaacctgtatgggtggatcaatggcccctttcacaggagaaactaactcaactccatcagctagtaaaagagcgattggatgcaggacatattgaagagtcagcccctggaattcaccagtatttgtaataccaaaaaagtcaggaaaatggggactgctacatgatttgagagctattaatgcacagattaaaccaatgggtgcattacagcaaggtctgccatccctggcaggcatttccaagagactggcctcttgtagtaatagatcttattgttttttttactatactattacatcagcaggataggcctggatatgccttctctgtgccttctgttaatcaaagggagcctgtctcttgttatcaatggaaagttttgccccaaggcgtgcttaacagtcctacattatatcagaattttgtaggacaggcattaaaggagccttgtaatgtgtttcccactggctatgtcattcattatatggatgatattcttttggccgctcctacagatcaaatcttacatcagttattcagagaaacaaaacaggctttgactaaatggaatctcaaaatagctcctgaaaaggtgcaaaccacctccccataccagtacttaggcactattattactgaaagaagtgttcagcctcagaaagtagtcatctgtagggacagattacaaactttgaatgatttccaacaattatcaggggacattaattggctgcacccaatgctaggtattgctacttattaactcaaacacctttatcagaccctccaaggagattcttcattagactctcctcggcaacttactaaggaggcagaagctgaattatagcttgtagaacagatgcttcagcaacaacatgccacctggttacagccacaaaagcctttgcttctgtttattcttcctacctcccattctccaacaggacttttaggccaattcatacacaaatctgtaatagtattagaatggcttttttatccaatcagacagtgaaatctttgcaaatttatctttctttaattactcaacttataacaataggtaggcatagatcaaaaatgtttatgggatgtgatccagacaaaattattgttcccttggattcccaacaacaggccacagcatgggaaatgtcgactgcatggcaaatcactctcacagattttgtaggaataatagataaccattatccatcagacaaaattttgcaattttatgaagttcacccttttacccttcctgtaatcactcatcacaagcctattccaggcagacagacctattttactgatgactcttctaaaggctgtgcagctatttatggacctaagcatactgaaacaataaagacctctggagtttcagctcaatgctcagaattagtggcagttattcaagttttacagctcaccgctttatctcctattaacattgtctgtgattcagcctatattgtaaatgtagccagtcacattgagactgccactattaaaagcaccctagaaccagagctgtataatttgtttctaagacttcaacaagctgttcactctcatgctgctccttttcatatttctcatatttgctatcacacacaacttcctggaccactatctctaggtaacaataaagcagataaactaatcggttctgtatttcaacaagcccaatcttctcatgcattcctgcatcaaaacacctctgcccttactcgtatgtttcatctgccttgcagccaggcttgagctattgcgcaagcctaccccacttgccagcctgtccctggcgttgcacccatggaaggatgtaacccactaggcttggctccatatgaaatctggcagatggatgttacacatatagcagcctttggcaaactcagctatgttcatgtgactacagacacttactcccatatgctacatgtcacgtgccaaactggggaaacagctggtcatgtctgatgacattgtctgtcaccttttgcccatatgggggtccctacacaatgaaaaactgacaatggacctgcttatgttagtcatgcttttcaaaattttttacagttatgggcaatcactcataaaacagaaattccttacaatcctcaaggacaaggaatcatagagtgggcacatcaaacattacaatgcatgttgaaaaaacaaaaatggggactaggagaccagctaccacctcaaacaaaattacatttagccttatttactttaaattttttgactcctggtatggatattaagactctggcagaatgacattggcaaatgttagagggaaaaaggaaagtttacccaaaggtattacagaaatccccggaagaaggacaatggaaaggcccggtagacttactgatatggggacgagggtttgcttgtgtttttacaggagatggacaatccgtgtgggtgccctcaaggtgtgtgtgaccatggaacgggagactggagaaatccatggatctcaactgtgggcccagctcctccagtacgagccatgagctagttgaatctgaatgcaaagacagaacaaggaccgactggagtcacactgacatcaacccccataaaatggggacagctcaagaaaaccacacaggaagctgagaaactgctggagcaaaacccctgactccatgtttatggccatgctagctgtaatatcctgtgcggtatgttttccctgtgcagaggcaaaaacttattgggcatatattcctaacccaccagtagtacgaccggtactcgggagcaacactcctcctgagatatatcatgatcagggagcatggacaccaggacccctaactccccctgacagagagtgattagattctcagaacaatggtatcaattatactgcaccattggagggacttctttatgtgtcacccaggatgcatcactcaaccgcagttgccttgcaattcagtcccaagcatgcttgagttaccatggaaaaattatgtacctattaggccttagctctattaatattactggtgtagttactaatcactcctggccccatcacccaaattgtattgattgtacagaatgggctccctttgataattctcacccctgtccttggactcagtgtcttggccccttagctaaacaacagtccatgttaatgggagacattatcgactggggtccccatggtcatttagatgggagaagtgagaatcagacctcatggcataaattttgctggcactggtggcgaaacttgaacatctcttcgctacatcccaatctgctacacaacttgcttggcacagaatgggctttagcccacctttgcctcaatggcattatcaaggaaagagaggtccaattcaggagtcaatatggaagacagcactcccatttatgaatggcagcatttgggttgggacactatccaataatagtaataatgctcaatgcagttttaatgttacctttgtagaaaatactaccacacagtttacaatttgtatttttaatccgtatgtttttctagcagcaaaaaaggaccaactccgggtaaacaatgcccaatcgatttgtgatgcctgtcaactgtatcattgccttaatcatagcacaatacaaacacacagcatatccaccctaataattctaggtcacattcctggattatagattcctgtaaatctgtccgagccttgggaggccacccccgctttacattttgtaaaactccttcttattcagcttactcatcgtgctcgtagagctttaggcatgataatttttgctataatttccctagtcacactaataacctctgctgtgttgtcctcagtagcactgcacagctccattcaaacagctcaatgtgtgaaaaattggatgtgcacagccgaccaggaatggatgcttcaaaataaaattaacaccaagatacaaacagaagtggcaatgttaaagactactgttctgtggctaggataacaaatacaaagcctgaagttgcagcagcaattgcattgtcattttaaccctattcatatttgtgtaactaatttggaatataatcaaagtgaatatccaaggaactttgtaaaggcccatttacagggagttttacattcaatgttacttttgatattaatgattcacaaagtaaaatccttaacttgaataagcagactcaagtgcttcagccctctttaaaagcttgggcagaattccagcaaggtttagggagccttaacccttggacctacttcaaacagcacctcaatgtcttttttgtgattatcggaataatgttattatgtttctgttttttgttcatagtctgtaaaatcagctggaccaccaaccggcaattgagagctgcacagcctgcaattacctttattcaattaatacaaaaacagaaaaggggggaggttggaggccgaaagaatgagggtcgtgaccaactcagtataccactggaggctatatgagcaaacagcaaactgttctcatgaatgcaggatgctggcaagctgacaactgcatctgccaccagaaggaatgctgagggcagtcataccccacgtgcagtgttccttgtggttatctataggaacatctggaggctgttgtataaagaaagcaattatgtgagcctgtgataaatcaagcagctgaccaaccattacctcttcctccctgttgattctacctaataaatacaaagggctgtagaagctcagggcccttgttccctagaagaaaggagccgcctgtctccttctttaaaacagatctttttgtctttgtcttcatttctgcatttgttctcttttgttcagtcccaaaccgacagccataggccaggatggtcttgatcttttgacctcatgatctgcccacctcggcctcccaaagtgctgggagccaccacacccagccaaagatgcagtattaagtcataatcgtgcatgtgtgtatgtgtgtgtttgaatagacagagtctccctctgtcgcccaggctggagggcagtgacatgatcatagattgctgcatactcaaactcctgggctcaagtgatccttctgcgtcggcctccccagcagctgagaccacaagcacatgccaccacactggctaattttaaaatgttttctgtacaggctgggcatggtggctcacacctgtaatcccagcattttgggatggttggcaggtcccagaagtttgagaccagcctgggaaatatagtaagaccccatctctacaaaaaaacaaagacaaattagctgggtatggtgccacgcacttgtggttccagctactcggggagctgaagtaggagtatcacctgagcccaggaggttgaggctgcagtgagctgtgattgtgccactgcactccagcctgggtaacagagtaagaccctgtctcaacaattttctgtagaggcaggggtctcgctatgttgcccaggctactctccaactcctggcctcaagcaatcttcccaccttgagctcccaaagtgctgggattacaggcataagccatcatgctgggctgataaaattaactacaggacatactacagtaccataataattttgtagacatctcctgttgttcacagtgttgtgagtattcacttaaagaaccccatgatgttaatcatctccacatgagcagttcatctctccagtaaatcacatattgcagtaaaaagtgatctctcaaggttctaatatattattcatagtgtttagtgcgatattgtaaactttaagtaacgctatatggcctatatgaagtgccagtagtgatgctggaagtgctcccaagaagcagggaaaagtcatgacattataagaagcagctgaactgcttgatatgtactatagattgaggtttgcagctgtagttgcccaccatttcaagataaattaatccagtatgaggatcattgttaaaaacaaacaaaaaaggaaataaagacattgctgcagctatgccagcaggcacaaaaatcttgcattttctgcaaaatatatcttttatctcatttaaaaatgcagctttcatgtgggtgcagaattgccatgggtaaggcatacagagagactcaaatacgatttgagaaacagtcattatatgacaactcaaagcattaggaaggtgaaggatctaaagctggagaatttaatggcagcaagggaaagtttgataattttagaaagatgtttggctttgaaaatgtcaagataataggagaagcaacttctgctgactacaaggcagccaacaatgtcccaggtgccattaagagaaccactgacaagaaattatatcaacctgaacagatttgttttttgttttgttttgtttttgagacagagttttgctcttgttgcccaggctggagtgcaatggcacgatctcagctcactgcaatctccacctcccaggttcaagcgattctcctgcctcagcctcccaaagtagctgggattacaggcacccgccaccatgcccagctaatttttttgtttttttttagtagagatggccatcttggccagggtggtcttgaactcctgacctcaggtgatccacccgcctcagcctctcaaagtgctgggattacaggcatgagccactgcacccggcctgaacaggcttttaatgcaaataaagtgccctgttttgggaaaaactgccacaaaggacatttattagtaagtaagagaagaacataccaagatttaaaacagaaagggataggctaactccagtgttttgttcaaatgtagttggttttatgataaggactgcccttatctataaaactgctaaccccaaacccttgcacaagctgtcagtcttttggttgtacaacaagaaggcctggacaatgagaaccattttttctgggttgttcccattaatgctttgttcctgaagtcaggaagtgccttgacagaaagtaattgcctttaaagttcttttgacattgtacaatgcccctggccagccagaaccccatgagatcaacaccaaagttgtggaagtggtctacttgatcctaaacaccctctaatttggcataaagatgatggagtcataagaatctttaaattaggatccctaatccccacattgttcaagggtcaactgtatatattgaccagtattcattgaactgtacattttaaactggcaaattttattgtgtgtaaattacacttcattaaatctgcttaaagagaaaaaaataatccatgagtccacagacataaatgaatgaatgaatgaagtaggaaagaaaaagttatactttatagtaaaatgtcagttaaaatagatggagatagaaaatcatcaatgagagctaaactggtgaagtaaaagattaatgaggaaaaggagttttatatatttctaaagaatctttcttctggccgggtgcggtggctcacgcctgtaatcccagcactttgggaggccgaggtgagcggatcacgaggtcaggagatggagaccatcctggctaacacggtgaaaccccgtctctactaaaaatacaaaaaattatctgggcgtggtgatgggcgcctgtagtcccagctactcgggaggctgaggcaggagaatggcgtgaacccgggaggcggaacttgcagtgagccgagatcgtgccactgcactccagccagcctgggcgagagagagagactccgtctcaaaaaaaaaaaaattttcttctatttatttgcatttatatagaaaaaacagtagagagaatgtaaacaacccagtcaggaggagactccaacactgaaaaaaattcatgagtaccatatttacatgttttaaaatcatatttcgtcagaattatattttcacaacgatagatatggtaaaaatgattttgcactttcttacagtaccacaaaacattttaatggagcaagagatttctttttttttttttttttttttgagaaggagttttgctcttgttgcccaggttggagcgcaatggccctatctcggctcactgcaacctccacctcaccggttcaggcaattctcctgtctcagcctcccaagtagccgggattataggctcctgccaccatgacaggctaattttttgtattttcagtagagacaggctttcactatgttggccaggctggtcttgaactcctgacctcaggtgatccacccacctcggccccccaaagtgttgggattacagacatgagccaccgcacctggcggagtgagagatttctaaccataactgagattttgcttattcatataacttaatggtttatgttacaagataaataaaaatgattagtatttggttaaaaaattttaggctggacacggcctattatctaagacattagatatatatcttgcatacaaattcattactagctgtgttatttgtagatattttatgctaatcatttgtagctcctctttttaatgttaacaagatattttgaagagcattgcatttaattatgagaaaatctaatttcttaattttcctgttacagtcttgtttggtgtttttatgtaagaaatatttgcttcactatgatcacaaagattttcctccattatctcctagaagttgtatggtttggccgggcgcagtggctcacgcctataatcccagcactttgggaggccgaggcgggcggatcacgaggttaggagatcaagaccatcctgactaacatggtgaaaccccgtctctactaaaaatacaaaaaatttagccgggggtggtggcgggcgcctgcagtcccagctactcaggaggctgaggcaggagaatggtgtgaacccaggaggcggagcctgcagtgagccgagatcgcgccactgcactccagcctgggcgacagagcaagactcagtctcaaaaaaaaaaaaaagaagttgtatggtttttggttttacatttatgtctatgaattatttcaagttaatttttagcatagaacttgctggaacatgggttaaatggtcaggaaaagtggtaaattaaggataaaaattgctacattctttggaaaatgaaagcaaatagcaagatgatagtgttattcatagagatgaaagtgactgttagacttggtgataaaagctgagaaaactgctcattttggagcacatttaaatatctatcacagaggcaaattggaaggtcagggaaaaaaattggaaaaatgaatctagaactcaggtaacagtaaggatggttgggaaggtttaaattagtaaattggaagatttcatagaaaactcatgaaggttaagtgacctgaggatgcagaagtgaccactgggctaaagtgaagaacaaatatggagagaagtggcaggcttgcatgatacacatgcgttcagtaaagcaaacacatcacaacccagtgagtattctcaatatcagcacatctcttaaactagcaccacaatcaataatgaaaatccccttcattcaccaatgggttctaactcctagaatttatgatttctagtgctctgtattctaacatatattttgctcatctttgcattttgtactcttttgcttaattctcagtggcatatcttcatttggagagatgtcttttaagtctagtggtggcttcttgtcatcctggtcctactcctcctcttcctcgtgttcctcttcctccttctgttctttctcttcctgctccttgtccctttacatctttatctttatttttaccttcatcttcatattctttttcaccagaaatccctcaggttgaccaagatggtggtatgtagctatatgtgccacatgtggcctggagtgtaggactggtaagatgtgactcataacaatatggatagacgatgtaattctgggtttaaaaaaaaaaacctctgcatgacctacacttcagaggcccttagagcttcctcagtaaatttctgttcatttgtgtctctttgggttggtttcctacctggggatgtgacaacatggatcacaggcgttacagtttcaaggtacatttccatagaagaggatgacaaaataattgcctttacatagaaaatgagtcataggaggtttctctttggaattcttaattgtttaccaacagtttccctaaatgcaccaagattccaccctcacatatgtggcactaggctacacgaacttccagctatgacaggaagcatttaagtttctgctgtaaaggaaagaagagattcggggcagaaagcgtcctgactctggggcattactgaactcccctgctgaggaaggaattttggggccaaacagcaacaataagtctatcaagcgtatagcaaaaatattcctgatagtgtcacatgccccacaatatagagatatctaaggataattaatatcaaggtctgaagtgagataattatggtgggcctagaatatgtgaaaacaatgtcacaggaatggcaagaaccaaatgaacagaaataatagagactgataaattatttcaagtcctactctgagtaattactcatgcatcacaacaagaatgattacttcaaactttctgataactatataaacacatgtaaagaaggaagcaatattttccgtattatggattctttgcgtagctttctgaaattcaaaactaaatattgcaagctaactaaaagagatggaatttcttctagaatatcaaccaatacttcaagaaagttgtttaaaaatagcagaaaggtcaatataataaaataagtcaatatcaatattccactaaatcatatttaatgcagatattcatttatattttaaacagtcaatacgtaaagtacctacctgattgttcactttaaagctggtgcaaattaaagtaatatgaaggataataatgctttgcagattactctttaaaaataaatgaaagagatatttagagaatatgtgaacttttagaaaaacacaaataagaaaaaatgtgacaaagtttgaatgaagtaagatttattcattcgtttatgtatatatttacttctgaggcggagtctcgctctgtcgcccaggctggaatgcagtggcacggtctcggctcactgcaagctccgcctcctgggttcacaccattctcctgcctcagcctcctgagtagctgggactacaggagcccgcgaccacgcccggctaaatttttttgcgtttgttttgttttgtttttgtttttgttttttttttgagacggcgtcttgctctgtcgcccaggctggagtgcagtggcacgatttctgctcactgcaagctctgcctcctgggttcatgccattctcctgcctcagcctcccgagtagctgggactacaggcgccaccaccacgcccggctaattttttgtatttttagtagagacggggtttcaccattttggtcaggctgtctcgaactcctgacctcaggtgatccgcctgcctcggcctcccaaagtgctgggattacaggcgtgagccaccacgcccgacccgtaaaactcttaaaataagaggatcatggccgggtgcagcggctcttgcctgtaatcccagcattttgggaggctgaggtgggccgatcacctgaggtcgggagttcgagaccagcctgaccagcatggagaaatcccgtctctactaaaaatacaaaattagctgggcgtggtggcacatgcctgtaatcccagctactagggaggctgaggcaggagaatcgcttgaacctgggaggtggaggttgcagtgagccgagatcgtgccattgcactccagcctgggcaacaagggcgaaactccatctcaaaaaaaaaaaataataaaaaaataaaaggatcagaaataaataatagtggagacaaacgattgtgatgccctaccttgttttaacctgattgtctctctcagctgagagagccaaacagactccatttttgtttcttcacttgcagcccccttatccccctcccttaaggacataactagtgcaagctgactccaagcacatccaggaatgcacttactgatagacactgaggcacgctgtaccagcagctcctaggaacgcactcagttaatggtacccaaagcccctgcgtttatcactttgtgataattaagcccctgcacctggaactgtttattttcctgtaaatgtttgtgtaaccatttatcttttaactttttgcctgttctgcttctgtaaaaattgcttcagctaaactccccctcccctatttagatcaaggtataaaaagaaatctagccccttcttcggggccaagaattttgagctctagctgtctctcggtcgctggcaataaaaggactccagaattagtctcagagtgtggcatttctctataactcgctcggttacaacactatagccaaagattacattcataaagatatttttacaatataggtgtcttatttaatatgactccaatctaaatggtaatttttctaacctttcttaagtaattataaaatgtcaaaattataaacaattaaaaactaaagagaaatgaagacaatggatagcaacaaaagctaattgctaaatatgggggaaaaaagccaggcatggtggctcatgcttgtaatcccagcactttaaggcaggcgaatcacttgaggccggttctagaccagcctggccaacatggtgaaaccctgtctctactaaaaatacaaaaattatccgggggtggtggcgcatgcctgtagtcccggctactcgggaggctgaggcaggagaatcgcttgaacctgggaggtggaggttacagtgagcagagattgcaccactgtactccagtctgggcgacagagtgagactctgtcaaaaaaaaaaaaggaaaaaaagaaaagaaaaagaagatataatgtttctgcaatctcatttcagttccacttatgataatagatacattatgtaatttaagtcactaacacttgagggcaaaaaaacagaataaacacaaacgtgtgggataaggggatgctgaccccactgttagtgatcaccttggttggagacccaggttttatcatacagatgaagcctgcaggtagcaagtttcagagaaatagattgtaaatgtttcttatcagacttaaggtctatgctgatgttattgctgtaggggtagaatgaggcatgtccaaccccttcttccataatggcctgaactagattttcaggttaactctataatgctgagaggagggggtccattcagatagttgggaggcctttgaattttatttttggttatagtttctacattaaaaaaaagaaaaaaattaagggtcgcgtcaattctcaattgtcaacatttttaatgtattgtatgcaatatatgtcaacttttgtgttgagaaatgaagatcaaatcgtattcttttatcctgtgtatgtaataggctttgctgaccctagtttgatgggttttttcctttgtcctctctttcttggattgagtcctcacagcgcggcggactgcggcgtggtaggaactacaccacccagaatactgtgcgccgagcgtgccggggccttagaccaatcattgcccaggaaaggggcacctccgtaagtgcgcaatacgccagaatcttccggcgtctttccggtggtggtcgtttttgctgcctgcgagcgcgtccgcgggctgggcgtttccggctcgctgggtccgggccaggtaactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggccgaggcagcgctagtgattacgccgcaggtgagagcggagtcctcggatcctcacctgggtcctgaggccccggactggggtcacctgcgtgggtctctgcagttcaggcctcttctccaggacagcgaggagttctgggtggggtcctcagagctgacgggcggtgaggtgaagaagggagagcgttgcgtaccgtgggggctgcacgcgcagagcctgggaggtgcgccggggtcgcgagcattcggaaacttgggggcggacctgtgtctgcagggagcagagagaatgaggagaagaaggcacggctgccatggcagcctgagcaaccggggtttttaattctgagtctttgggagccatggagggttgtgaactaaaggagaacacgatctgagtgagggtctgaaaaaatatttcaaaggcaatgagtggagaaaacagactgttacggagtgatgggggtggacgcagggatactggtgaggagactgctgtagtaggctccaggaggattatggtggattctggaccagacgggttgctgaagggacctaagtaataagaatcttggtagatcttaaaggtaaagccagcaggattttctgctccatcatttgtgcctatgagcaaaagtgggagtgaagtatgatcccaagtttttcttttacctgaacatctggaagagttgacaaagaaatctggtgagggagcaggtttcagggaaatagtaggagttgaattttggacgtggtgtttctaaattgccacagagtgaagttgttacatgggcagttggaatcataagtagaaaattcatgggaggggactgactcagtgatgtgtaaatggagacaggctggggcgtagactcaagccaagccttaaatttagacgggaaatcttaaggttttactttgagatgaagagagggagggctgaggctggaggctgggaaagtgtgggtcggccttggcgaagctgcctgcagataggagggccatggggttccgggggtacttccaaagggaatgtgtaaggaatacacactgcataggatggatttgagggtgggacactgtgtagagtcaccattcagaagacttggcgaactgttcactctatgtggagccagagaaaggtcagccagactagcagagaagcccaagcccagcaagagcagctctcccaggaaaatacaagtttagactgtatagatttaacaaattaaatttatgcaagcaattagttaaccgaataaaatgtcactataactctgtgctctaataaaaaataaatgtttgttttttgtcatgctttcctggcacagaattcctaaaatcgttgtaatttcctcagtgaaaagtgtcttgtgataagtcatggaccgcataacaacagtgttgaccacatcagtgacggtggtcccataagattatgataccatatttttactgtaccttttcattttctttctttctgatcaggaggcaaactgcattttctaagtttataaatgtttaaatgcacaaataattatcactgtgttacagttgctgacagtatttagtatagtaacttgctgtacaggtttgtagcctaggagcaataggctataccatttagtagttgaacaatgaatgtctgaacagtagttcccccttatcctcagaggatacctttcaagaaccccagcggaggcttgaaactgcagatagtacccaacctatatatactatgtttcttcctagactacatacctgtaataaaatccagtttataaatgaggcagtataggagatgaacaataataactggaaataatatagaacagttatactttataagttaataaaagttaagtaactgcagttgagacaataaaaaagcaaaagttaaattataaaaaacatgtgaatgtggtatctctctaaatatcttactgtactattcacccttgtgatgaagaagggactaaactcgatagagtgagatttcctcacactacttacaatggtgcactgttggccagcgcagtggctcacacctgtaatcccagcactttgggaggctgaggcaggcagatcacaaggtcaggagatcgagaccatcctggctaacatggtgaaaccccgtctctactaaaaatacaaaaaattagccaggtgtggtagtgggcgcccgtagtcccagctactccggaggctgaggcaggagaatggtgtgaagctgggaggcagagcttgcagtgagccgagattgcaccactacactccagcctgggcgacagagcgaggctccgtctccaaaaataaataaataaaataaataaataaataaataaataaaggatggtgcactatttaaaacatgaattgtttatttctggaattttaatattactattttcagactgaagttgaaatttaatacttataattttcacactgaagttgagtgtgggtaactgaaactgcaaatagcaaaacagctgataagggaagacttctatacttgagttttatgagatggcttagggtgagcagacaaggtggagtctctagatagcctcagagtggagtcagtcaccagaaaaatcaagtgattatagaatttgaactttgagccccacctctggcatccagggaggggagcagagatctggagattaggttatataaaatcttgaacaatgagttctagaagcttcaaggttgtgaacacttggaagtgctgggagagtgacgtaagagagcgtggaagtactctgccttaccccctctcccagtaccttgccatatgcatcgcttccatttggctgttcctgagttacatccattatcataaactggtaaacataagtaaaatattttcctgagttctgtaagtggttctagcaaattattgaacgtaaggagagaggtcatggcagcccccaaatgtgtagccaagtggagaaaattacagtggtctggacattggcttgcaattgccatatgaagtgagggcagttttgtacgactgagcccttaaacctgttggtttagctgcaactccaggtagttagtgttagaataggattgaattgtaggacacctagttggtatcagaatcagagaatggtgtgggaaaagacactacatatttattatcaaagaagcacagaagcctctcataatttgaaaagataccacattcacataaagacttaaatggcaagtaagaaacaccagagttttaaaaaatgtttacagaaatcttaatgcaatagtcagtactagctaaatcttagcattggacacgtatgaatgagtttgatgcctacgatggcactacgagatagccaccattaagtgtttccattttacagatgaaggcaacctcagagaggttaggtctttgtctagtgtcacacagttggcaagagcaacttaccctttgtaaatgccaccttgaacacctgtatttcatagcctccctcttcctacagattcccatggtaacagaagagtttgtgaaaccatcacaggtaagtggaagaagtcccaggtcttcactggccctgttccctaaagccatgggtctggcccacagatgcaggtaacaataatgtcctgggactctttttccttcatcttgggtccctggggccacctcaggcccaggatgattaatcagggtcaggagttatacagagatgttcccatttctgcatccaataggatgaagtgatgaaaggtttcctgggcataggcgccagcatgtccaaatgcttagagatgagaatgatatgggcatatatagggaactgcaagtctgtgcactgtggccaaaacttttgcagtttgagctgtgacagaactaacatgagtttctttttccttctttacaatctcacagatacatgatttgtccttttcgtagatcttagcaaactcagagtacaatattttttttcttgttaagaactctcaccttttcacttaaaggaagtacttcacaggttgtcttttacatatctgaatggctggtattatcgctcttgtgctttgggggtattaagtaaaataagcgttacttgaacacaagcactgtgataatgagacagttgatatgataaccaagatggccacatagtgattaacaggcaggtagtgtattcatcatggatctattggacaaacggatgattcacgtcttgggcagaacagcgtgggacagtgtaagattttatcacactactcagagaagcacgtcatttataatttttgggttgtttatttctggaattatccatgtaatattttcagaccacagttaaccagtagtaagtgaaaccatggaaaacaaaattgtggctaagatcggggacgactgtatatgtattcagtgctatacattttattctaagcaccgcttcgactgcatctcacaaattctaagttgtgttttcatttcatttagttcaaaatatttttaaatttatcttgagtatttcttctttgttccatgcgttgtcttgtttacatctcccaggtattttgggatttgccagctctctttccattactgctttctagttgaattccattgtgattgcagagcagaccttgtattatttctagtaaatttattaagatgtgttttataactgtgtattgtaaactggggagtaaatgcccttcgtggggtctctaggatcattccaacactgccgtggaaatgaaactctgagaagcataaaggatttattatattcataggtcctcatagagggtggcacagcaaaccatgcatggagccatatggaaatagctctcagggagtggactcaaccaagcaggcagggagccaagagggagagcaaggacctgtgggcaggtgcctttcctactgtgtttgaatgtcattcagtcacagtcaaaggatgaaaagaaggggaggttgtgacagggaccagtcttagcatgctggggacctggtcaccggggtgggttgctcataatgtattggggatgttgaagcatcaggaaaataggaagttttaaagatatataaaacaggcccagaatgtggtctgtcttgttgaatattccgtgtgagcttgagaacagcatgtattctgttcttgttggacaaagtaatctaaagatggtgattatgtccagttgattgatggtgttgttgaattcagttaagtttagtggttttctgcctactgtatctgtcagtaacagaaaagagtgtggaagacttcaattatgatggtggattgatctgtttctccttgaagatctgtcagtttttgcctcatatagtttgatgctctgtggtcaggcatgtatgtgctaaggattcttgtatctttttggaaactgcctcaacctcccgagtggctgggattacaggcgcccgccaccacgcccaactaatttttgtatttttagtagagacagggtttctgcacattggccaggctgatctcgaactcctgacctcaggtgatccacccgccttggcctcccaaagtgcctgtgatgttttcttgatagctacacatgatgagctcagtaaaaggaattgctgtaaataggcctttaataatgtggtggtgaggtgtgtcagcgggcaggggaagcattttaagtcccacagttaggtctcagtgttttagtgagcctgttcctcttgactgaaattcacatgtgtttctaaattgtgtttattatgctttttctctcccattatgtggaagaggaatactagagtgggttgtagttggttatttcccttcccccagatagattaggctctgataatacctctgcaggttaggctctgattaactgttgtctcccaagggcaggctttgtttagaggaacacattgctatggcatattttaaaatgattcattttcccctctctgctggaagcacaaggggatttttttttttccagtattcaccatgagaacttggttaagtttctggaggtaaatattgcaagattgtgggggccccctatcagagtgcctcctgaattttcagctcacagaattgtccacacagaccttccagcaatttatgcattatagattgggttttcctaacctagcactggtttgcatgatggtttcctttcatgagtttctgctcctgtgagccttgattctcctgtatgccctcgtttgtctctccaatcttgtgggcagcagtgtgtgctgtgcccttatctttcctgtgtggatcctagaattgtccatttttcagtctgtttaactctttacttgctattgtgatagagtggccacttccaagctccttacatgcagaatagaaaccaaagtccaggagttaggccttcacaatgtggagtctcatgttgggacttcttggtggtggtgttaggtgcacagcaagagacagacacgtggagttcagggaagggatccaagtgaaagctatccgtcagccagtggctggcctgtggaccatggcagatttaagaggaacactcttcaggtcatagtggcagtcccatcagtgaggaaggatgtagagagtattctctaatgactgggtctcttgcatggtcacctagatagaagtgggaaccatcactaagacagataaagaagagtagtaaccatgggtgtgtgggggtaggatgaaacgggtgtccagctgttggcacagtctttaaatggggaatgttaagagattcattcagaggcaaagcagtaatggaggtcaaataacaccaaggtcagggctggtgcttttcctcccttttgctggctcagacttttgttggtaactcttggtagggcctaagtagtttcagacggtgtgacagattaggttaaaagcaaatgagattgactgggagagtcattcagcctgtggtgggagcagctgggggccaagctttgactgagtataggtggagagaggaaagatatgactggtgtggggacagcacaggcaacactaaggaggaagtggactttggcagcctgagctcacacaaggtctgagtggctgaaattggaacaaagagccaggccacatggggacgtcttcataacagtcctgagactgcctctgacttgggtctaacaaagatgtgaggtggtgctggatccttgttgcatttagcaagcgctgcctggatcccttgagcagagtggcatgtggagaagccaggtgaagtacctgtgtcatggatgctgagggcagtggagttcaaggtgtagcagtcacgatctggagatgtgttcccatgaatggtgtgcaaccggggagggagtatggctgtactcaggatcctcgtactggcactttaaaccaagatggtaagcacaggtttcagtatctgggtctccagggaggtgaactagcaggagcatggatgagattccatgatgtaaggcccagagcccagtgggagacaccataaggacctggtatctcctctgagttggagaactagggaggagcgagatttactggggttcctggggattgagtctgctcatgatttcatctgcccccatcatgcagggccatgtgacctttgaggatattgctgtgtacttctcccaggaggagtggggcctccttgatgaagctcaaaggtgcctgtatcatgatgtgatgctggagaacttttcgcttatggcctcagtaggtaagatctcttaaaaccacaccatcaacctctgctggactctgctcttcccctttttccaggagtttcctgtctttcccagagttggacatgggcccttcttctttccttggttcttgacctgtggaagacataggcgttgtggttgccaggcctgggttttttctgccccaacatctactgtcctgaagccttttagttaagagtttgggttcagactcttgtaacttgcccaaccgacaccacttggttttgccactccttgctaaggtgactgttcagttctgtggtggacctgtgttacaggttctccccctgcctttagtagacgtgtctttggacctgcctttctcaggaattacaggtacttacatggttgctatttgtagggaaccctagactatgacagcaagaccccctcccaagggtttttttgtaataaatttccctcctgtagtctgtcatgggttggcgcaccctgggccagtgttgttgacccacctccctgtttttcccttaggatttcttctaccttccaggacccagatagtctcctgacttaagctggggacaggggagaggcctgtgttcctgaaagcgtagtgaagtcttcagccacagcaaggggggttaacagggtttgggacctgtgagtaggagcagtgggagggcatgatttgagggctgaactcaaatcataccaggcaaatgtcctatgttccccactattttggtgccagggctcatggccatacctcatttttctcttttctctgcctgcttgacaatttgcctacttgtcgtttctactgtgattgtcccctacctctgttctccacatctctcctgttcctgttctgcagtgttctccaacattagcctatacctaatgtatttaatattatgagctgtgcagatacagatgttcctcagctcgtgatggggttatatcctgataaacccattgtaagttgagaatatcgtaagtcagaaatgcatttaatacacccaacttattagacatcctagcttagcaacacagtagagtgtcagttgtttagcctggtgattgcatggcttactgagagctgcagcttgctaccactgcatcacaagagtatacacactgcgtatcactagcctgggaaaagttcaaaattcaaagtatggtttctactgaatgtgtcactttcgtatcatcataaagtggaaaaatcataagttcaaccattataaatcaaagactgtctacttaagctctcaaacatcagctatccagttgtaattgcattttcctggggtgacacacattctatgcaggtctcccctgtctccatcagatgacgtcctattgaaaaccattgacagagaagggagttgtatgccccctgcctctcttcccaccatagtaccccattccttgttctcttgctggttatgggtcttcccctacatggtaaccttaagaggcctaatactgcaagtattatcttccttgacctgactccagctcccttgtcctgaaaacaaacccatggcctgggtgcaatggctcgtgcctataatcctagcacttggggaagctgaggtgggaggatcacttgagctaaggaatttgagaccagcctcgacaacataatgagacctgtatctccacaagaaattctaaaaaaaaattagccaggtatggtggtatatgcctgtagtcctagctacttgggaggctgagatgggagtgtcactggagcttggaaggtcaaggctgcagtgagatatgactgcaactgcactcccatctgggtgacagagcaagaccctatctcaaagaaaaaccatggactcgtccctccctgtgttccacaggtatttgtaatggagctgttcccttctaccaaagtctgcatatacttcacttgcatttttatgcttttaggttgtttgcatggaatagaggctgaggaggccccttctgagcagactctttctgcgcaaggagtgtcacaggccaggactccaaagctaggtccttccatcccaaatgctcattcttgtgagatgtgtatcctggtcatgaaagacattttgtacctcagtgagcatcaggggacacttccctggcagaaaccttatacgtctgtggccagtgggaaatggttttcatttggttctaacctgcaacagcaccagaaccaggacagtggagagaaacacatcagaaaggaggagagcagtgccttgcttctgaatagctgcaaaattcctctgtcagacaatcttttcccatgcaaagatgttgagaaggattttccaaccatcctgggccttctccaacaccagaccacccacagcagacaagagtatgcacatagaagcagggagacctttcaacaaagacgttacaaatgtgagcaagttttcaatgagaaagttcatgttactgagcatcagagagtccacactggagaaaaagcttataagcgtagggaatatgggaaatccttgaactctaaatacttatttgttgaacaccagagaacccataatgcagaaaagccttatgtgtgcaatatatgtgggaaatcattcctccataaacaaacactcgttgggcaccagcagagaattcacactagagaaaggtcttatgtgtgcatcgaatgtgggaaatccttgagctccaaatactcacttgtggaacaccagagaacccataatggagaaaagccttatgtgtgcaatgtatgtgggaaatcattccgccacaaacaaacatttgttggccatcagcagagaatccacactggagagaggccttatgtgtgtatggaatgtgggaaatcttttattcattcctatgaccgcattcgacaccagagagttcacactggagaaggggcttatcagtgcagtgaatgtgggaaatccttcatatacaaacagtcacttcttgatcaccatagaatccacacgggagaaaggccttatgagtgcaaagaatgtgggaaggccttcattcacaaaaaaagacttcttgagcaccagagaattcatactggagaaaagccttatgtgtgcatcatatgtgggaaatcatttatccgctcgtctgactacatgcgacaccagagaattcacactggagaaagggcttatgaatgcagtgactgtgggaaagccttcatctccaaacaaacacttcttaagcatcacaaaatccacactagagaaaggccttatgaatgcagtgaatgtggaaaaggcttctaccttgaggttaaacttcttcagcaccaaagaatccatactagagaacaactttgtgagtgcaatgaatgtggaaaagtcttcagccaccaaaaaagacttcttgagcaccagaaagttcacactggcgaaaagccctgtgagtgcagtgaatgtgggaaatgctttagacaccgcaccagcctcattcaacaccagaaagttcacagtggagagaggccttataactgcactgcatgtgagaaggcctttatctataaaaacaaacttgttgagcatcagcgaatccacaccggagaaaagccgtatgaatgtggtaaatgtgggaaagccttcaacaaaagatattcccttgtcaggcaccagaaggtacatataacagaagagccctagcaattgttgggatgtgtaattgtcttattcactgtaggacaccagagagctgatttttcaagggatccaacagacagaaattcaccctcatacatctgcatatcactagttgaaagattcactacaaggtccaagtacttgggaagctttctagagattacttgtactttctaatctgcccagtgttacaacagacactaccatgtggcatatcctcaccgttttcatcagtcactcacatgtgctcaaggaatgcagaccactgtgcttaccaaattctgaagggaataatataataaaagcctgttgagggtcctcttccatcttgctgaactgttcgaggcaaagacaaaacccaactttgaccaagaagagcaatctggattcttgtagcccatggaggtttaccttcttcataggttttttttttttttatgtgattgccatagtgggatattccctctcccacattacccaagagggaaatgggctgtcttaccatgtgctgatgtatgtgctctgccagtgtgaagggtgaacagctccaactttatgtccccccagggacatagtatgagatcggaaaatagttcttagtcctgtttgtcttaatttttattggtttccaaggtctcctaggaaggagagcagagctgtgtggtcctaatcatggtgtcgatgccagatttatttgtaggtccagaggtctccctgagaagaggcatttgtgacaaactcaagtgctgggacctgcatgaattgtttatttgcagtgatgcttcatatttcccagcactgttcatggtatcttatttcccaggtccttcattgtagccatgggcactgaaggactgaattggtaggtaggtcactggttgtaagacctactggggccaggtaagaacagtaattggcccagacaggtaggtgtgataaacagagtagaaaagattgtggccaagaagagtgaatgtgtcccatccaaaggtgcatccagatatgtctgtgttactatggcttcatggtttgggggtatatagaaattctcaggacctcagacctttgattctcctttagcaacacacatcgtcagcataaggcatctaaagattttgtggactcataacttatgtactgtttttgagatgattgctgcacgggcaggaaagcaggatttgagagaacatacaccttgccttccagatatgtggtttttgtgattcacccagatctgttgtgccagttaggaattatctttattacttcccgtttattgccactgctgagaaggctgtccttcctaacttgtgaggagatgaatccttaataataagtaaatcttgtgttatcctatagtctggttttccaaaaggagaggtagatgcatatttttgtgtggaaccatttatcttaaaacattgaggtgcagttttcatacacaaaaccttctatctttttaagaactgtctgtatggtttattgcccagttaatgggttttgatagtcatgttatctcagtaagtgtcttgtcttagaaatatgtgtgtataggctgggtgcggtggctcatgcctgtaatcccagcactttgggaggccaaggcaggtggatcacctgaggtcaggagtttgagaccagcctgaccaacatggtgaaatccagtctctacttaaaatacaaaaattagccaggcgtggtggcgtgcatttgtaatcccagctacacaggaggctgaggcaggagaattgcttgaacctggggggcggaggttgcaatgagccaaggtcgcgccattgcactccagcctgggcgacagagtgacacttctcaaaaaacaaaaacaaaaacaaaaagaacagataagaaatacgtgtgtatatattctattttgtgtgttttcattcaccttatttcattcagtcttccaaatgaaatgttcttaattttgatgaagtctaatttgtctgtttgttcatttactgttattttggtgctattaaaaaaattttattccttggctgggcacggtggctcacgcccataatcccagcactttgggaagccaaggtgggccggatcacctgaggtcaggagtttgagaccagcctggccaacatggcaaaaccccattctactaaaaatacaaaaattagctgggcatggtggtgggcgcctgtagtcctagctagctacttgggaggcctaggtgggaggactgcttgaacccaggaggcggaggctgcagtgagccaagattgcgccactacactccagcctgggcgacagagcaggactcccatctcgaaaaaaaaaaattgtgtaattataggaactttggaaagattgttattcaactgatattacataaggtatttattttgtaaattatttgcaatattagaatttctgtcagcctacagtatttctctgctgttattctgaccttaacacattgaaagagttcttaattttgcttcgccatcccttacgcatacttaatttttgttattttgccaaattccaattatctttacaagatcattttattttttaaaagagctaaccagacaagaaaatttgcccttgttattcccacttcctatatagcttgtctgccaaaacctttatgccattattctcatcagtctcattctcaggggtttctctgagcaaatccatataaaagtggaactatatgacatttcctgccccgttctcatgcttcatctttaataggtaaatttaccattttaaatagttttaaaattatcttcactgtgtgtactttggatttaatccttactaatgattaagatgctctaagaatcaatgtaaaactaattttaaagccagcagcataattttgtgagttatgcctgagtattcaaaaatcctaacaagtcaaaaatattaattaaaatcaatatgtttaatctttccaattaaatacttccattccataaacttcagaaccaaagttagataccaacaagagactgaagataaatacagtgtcaatagtatcaagggactagcccatataatatacttgaaaatcgtattaatcaccaataaagtaccccaccataaacaaaatacacaataaaaagtcaagatacaaataaagacaggccaacatatgagtagaccattgacagaagaggaaaaacaaaaggcaatgaaaggatatgaactaatgttcaaatgtatttcaatatgagaaataccagatatattctatatcactttaaacttctaaagtaaaaactggaaagctgggtaattctaaatattgtctgggacacagtgatacagaaacacttttgtccatcttatgggagaggaagggcaatgtataacataattccagttacatactagatcaccatatgacctagccattcagctgcaaggtacatttctcatgtatggccataagtttatttagaacataatactgatgaccttatttttaaggttgaatcaagctggtggtgatatatttcatagcaggaaaatggaggaaatacatgtccataatcagaggatttgaatcaaggatgaaagcttcatgatgtaaaatattacatggcagttaaaaacaattggctagaggtaagcccatgaaatataggatagaaatataatattttgctgtagtttgagtgaaaaagaaaaaaaaagaattgtgaggtctacaataaaacataatttaaaaataatttaataccacaaaaactccaaagaaaaaaaaccaaaacaacccagacacttcttactagaacatatgttccatgcttctatctcggcttctggtagccccgtgtgttccttggcttgaagatgttcttcctgtgtcttcacatcgtcttccctctgtacatctgcctctgtgaccaaatttcccatttttctaaggacacagtcatagtcaattaggaactaacctaatggattaactaacatgattacctgaggttctgagggtaacgactccaacatcttttttggagacacaaacacttaacattgccctatgaatttctgcagttcttcaaagggcagagtgaataataaccacagcaatttcaagacacacaggcttccattgtgagatggcttgtttaaagaaactattaattccctacactcttctgatcactctgttgttcacattcattttaggatttctcttccaaatcacttctggtgctttccttcttgcttctttcatttccttcggtgttgtagttctattatgtttttattccgtcagcaatttcttaaatttctcttttcaaccttaagcagtttttctgaaattataaaatttactgtgaacatttcaaacatttccacatgtgcatgaagttaaagtgaactctgacattcccctctaccccatcccttccctccctctacacccaaggagcaaataccatttaactgggtgaggatccttccagacacattttttgtctgcttacaaatattaagatttctaattcgtctttgcatgaccgacttgccgagttaatttaccgtccacatttcctctgtgacatttactgattgaagtgcaccaactgtgaatggtcataactagtcccacccccacaatcatttctcacagattaagcagcataagagcatagtgctttttatctaatttgttcattaaatgtaacaaagttacaaaaacatgaacatgaaaacgttttacctctgccgggcacggtggctcacgcctgtaatcgcagcactttgggaggcagaggcgggtggactacatgaggtcaagagttcaagaccagcctggccaacatggtgaaaccccgtctctactaaaaatacaaaaaaactagccgggcatggtggtgggcgcctgtaatcccagctactcgggaggctgaggcaggagaatcccttgaactcgggaggcagaagttgcagtgagctgagatggcgccactgcactccagcctgggcaacaagagtgaaactctgtctcaaaaacaaaacaaaaaacatgttttacctcaatcataaactgtggaaaacatacagaagttcacaacttttactgtaagttcaaaacttctactgacttaaaaacgggtgctaaacaagtttaagtcaatatattgcacctgttctcatgtgtttttcctatattagacagtaagttccttccctgctcaagggcaggacccatagcccagccatccactgcatcccactcttctaagtatgaccacaacagtgagtggccatggagctaaatgacaggtgtctcatgagattcttgcctatcacagcagcaagttcatagtagatccttgtaccaaacacttcagtgaagactgtatggaaagagctggaagctaagaaaaacctagggtgtcctttatcccatggaaaacactcctgctttgggacaaactggggcctaggtcctcaggcctggaaagaaccctttgatgacagccaatatgtttctagaggggtttctccaactctcttgaacccagggccttaggtacaagtacagccacagctacaatacatgcagccttccagagagaggatgcaggagggtgggggtcctcaagagtcaactctccttcccacaggagaggaaactgtgcactctgtcctgaaaaaacaaaaacagagaactcttaactcaccaagaattctatttataatatgtgcaaaaggaccacagtaaaaggtacatgcccactatgaaaacatgaatatatatgcagtgctttaaaaggttgtgaggaaagctcaaagtgagaaaatgataattttctatttttcacacgttttaacctaacattatctcatgtagcttgaaaactaaaagaaaatctcacaaaaggaatttcaaattaccagattcaggctaagtacagtggctcacacctgtaatcccagctttttggcaggctgaggtgggtggatcacctgaggtcaggagttcgagaccagcctgggcaacatggcaaaaccctgtctctactaaaaatacaaaaattagctgggcatggtagtacatgcctgtaatcccagcttcttgggaggctgaggcaggagaatcgcttgaacccgggaggcagaggttgcaatgagccaagatcgcactcctgcactccagcctaggcagcggagtgagactccatctcaaaacacaacaaaactaattaccatattcagtgctagcaccaagggactaaggtcatggtggttaactatgaaactcacgtaaacctgcccacgtatatcctgattcacctgttaaaatgctaggcactttattttgtagcaaaacttcacgcaaatgtttataagatcagacaatgagattcctctccatgttgttttcttgggtttactgggtttaccatggattcatcttagttgtgtgttttattttgcctgttttagctataattcaatccctagaaaaatgctgagggggacctaaaaatacccctctacacaggattaaagaatctgataaacaccagaaagaattaggactcatctgagaaggccaagcaagtacaaagtgatcactatgttgccagagaaaataaagacaacaaacagacagaatggaatcaggaaaatgtgagagtgctgagcatttgaaaccatattaggctaggtgtggtggctcacacctgtaatcccaacactttaggaggctaagcaggatgatgacttgagtctagcagtttgagacaaatctggggaacacagcaagacctcatctatacaaaaaaatttaaggctgggtgcagtgactcacacctgtaatcccagaactttgggaggccaaggcaggtggaccacttgaagccaggagttccagaccagcccagccaacatggtaaaaccttgtctctactaaaattacaaacattagccaggcgtagtggtgtatgcctgtatcccaagctactcagaaacttgaggcaagaggaccatttgagcccaggagttcgaggttacagggaactatgatcatgccactgcactctagcctgggtgacagagcaagtccctgtctcttaaaaaataatgagtttattaataaaaatcaaagccttaaacagtcttaggtattgcacattttaatgtggtgcacattttaatgtggccatctgtacatgggttcttctcaccctagatataaaaaagaagtgtcacatgaagatgttctcagtattctaatttctactaaattcaagaatctcatgacacaagccttcatatttctcacaaagaattactctcctcatggatatcctcccagagatgtctggatcaaaggcaacttccaagaaatgcctgaagagctgccctcactgtctaactctgacaaaggatggcagtgaatgtatgttaaaaaaaaaaaaaaggaataaaacccctttacctctcaaacattcccctaccaaaaaataaaactgatcttacagggaagtctgtaaggacataaagcaagaagatacctgtaactgaaggttttcataagttcatagagaaaatcccaaggtgggtcaaattccagcatggctctttataggacaagcaagtgacaacctggtcacaaagttttctcacatcaataacaattatgtagtaacttttcattatgattctcagatagtaagatttctgctctggccaaagactgtccttaatagttatatttggaatgtctttctccagcatgagttctctgatgttgatggaatgccttccacatttccccctggtatgaatccttctgcaatgagtgagaactgagtggtgactgaagggatccttacattcactgtattcacagggcttctctccaaagtgactgctcatgtgttagttaagaaagagctgacaaaaaaaatgaaaagtttcctgacattctttgcattcgaaggacttcttcctacagtgtgggtcccattatgaatgataaaataacagtgggtaaaggccttgctgtattcattgcagcaatagggttctctcatgtatggaccctttggtgctgcagaaggtgtgacctgcgtttgaaggccttcccacactcgatacacttgtagggcatctccccagtgtggatgacagagtgctgaatgaggtacgtgctccggtgaaaggctttcccacactgggtgcattcatagggcttctccccagtgtgaatccgctggtgctgtatgagttctgagctgcatctgaaggcctttccacatgccatgcaatcatagggcttctctccagtgtggatgatgtaatgttgaattaggtgggctctattgctaaaggctttctcacattctttgcactcaaagggcttttctccagtgtgggtcctattatggcgaataaaagtagaccggtgggtgaaggcctttcgacattgactacactcatagggtttctctccagtgtggattggatggtgctgcatgaggtacgacctgcgtttgaaggccttcccacactcaaggcacttgtatggtttctccccggtgtggatgaggtagtgccgaatgagagttgagctctggctaaaggctttcccacatgcattgcattcatagggtttcattccagtgtgaaccctctgatgtcgaacgagataccacttcctgttaaaacctttcccacactgcttgcatttgtaggggtttgtccctgcatgaatcaaggcgtctttccctggttgctgtgagtcacattcatggagaacatctgctgataaccactcttgtaatgccctggagtgcagaccatcatctgtccccaaaccttcaccttcaaggctcactttcccaagatgggtctccttgtggaggtctgtctccggtgtcactttacctttctgcatttccaaaagcccttcctcatccctagctctccccaacctcgaatcacttgaggttgaagattccagagtcaggcttccccggagaaaggcccgctcagataagactggcgggtaagtggttggctctctggtatgaacttgtgctctgtcacctgaagggcatcaacaaacaaaggaggggtcttttagtgataaaatatagaaaaacacaaaataaccacttcagtaggaaaatgaagatgaaaatagtgcctatgatacttgctgcatttttacatctctaacccaggttaccaaatactgcttacggtccttgtatccttgacaccattaaagggaaaatctggagggcaggctggaccgggggacagaggatccggagtaaagacatttctctttacagttcagagtaaggaagagataatagagttttgatgacattgtctgaagggcatttgctttaagaattgaacgcttacatccatctgacaagggattaataaccagaatatataaggagcttaaaccactctataggaaaaaatctaagaatctgatttaaaaatgggcaaaagatctgaatagacacttctcaaaagaatacatacaaatggccaacaggtatatgaaaaactgctcaatataattgaccatcaaagaaatgcaaatcaaaactacaataaggtatcatctcatcctagtcaaaatggcttttgtccaaaagacaggcaataacaaatggtggcaaggatgtggaaaaaagggaaccctcatacactgttggtgggaatttcaattagtacaactgccatggagaacaatctggaggttcctcaaaaaactaaaaatagagccaccatatgatccagcaatcccagtggaggtatatacccaaaagaaaaaaaacatcagtacatcaaagagatatctgcactaccatgtttactgcagtactaggcacaatagccaagatttggaaacaatttaagggtccatcaacaatgaatggacaaagaaaatgtggtgtgtatacacaatggggtactatttggccataaaaaaggagatcctatcatttgcaacaacagggatggaactaaaaatcaaaacaactgaactcatggagagagagtagtaagatggttactggaaactgggaacggcagtaggatggagtaggatcctactccatggagtagtgaggatggttaatgggtaccaaaatgaagttagaaaagaatgaataagacctagtatttgatagcacaaccgggtggctatagtcaaaaataatttattctatactttgaaataactaagggtataacgggattgtttgtaacacaaagaaaggataaatgcttgaggtgacagatacttcctttaccttgatgtgattattatgcattgtatgcctatattaaaatatcttatgtacccacataaattaaaaattagccaggcgtggtggtgcatgcctgtaatcccagctactcgggaggctgaggcaggagaatcgcttgaacccgggaggcagaggttgcagtgagccgagattgcaccattgcactctagcctgggcaacaagagcaaaactctgtctcaaagaagaaaaagaaaaataaaaataaatgaagccttttggtgctataagagtttagggaagttgcacctaatgagactggaaagaaaaagagatcatggaaggctttctagaggaggtgtcccataagctgagtcctaaaagagaagccagagtcattgccagagagaggaagtgggcaatgggttgaaggtgaggaagtaaaaatgggtagattcaccctttgggcaccagatgcctggtgaaaccaatataaaagggtgattagagttggagcaagaaaatgaagattccagcacaaaagggatggaagtacacacaggaacaaatggtacaaaaggcctagtgtagtaagatctgacaagtttctgctgtgtcaggaggcacaatgcatggcagacaagagggtactggagacagaatgactcagttcaaatcctgcctgtgtcaagtgggttgatactggaggatgactttctccaccaggtctccaattcctcaactaagagactaggagactcaatttctcaggctgtcatgaggttaaatgagaaaatgcacagttcttgatgcagcgcaagtgttcattaaattgtgggacattacccttattattttcattgctgcgctgggcaatttgggtaatgccagtgacactagcaagaacaacttcagtgctgtgatctgaggaagctagcagctgtgcttcatgaagtggccagcatcgcatgcttagaagacccgagtgcagcagcagtctcatacctggaatggtggggatgggaaatggtgcggctactctggaaaaatatttgggggtttgacttaaaactgagcacagatctgtctcttgactccaccagtcatctcctgggtgtatatgcaacagaaatgagtgtttatatccactaaatattatggaaaatagtattcatagcagcattcttcataatctccaaacaaggtaaacaatacaaatgtcaaccaataggagagtgaagaaacagatcctgatgttttcacataattttatggtacacagcatataggataaacccagctcatggacacaatgatggtgaaaagaagaaatacacaaaagagaaactgctttggggctccaattatgcccattcacaaccaattaaaaactagtccctagggagagagtctaaacagtggctcccactgcaggaggagctattgacaaagacagggtaacagaaactgccgaggtgctggaaatattgtaaatcttgacctagatgaagaattcaatttgcagaaatgcaaaaatttaagctgagcccttcaaatttgtacttattattgtatacataagattttttttagtttgagaaattttaaacaaaaaaatattaaagtcaagtgtaaacatctcttccaaacatgagacaactccaagaagcttggctttacaagtggggtcaacacaagttacagggtattgtaggtgaaaaagcattttgtctgttttcgccaagtgtaagcaatttgagtacacttttttttgtttgtttaaacttatattcactttctggttttgtattgtgcacactttttatttgaatatagataagttgaaggtacagacaaagcagagattttttttaaaaaaagcaagttccctgagaacacagcaggtatgatgcaggcactggcaaagacactgaccatgactagaggtaagatctcctccatagaggacaagagaagccaagtatgagaccgtgcagatgaatctttaagaacattaaatacacatcctatttttaacatgaaattaattatatactgaaacatcagctgctggggaagtggtgaaaatctgaaacacatctgagtggctgcaggagccggtgcagggacaagagctgcccagaggaatggggcagatgtggggagacctgtcaggagcctctggtatggcccaggcagaagattatgagagcccggactagggtgttggtgaaggagccaagggaagcagtggaagtgatggacttaggagatatggatcatttaaaatgagcaggactagggatgaatggatgctgggtttgatgaaggtaggtggagtccaggagctatgtggtgtgtttccagccttctaacctgcttggatggtaagacattctctgaactgagtgtctttttaggcatcaggagctaaaggtgcctctgagacacttaagtggagatgtgggattgagggaatgggaagggaggtatttggaacacagggttgcagatggggctggccaagaagcccaaggggagagcccatgactcagtggtgatacaaatccacaaggcaaatggctccagctacactcatcagcacagatgtagggcagagaaggccaaatgtcaccttggtgtttctcagggcaagaggggcaggaagatatggagcaaagggctgcttccgagtctctgatggtctaactggaggatggatgagtggacggagagggtggaaaagagtgggattcacagcataatgcagacagtaatatcaaggggaggaaagtcccctttctcttgagtccagaaagaaatgtatgacattacatttatgatgattaaaactgttcatgcataatactaactagctgacatttgttgatcctatggaccaggaactgaactaagcagtgtcatgtgttatctctacatcctctaacaactcaatgacacagaaattatatcactctgattttgttgagtagaggagtctgaggtgatgtaaaccaaacccattaattcttttccatgggcacatagccaaatcacatttgtcagtcctgagcatctaggtgtggccaaatgcctagttcttgtcaagactatgtggttgtcaagtatgtgtacaactgggtatgacttctccccttcttcttgttccccttctaccagctggattgagccagagcaaccataaagattcctgttcacagcaaaaggtacctgtgtctctgaataattgtgtggctcagtgctcacctgatgatggacactatgacccaaagtgagtcagaaacaaccaggcccccggaaagccacaatgagcagtttcacacagaaattcagaggcagtggtgccctcacattatctgaagactgccatgactccacatgaccagctggtggctgcttacctgcacaggtagcatgtgagaggcctctcttcactatccacagctcctgcccatgctctagcaggtggaccaactctggtttgggaacccgatgccctgttgatagcaaaagaaatagaataggggtaatttaatgagaaaatgaaagtctctccatcttgcctaggacttcatgacagggtccagacatgaatgcagctgctcccaaagtaagcaaaatgctgatgtgagccctgaaaatcaagggcattgctctgagtgagctgtgttccccataaaaatcatatgttgatgccctaacacccaacgtgactgtatatggagacaggatctttagaaggtaattaaaattaaatgaggccacaagggtggagccttaatctgataaaattatggcctcataaaaacagagagagatctctcctctgtccctccaccttgtaagaacacagcaagtcagccatctgcaagccaggaagagaggtctcaataggaatcaaatttgccgacaccttgatcttggacttctcagcctccagaagcataagaaaataaactctcgttgtttaaaccacccaatccatgacattttattatggcagccaaggagataaaagacaggcacaaatcccactgttgggctacaactgccatggagggtagtgctatctgtctacacaacacccactgcccatgacctccgtctatggaagccaacgttgttcaggcacacaacactttgacagccatgggacacggcaaaggtgtgctgcttcctccagaaggcattttctttctttctttctttctttttttgaaacagagtctcactctgttgcccaggctggagtgcagtgctcggctcactgcaacctctgcctcccaggttcaagggattctcgtgcctcagccacccgagtagcagggattacaggcatgcaaaaccatgcctggctagtttttgtatttttaatagagactgggattcacaatattggtcaggctggtctcgagtgcctggcctcaagtgatcctcctgcctcagtctcccaaggtgctactgcacccggccccaggaggcattttctaacaaatctaaatcattgcttctcaaacacctcgtgctttcagaaccacttggggatgcgtgattccaacctcaaaccaaatgaaacaaaatttcttcgtgtgagacctgggcatcagtacttccaaaatgtgccccccaaaattctggtgcccagatggggctgcaaaccactggctgaggctggacatggtggctcatgctgtaatcccagcactataggaggccgaggcaggaggatcacttgaggccaggagttctaaaccagcctggccaacatggtgaaaccccgtctctaccaaaaatataaaaaattagccaggtatggtggtgtgcacctatggtcctagctactcaaggggatgaggttgggaggattgcttgagcctaggaagcagaggctgcagtgagctgagatcatggcactgcacttcagcctgaatgacagagcaagactccatctcaaaaaaaaaggaaaagaaaaaccagtggttgaaataaattggtaatgcaagagtcttcattaggcaggtgaccaaagctggattctcattgtgaaaagaaagcatttattccaaggtgggaggatggattgaacatgggggcctgctgccccagtcaaggctgcagcacccagcatccctatgaggagccagcctgaggacaatcagaagcctgaaccaagaagaaggaacagagaaccaagacatccttgatggcgtcactgggctgcggcaccgaacaagcctggagccaaccacacctcaggcttctcatcaggcgagttagtgaatttccttccaggtgaagccagtttgatctggttttctgttatatgcagccaaatgctttccactagatgtggtgagtaaaagacaggaggattctgtatagaagaccaatgactgaggtacaaggatccacagaaacatcgactggcagattctgaaccatagcccaggattccttcagacatgtcacagtaaggtccaccaatgtgtgctacatgcctggctttgagttctgggacagggctgtgggaaaggtgaatcagatgatcctttggctctcccaagagctgagctccctgtcacttttcacacgctggttcctccacctggaacactgttaccctcttccacctccttctatccagctaactcctactcagctttcaggtctcagctccactgtcacttcctgagatgccctctttggaactcccacaataggttatgacatcctgcttatttattcctaaattcccctcatttttctttctagaacttatttcagttgtcatctatggattgatgtccaccttcccaactgaactcagagtgtgccatcaattctaataacttctttatcctgacccacttttgttaaatattgtattctaaaagggaaccttgttttgctctggtaagtgagaaagtcaatttcccttcctacaaatagaagtctgcaatcacaacacaacaaaatcaaaacaatgccactaagtcccaggaaacccttgtatgtttcttagggctaagttggaggttgtcccctctgttaaaaaaaagaaatgaactgcactgggggagtgaaaggaaaatgaaagactcagcgctgatctgagacttttctttttttttgagccggagtcttgctcagtcacccaggctagaatgcactggcgcaatgttggctcactgcaacctccgcctcccaggttcaagcgattctcctgcttcaaactcctgagtagctgggattacaggcgcgcaccactgcgcccagctaatttttgtatttttagtacagacggggtttcaccatcttggccaggttggtattgaactcctgacctcgtgatccacccgcctcggcctcccaaagtgctgggattacaggcgtgagccaccacacccagctgatgagacttttatgacaagaattagcgtgctggacagagaaagtaaaaggaatggctttatcagggtatcaaaccatgccatttgaggacattcctgtgtaccctctaaaaacacctcctggatcaacagagcatggatatcaagcatcagaaaacaactaatgaccatgcaggcacccagatgcctttttacagagattgtattgcttaggaagatatccgaggggcactgaggacaaatgtcttctggggggctgcctgactcacccctttctctaagaacagcccatcacccatggcccctgcttaatagggctgtggccacagctgaccccaccaggatggccaatcagcttccttcttatgcaatcttgattaaggacctcagaatgggctgagcactggagtgagggtttgtgttaaaaggacattttctaccccgacaatctctgatgcagacaaagggagaccagtcaggaagaggtgggaacagaaaggtctgtcaagagaaaggtgggcagttccagtgacctttttgcctggccaagaatcagggttagggtcctcctcagggatgagaggtgagtcattacctagtgaaaccagaagcccacaggtctccagcatcacctctcggtacagggtcctctgggccaggtccagctgtctccactcctcccgggtaaaggtcacagccacatccttgaaggtcaccaacatctggaaagtcaaacagaagtaatgctattggccttgtgttgtcgcataggatcagaacctgtcactcagtctctagtcaatgtgcagagagatccaggtctgaatcaactaggtctcctttgggctgacttccgtgcagggctcaaaggggaggcagatactgccttttgacaatgcaattgtgcctgagagaaaagccttctatggggaagctgttgaagatgacacaaacaatggcaatcccacgaggactatgggaagcagagagtaagtactctggcatattaaaagaatggaggaaaatgactgatactaatccaaccacaataacagcaacagcagcagctaagtgtgggggaaagaaaaatagatcagaccgttactgtgtctatgtagaaaaaggaagacataagaaactccattttgatctgtactaagaaaaattcttctgccttgagatgctgttaatctgtaaccctagccccaaccctgtgctcacagaaacatgtgctgtattgactcaaggtttaatggagttagggctgtgcaggatgtgccttggtaaacatgtgtttgcaggcagtatgcttggtaaaagtcatcgccattctcccgtctcgggtacccagggacacaatgcactgcggaaggccacagggacctctgcccgagaaagcctgggtattgtccaaggtttccccccactgagacagcctgagatgtggcctcgtgggaagggaaagaccttaccttccctcagcccgacacccataaagggtctgtgctgacgaggattcatgaaagaggaaggcctctttgcagttgagataagaggaaggcatctgtctcctgcttgtccctgggaatggaatgtcttggtgtaaaacccgagcgtacattctatttactgagataggagaaagccgccttatggctggaggtaagacatgctggcggcaatactgctctttactgcactgagatgtttgggtaaagtcaaacataaatctggcctacgtgcacatcgaggcacagcacctttccttaaacttatttatgacacagagtcctttgctcacatgttttcctgctgaccctctccccactcattaccctatagtcctgccacatccccctcatggagatggtagagatagtgatcaataaatactgagagaactcagagactggtgctggtgtgggtcctccatatgctgagtgccagtcccctgggcccacttttcttcctctatactttgtctctgtgtcttatttcttttctcagtctctcatctccaccttgcaagaaatacccacaggtgtagaggggcaggcacccttcactaagtcctctggtcctcactgtgtccctgccaggctaaggcttccttagccgtggtaaagcaaataaaggcctgacttaaatcaggcctcctgaatctgacacttgccagctatgtgactatgacgatgtcacatgatctctctaaggctcgatttccgaatcaacacaataactattcccatctcagcaggcagctctaagaactaaacagaaaatgttcacttaggcaatcagtggagtgcctagcacatgtaagtgcctgatgtgtttgggaactttattaatcccctgacaggcccagaggtaaatgtcgttatcacttccatttcacagtcagcaaaggctcagggagctttagaaatcaggcacagcctcacatttaaaaagcaaaagcagcatttgagcaccgctaaaacacctcaccaagctgccagagagcaggcaggtgggagtgaggggtgcttttagctacagccagcactgccaggatgggtgtggaactgcagccccgcagagacctgagaacaatgtctcagacaaagggaagtgcaagggcaaaggctgaaaatgggaaagagcttggcaagctcaggattccctggatgaatgcagtgagaaaggggacaatggaagaggagaaagaagatgcggtcaaaagggcaaaccaagtacagccttgcagaccatgctggtaggagggggtggatttattggaaatgtgatgagagtccctataagagaggcctattcaatcatcaaccatttattaagtacaataaatgtacttaagcctggctgttctgggtcttgggagagggaagcaacaggcactcacattccagggttggaaaaagatcctaaacaggcaactaaataaatgagtaaggcaatgtcagatggccttaaagattcagatgacaagaaaacagagcaaggagaccaaagagactctggtcagctttaaacggtgcaacagacgagacctctttaagcagcggacaccagagggagtcagaaataaagcaaaggagggagaggtggatgagaaattaacaactacgacaggagctgacagtaatctgggctatcatgaaagtaatcagagtgactgctagagagtaaccctgggcctcatgtgttatctccaaagggacactacatcctgcataccatcgccactgaacattttaatggactcgtttttcacctgtaactaaatgtcttaaacaggaaaatatactgttagttgcaacccagcgtcccttgccctaaactgaaagacaaattcctcagcctgccctaccaccttttctgccctggcatagcagcaaccgcagaaacgctcctcccacctctttcagccgctgcccttcgtgttgtagagacaggaggccaaggaggccagagggtcagactcctgctggggttgagtctccaaacctagcacaggcccagggagcagctccggaaacaacatcctgagcgacgtccccggaccgtgctgtgcactgagacggacacacacacatcacccagggagccgttcaagcttcctcaaccccgggggggggaagagtaaatatttctactttgcgcgcgcaaaaatgaaggacgaggacagtaacgggacttgttcaaggtcgcaggcccgagaaaggacatggttggaagagccacgaggaggactgcggtcgctcctctcacctgtgaggggttccgggaccctaaaagccctatttcataccacaacgccgcgcaccccagaaacggggacgctccccacgccaccgcgggcctgcattccggacccgggaccgcgcgacccccttctaggcctctaagaagcaacggcagggactgcactgaggacgaccctgaaacgccgtccttccgctcgtcgggcccgggacactgaggccgggtggccgcggggagccgagccagtctgctcacctgcgctgcgtccttcgtctccgccatccgaccgttggcaggacgaggccgcgtggggcagctcccacgggctcaaaaccctaccccgggtcctacaacggtgcggaggtgagccccagtcgccctaccatccttcccagcacagttctgagagcgcggaccaacacgccccaccacaaacgtccacgccagcgaggccggaagtcccgcccctgtgtcgcggtcgcctgccacgccttttcctgcgccggcccactgccttctaggtaatgtagtcttgtcccgtaagaggccaggcttggctctttttccttttttattatgcacaccatgtttctgtatatctcagatgatcttagcggagcaagtgtacacactggattgtaaatttttaaaacttcctattattcggatgcctcaacgtccctacaagcaggctgtgagcactcgcccaggcacccaggtaaacgagtttgataaagggggccctgccacgaggttccccgcttgcctcctctgagtgacccagtgacattcccatgtaccagtaaaatcttacgcctggttactgcgtcctcctccaccctgacgccaggcactgtccctgggactggcgtggatctggacccccgcttcccgcgtggagccattcccgggacatgctcgtggggttccgtctgtgggacgtctgcctcctctgtgtggactggtgttgcccagggctcaggaaggtctccaggggccgtgagtccccgcccgcttccggagtccagcttcgtgacaccatcgtgagaaagaatgcagggatgagtcaaaatgaagccaaaggcaagaagcttttattgggaagaaaaagtacacatttttgagaagagtgtacttttcccaagagaagagggaaatgcggacgtacgagggagagcgggtcatgcacaatggagtttgggtttctaattttatgggctcttctaattagggggtgggataatcatgaggtttttctaggaaaaggtgggaatttcttagaattggggtgccaaccatttttatactaaatgtgggcgtgcttggattggcctggcactggtgggtgtgtgatttaatgtggcaatgagtgtataattaggtctggggtaggaaatgggtcaaatctagcgtcatgggacagcctagccccaatcctgtttgttaaggtctcatcagcccagtcttcttgttggagtagctaattttaacagcttgatgttttcccccttctcctgtgaccacacagcattcctattttgtgggtgtttctttaattagagagtggaataattattaggtattctggaaaaggagggaaattcagggacccacctggttactgccccctttctctcttatttggctttgcccagaagagtcatggacatgtcatcctgactgggattttggccattctttctcttattttgggttttctgttatcctatggtttctttgcctagttcttgtttttatttgttgttcgaatttttccatcctcctgcaaccacccagtgctattcctatatcactgtgagtataaacaccctttaaccttataggcttcttgaagtataattcccaagaccatgttgcagtggtccttaaagaaccaataaggcagagagaaacaaacatgttccaaattttgttctcaggagtaaaccttactcaattgttaaaggctgtagctagctcaaaagaagtttccttgactctgaaaaacaaaacaaggatcagcaatgttccaagcaaaagtcaaaaagattatttcagtttttctattagttcagcctattctgttaactcttgttctgcttgatatttataaacattttagcttttcatgagtcctgtatgtttttcagttatcagaaacctgcatttaggaatacctgttaaagtattcctacatctgattatgaaccatattttgaagaggattaaaacaagacaacaattgtctgtaaatgacaaaatgtccagggtggttagtcaaaaacatgattgacaaaaaaaatttggttatctccgtggtttacaataacaacataacaaccttaattgtggttgatagtgtatactttcacattagagttttctaaatcccatgcagttttggaacacatattaatagtatttgctgaaatataacctgaagaagattagacatcattttggcaatcccatgtaacaaaacatgtcaaataatcctgcttgcctcttttctggatgccccagggaccctctgtagcatccaaaacgtaggtgtcaagaaagacaattgatttgtggaagcctgttaaatatgttaacaggcttaaaatatttgatgttatgtactagaattccagattactataagttatttattttgccaaaatgatgactcaaaaatttgaaaaagcaaaaacctttcattagcctttactattacatgaaaattgtgttcaagagagagaaagccaaatttcacccttacattagtgtactattaatgtcaaccacaatttttaatgaaacaattataggcaattctatccaatcttaaccagtttgacaatgaggtgagattttcacaaaccttttataaccctttacaaattttgctaaagagtagattcatgcattaagagttctttgttgtgcttttatttcaatgctcaatttacagaaaaccacataatacccttttgaatgtagtcaatatattcacacagagtttcctttgcaagattaattcttacaattttttccccagtttgcttaaaccttcagttgtattttatctactttaagacaattctttatccctaggcaaaacgtacattgccatgccttcttataattttttacaaaaaacacattttactgtttttacacacattgcatgtaaatctattcagtagtctcaattacatgtcataatggtaactcttagcaattttttttttaagatggaatcttgctctgtcacccaagctggagtgcagtagcacagtcttggttcaccgcaaccaccacctcccaggttcaagcgattctcctgcctcagcctcccaagtagctgggactacaggcacatgccaccatgccaggctgattttttgtatttttagtagagatggggtttcaccgcattagccaggatggtctcaatctcctgacctcgtgatctgtccgcctcagcttcccaaagtgctaggattacatgtgtgagctaccacgcctggccctacctcttagcaatttttaactttagtgtaaaacctggtaagttgttttaattatttgctgggtgcagataaagtttaactccttccagaataagttaggggcttggttacttccatatgttcccagactttacccattgtgaagcaggcaagttgaacagttcttaaaggccaaaggagcagtacaaccttaaaacatttagcaaacctaccatctgacctgcataatttagaccacatatttacatcttgagtacatttgtattttaccaataatccctaagactgttttatttttaaagattaaagtcacatgaactaagagaaattacagtttttactattctttcaaaaaagatttgatcggccaggcgcagtggctcacacctgtaatcccaacactttgggaggctgaggtgggtggatcataaggtcaggatattgagaccatcttggccaacatggtgaaaccccatctctactaaaatacaaaaaattagccaggcatggtggcacgtgcctgtaatcccagctacttgggaggctgaggcagagcaattgcttaaacctgggaggcggaggttgcagtgagccaagatcgcactactgcactccagcctggtgacagagcaagactcagtctgggaaaaaaagaattttatttgatctaagtgcttataggccaatcaattacagctcttttttatagacatcacacaacacatatatgactacacagacagaagaagatccagcagctcagggtggagccctttaagaataaggctacaaaagcatgcagtttctggggcctaataaacaggcatagctcgaaggccaaaacagattttgagagggatttatccatctctaattcttggggttccatgaggaaaacagatttcccccaaattgaatctgtggcaccttgtctgttttctcaaggagtccaaggccaccagaagtcatccttgagcctttcatgcatgcaccaagattggcaagacagagtggagaaaagtaattcagttgactgagatacaaaccttttccagaaaaacaagatctaagaagagaaaaacataaaggcgtttcaaggacacctataacttgggtatccacttttaattaagctgagtgctctttcataaaattcttctttactaattaaaactttacagataatataaacaatgatccttatcttttttttttttttactggtttgcatcactctttgttcacaatcatgttcaggttctccagtttacttttggggaaagtggctggattcaggcaaggacaggtttttaactggactgtagatccctctaacagcaagccctgatatttgaagaggcaattgtctgttagccagagacttcccttagaggatagcagtcctgctatattatgtggggtctaaacagttattttccggctgggtgcggtggctcatgcctgtaatcccagcactttgggaggctgaggtgggtggatcaaaaggtcaagagatcaagactatcctggtcaacatagtgaaaccccatctctactaaaaatacaaaagttagcagggcatggtggtgcacacctgtagtgccggctactcaggaggctgaggcagaagaattgcttgaacccaggaggcagaggttgcaatgagccgagatcacgccattgcactccagcctggtgacagaacgagactctgtctcaaacaaacaaaaaacaaacaaacagttatttcccattattaacttggtggcctctggcacgagcaaagccaccaatgcaacttcttggaggaaggctggccatcctttaaccaccaagtcaagttccttgcttaggtaacccactggctgttgagctggacctcgagcctttgttaaaattccctgggccgtttcctttctttctgatacatagagattaaatgtgttccctatgagaagactgagggctggtgttttaagtaatgcttgttttaactggttaaggcttttgagttttaagattccaagtattagttgcttgagtttcttttatgaggtggtataaagggtgaggtatttcaccatatccaggtacccacagtctgcaaaattcagtaattcctaagaatccccttaactgttaaaggaaatgggcttaatcctttccttacctggtgctcttgtcccttctgataagactagacctaggtactttactgaagtctgacagagctgagctttagattttgaagtcgtatatcccctttctgccaagaaattgaagagagcctcagtgctttcctgttacttccttggttggagcacagaggagactgtcatttatatacttcaaagtttaaacttgagggtgagaaaaattagaaaaacatttggacagggtctgtttcagcaacttccttctgatatcggggggtgcctgagtaataaacctgctctttattgaattgggagacagggaggtgtgtttcactaaggcctctctcagcctttccataacggctgagggattttcatctgatttttgatttaacatggattgtttagagtaattaagaggtttggttttgttttttgctagccttttaatatgcacatcagaaagtgtattccactcatctatgcgatgactagtctccacttagggttttcaaggggcactgtttatcttcctactgggaatgggaatcctgtctcttttttaccctctttccccttttgactgggtttcttttttgactggctataggatacatgctgtttgtcggtgaatctctctgctgccttagggctgcctgtttctcagcagcagttagagtttggcttaggagtaacataacatctccccatgcaagatcaaacatttgggttagattttagaaagcttttatgtatctatcagggtcatccaaaaacttgcctaagaccccctttgtttgtctaaggtactgcaatgatatgggaacttgaactctagtggcaccatgtccattgggcatttcctgcagggtcaacagtgaagttgagttttcttgtgtggcacagctggaggagctgatgcttggctattggaggccccagataagggatggggaggtagagcatccagaagttgcatttgagggggttttctgactttgcggtgttgtccactgtgggcttgtctgatatgactcttaagagggcagagtcaattttgcagtgcttacaaagagctgggctgtttcacagggcaaagaaggcttgcacataggggacctcagaccgtttgccctcccacgtgcagaaaagatctagttattggatattattgaaattaacacttccctcagcagcccaggcctatccatcctggagctggtaagatggctatgtcctcgtacagaagaatataagccatttttcttcagtctcagggttaaaagtctcagtgtctcaggatgcactcaagaggagtgcagactgaagatggtttgttacctgttttaaaaagagtaggagaaaaggcgtcccttggtctttttcctttttttggtgtgacccagggtggagggaaagatcgaaagtgcatcccacttctctttcttcccatactctgggtcctggccaccatcataggtgtcacccatggatgcaagcatgaccttcacccgtggatctggaagagctagttgggtgtaatagtcatgcttacctgtatgaggacctgactctccacgctgctggtttcctagtcccaagtggcccataaggctcccagggtaccctagtggtctgggagatattgtatttgggtgagaccctttaatggagggagtgttttaatactatctctggcttcccttgctatggccctagcaaaacattgaaatcccagagaatgggaccgattgacttccaaatatgaaatcttctttttatttaaatgccagtgtagttcaatgcagaacaggtgactcaaaagaacataaggattgagtggctgttctcccgactgttaaaggtacagctttgctgttaacagatggagcatggagcttagtccctaacagaggcacacaggagggagaggaattggggaactaatggttttgcacaaagggcagatagggctccttatggagaaaaaatcctatttcacttggtggcgctgtaggatctgaaatgttaaataagaactctgactccaaattctttccaggaagaagttagaaagagaggtttgggcttaataggctgtccccattgtatgccttccagaagaagaaaattaacttgtctcataatggaactgtctagattcattgggcagtcctgagcttttacatggaggaaaaacacaacccaaatggagagggagaagggtattcactcagcatgaaatatcccctctatacagtgccatgaatgtctgtcattagggacaaaaagctctcactaggtgaaagtttagacagaaatcctctaattgttctaattagatcaaacctctatagtaaacagttcaaaaattatagtgtcagggaatcatcttcatggttgctggacttgtcatcaacatccccaggatctagagttccatcttctggcctatctggaaaacctcacagacatctacccagtacttctaactaaccatagcaatcccaaagtaccaaaacccctacttattcagtggaactctccttcacttaatggattccacctgaatgtccccttccacacttgccattatacctggacttgaaaagttgagtatatctccagtgcattaatgattcttttgcactcactactatgttaatgacacaaaagcagacgtttccctgtgatgctctgatctaactatagttaccaagtttccaaggcaacagcaaggtaaatggtatttcacttgtaggcaagaagaccatatatgatgtcttctcccagaccagaacacacgggaaaaaatgactgcctaatctgggagggtgggagtactattcgcttctggaaaacaaggtttgtttgaccacccccattggaacaggggaagaatatctctatagacccaacttggcagcaaaggatagacattacaccctgtaggacctctatgctccaactggactcatttttgtttgtggccatgaatgagaagtcacatgctgtaactactcctggctccccagggagccatctgttcttttaggagtagctttcccttatatatcaaaaacttggaacaaagataaatgtatgttgaccacccttgcccctccaagggtcacagtctataacccaataaggcccaggaacaccagaagtcaacaagcaataggattaattctggtgggaatcagggcagccataggacaagcagcaccctagggtggctttgcctaccacaagtcaaccctaaagaacttgactcaaactctagaatccttagccaccaacacaggttaggcactaccagcaattcaagaatctctagactctttggcaaatgcagttctcaataacacactggcattagattatctactagcggaacaaggtaaagtctgtgcagttaataaaacctgctgcacatatattagcaactctggataggttaacattcaaaagatctataagcaagtgaccctgttatgtatattttctttggctcttgcttgtttaacctcttagtaaagtttgtgttttctagatcaatagtccccaacctttttggcatcagggaccagtttcatggaagacaatttttctatggatggggtatgtggggctggggctgggggctggtctcaggatgaaactcttccacctcagatcatcaggtactagattttcataaggagtgtgcaaccccagtcccttgcatgcacagtttatgataaggttagcacccctatgagaatctaatgctgccactgatctggcaggaggtggagctcaggcagtaatgctcactcacctgccactcacctcctactgtgcagcccagttcctaacaggacatggaccagtatccacaggagaggggttggggtatcctgttctagttccaggtaaagacaatgctggcacaaggcttccaacccatccttgtctactattccagagaatggaagtgtccttcctttggggaccttatatgtggtatccagggatgtttactcctttagtgctaggcagggcctaggcccacaaaatcagcagcaagcagtcacagagcccccttaagattaaagaggagtatctaatctctgatgggagagtgagataggaggcaggactccataccagactgaagactggctgaaacagggaacaggcaccaagagcatatctacataatacacacccaccagtgccatggcagtttaccatcaccatgacaacacccggaaattaccatcccttttctagaaatttccaaataacccaccctttgcatgtagttaaaagcgggtataaatatgattgcagagctgccccctgagctgatactcgacacactgcctatggggttgccctgctctgtaggagcagccacagagttgtaaccctgctgcctcaacaaagctattttccatctaccactagcttgctcttgaattctttcctgagtgaagccaagaaccttcttggactaagccccaattttggggctcacctgccctacaacgccacctgatgtcctacctctgtgctttctaaaaccatctcccttaccactggaagaatataacttaggcctcaggaaatgaggataattcatgctgacataaggagctctttaaaaaataaaaaagcagctgggcgcagtggctcatgcgtgtaatcccagcactttgggaggccgaggcagctggatcacctgaggtcaggagtttgagacaagcctggccaacgtggtgaaacctcatctctactaaaaatacaaaaattagccgggtgtggtggcacacgcctataatcccagctactcaggagactgaggcaggagaatcgtttgaacctgggaggtggagtttgtagtgagccaagatcatgccactgcactccagcctgggcgagagtgagactccatcaaaaaaaaaaagaggcagcattatataataagatacctgggggatattgatggacatgctaccttggagtcctgcctagctcagccccttcttcgagaataatccactacccacagtcctgttaaccaatctctggggatacctgacccaaccaggctagatcaagttttcttgcctgaattctggaataaggacctcagacagagggcagagtgtgctgggcactagggtgaggatttgtgtttaaagggctgtttctaccccagtgatccccagtgcagacacagggagaccaggcaaaagcatgtgagaccaaaacagagaatacaacaggacctgtgggtagagggagaagggcttgagatgcctttctcaccaggcagtatgtgcaagaggatggaatcagaggactagggtcacccacatgggacagaaataaagctttacccagcaagaccaagagcccacagttctgcagcctcacatcttggtgcagtgtcctctgggccaggcccaaatatccacatttctaccagatgaaggtcagggccatgaccttgaaaggcaccaatgcctggcaagtcaaacagaaagttgacctcagactgttagatattagaacctattgcttggtcactgggaaaggcacagagaaccaggacatctgagggttgagctccatgtagggcacaagggtgagggacactgcctctgaaaatagggtaactgtggcagaggataaagcctatgatgggggatgtcatttccaagttaaggtttctgctacccaggctccttctgattctctacctcccacatgtcctcctgcactcacattaaatcatcccaagtaatcctccaggttgcttgcctggctccatgctctgacaatcatgctgcagaatggagctgttccctctaagccaggctatgcctacactgtcacaccttgtacaaggagattgtgtgtgttgtaaaaatagacacagccagttactagatgtgtagatgcacttttaccacaggcacatttgttttgctattacctcctccactttctattaatcatacccaaaatttctgtaccaattatgtcccatgcttagctcccatcagcttgagtaccaccatctatggaatcatgggcatcagggcacataggttcctttgcagaagctgggaaaaagcttcgtctcaacagtgctgggcattacagcctgtagaacaatgcaataaatccatcttattccctaaagcacaggagcctgtcataacagccgacttgtcctcaggatgacctctggtccagagaaagtgtagggatccaggccataaattaggacaacaaaattcttgcattgtttcctaggaggccttgagcagcaaggcaaagtggactaaaaccagaacaagaactactgtcattttacttttcctgcacaggccagcaacattggggccccacaaaagctgtccatgcctttatgtaggagcccaaatgtgttttccagccacctcacacagtaaaccaaaccctaagaccacacatagatttaaaaataaggcctttattaccacacaaaccagagcaatgtgaggcagccagttactaggtggtgacttggaggctggaaaaactaccaagtgttgtgtgaaaacaagaatttccatgaagggaagccttccacatcagcttccagcagaacccaggctgggcccttctggccaaaactggtcagatgtatgctgtaatcagtcagaaaagggaaggaattccccttaaaggctcagactgctcaaggaatttcctccaagggttgggagaacacaggtgtatctgcctcgccttagtatgcaagggtgactaatgatttaactctggcaaaggcctccagcagtttagaacatgcaaaggagctcctgcaagacacatatgcctggaactaatgggagtctgacccatcgggaggtctagaagtatgaggtttaactttaggcagacggctccttcacaaaggctctctatagccataacactgaagaaagacatggcacattccctgcaggtctaaggcttttctcaggtttggagtttcaagagttaaacaatgttagatcttgggctgtagggttttccacatttgctgctgtcacgaggcctctccacagtgtgagattttcggtggagaatgaggccagagtgttgtgtaaaggacttcccacatttgccacactcatatggcctttctcctgtgtgaaccacttggtgttgaatgaggctagacttttggataaaggatttcccgcactgtccacagtcgtaaggccttaatccagtgtgaattttctggtgttcaacgagggtatagctttgtctaaaaaatttcccacattcactgcactcaaaaggcctttctccagtgtgagttctctggtgcctaacaagtttagatttgaacataaaagctttcccacattccccacatacataaggcctttctgcagtgtgaactttgtggtgtttattgagggtggttctttggctaaaggattttccgcactcatcacactcaaagggcctagctccactgtgaattaactggtgctgaatgaggccacactttaggctaaatgatttcccacactggccacactcataaggccttgctgtagtgtgaattctctggtgtacaacaaggctgaagctttgtctgaataatttcccacattcaccacactcatatggcttttctcctgtgtgagttctctggtgtcgaacaagagtggatttggacccaaaggcttttccacattcatcacactcataaggcctttctccagtgtgaattctgcaatgttcaataaggttggaactttggctaaaagatttcccacattcaccacactcgtaaggcctttctccagtgtgaactctgtgatgtttaatgagggtggctctttggctaaatgatttcccacactgaccacacacataaggcctttctccagtgtggattctccgatgatcattcagatgagaggtttggctaaaagatttcccacattcactgcactcataaggcctttctccagggtggactctttgcagctgaacaagggagcactcacagcagcaggctttcccacatttgctagattcataaagcctttttccagtgcagactctagggtgaaaaaaagtgtgtttgtggctggactctctcctgcattgactccacttgtaatgacttattccaacatgaaaggcctcctcacatttgctgattttgtttggcttctcatagttagcaatagcttgcggctgaagaatgcccaatggggctaggaagtccttcccaacctcactgctggtgaaaggcattcctgactcatggaacaggcagcactgcacaaatgaggccttgtccatgtcactttccaagggtttctctgcactatgatgcttctggtcctggtgaaagaccgcacatgccccagtcaagtatagttcctgcccaggcaaatcggtcaggtgcaaaatgtcggtcaggaatgggacacacatgtcacaggattgaatcttctgggtggatggactggcctctggagtcctgacctgaggtactccttctacagaaacactttgctcaggtgtctcttcatcctccatcccatgccaacaaactgaaagcagagaaacactgatgaaatgcacgttgactatgatgggagtgtattagtcatttaaaaaactattttctgaataattggtgttctgacatcttaaaaactttgctggcctgagctcaggagtttgagaccagtctgggcaatatggtgaaaccctggctctactaaaaatacaaaaaattatccaggcgtggtggtgggtgctactcaagaggctgaggcacaagaattgcttgaatccgggaggcagaggttgcagtgagcccagatcgcaccactgcactccagcctgggagacaaagcgaaactgtctcaaaaacaaaacaaaacaaaacaaaataaaaaacattgctggctggggagagaatggtgcttccagagtgagccaactcttaaagagatagcaaagggctcagcaaggagcataacaaatacaccatcaatccagagcccatactcccaatcacattttctatgtgacttggatgcttcaggagctaatattcctctgctctagtcatcccaaggtcaggcaggagacaactacgcctagtgagcccctttgccccaaagcaaactactcaaattacccaatcctaaactgtttattatgtcttgtgttacctgcagaaaccccaataaaggctgtggcttaatattttccctcctctcttgcttctaccttctgaccactgagcacttcctcatgtggccctgcatggcatggtgttcacatgctcttgctactgcaggtgataaattcctatgtcactgacattaacctctctgtattggcactctactacctccattaattaaaatcctgtgggtacataacaggaaatgggaagcaccttcacatatacatcaaggaatgaattcacagtattgctttgaagcaatattgaggaactgaaagcaggataagaaagaggctgcttggcagtagtgggcctctaaagatcacaaaatggggaggcctcaccaaacacaggacgtaagaatggggtacagtacacaaggagaggcagggtctccaatctattcttttgccaaatcctgtggcaagatcttgtcagctggtggcacgtgtatgctgtgctgaaagctggcattattcgggcccaagataatgcaattggaagtgagtgggagattccaattgcgatcttgtgttcaagaaatatttaattggcatgtgcacaactcacaacatatcgtgagtgggtcagtgttggaaaacatgctggggggcagtgcagagaaactggtgacacatggagggcaggaagatgggggcagcacgaggccggatgtcccagatgaagcaataagccagcaaagtgtcaaggaagaggaagaaaacatagaaatgagatgtgtccagtggcattagcaccaaactctggatgacacagggcaaattcctggtaagattagaaaacaggctggatgccatgtcctcacccaggtgccactgactgaggccaggcttcctctgaagccatattcccatcttcaccctttccaacaaccagggctttcccaccacctctagatgtgccactacttgggacctgaatgaagcaagtcctaagggaaagctgggacaggtgagtatcctgcagtggcccagagcaagtcagcagccttgagaacacaagaaagaaaattaatatcacacagatccttgaaggaggttctggcaaccacagctcatggtccatgtaaatactgatgaggaaaattctgcaaattcctaacacaggtagtcaaaggaaatgtcatctaggaggcagaatttgagacacaaagtaccatgaatatggacacagccacccaaagaggaagtgaagaagtaaacggagatgcattaggctgactcaagacacctaacagccagacccatccctgtgcattttgggacagcaaatgtcagggctgattaaggagtgcaatgatttcattccttacaccacagcacatacgccaagacagtggggaagtcagcaaagcccacggtccggcagagctgcctctgaggaaaaagaggatagacgaagaccaggacacgagagtgggtgtgagggccttacccagcgcagttataagtgcaaagttctccagcatcacatcgcggtacaggagcctctgagcctcatcaaggagcccccattcttcctgggagaagtaaatggccacgtcctcaaaggtcacacagccctgccatgatggggatagatctttccatgatcagattctctcctaggaccccaagttcatgccccccacacatcctttccctgcttatccccatacctaagccccacctcagaggagataccaagacctggtggcactgattcctgccctctcctcatggtcccatcatcactgtgtcttcccacagcaccaacaggcaggtgggccaggaaatgccattttaaactctgggtctagcatatagggctggattttgtcttgtcagacagttctcctggggtttccaaaattatgccactcacatacaaacaatgatgaggtttgccatcattcttatatcctcaatgccatggccatgggttgttcagttcacacttcctctccatatgcacatcactctttgaagcacacactctctcaaacaatctcactcccacggctatttccaccctgttgccccacaccataggcatctctctggcatccccacgatagttggaatgcaacattcagaaagtgcttggcaaactgaaatgaggtccggtgccactcaggctgaatggtccccactgccaaaggcagcccttcagagaccctgctctgaaggcctccctgcctgactctgtccctttctacatcctcagtcacccagaaatacctggggatctgacaccgatggccctcttgcactagcgctgcacttgatgtcctctcttaagtcacagccttcctctcctgctaaccctcattcaaagtctgccccaggggacccccacacctcaggcccaataactcccagatgaccacctgtgcccctcaacttatccacctccctgaaattcctgacacctcaagggttgccacaaaaccctggtagatatatccagagtgctgagtaagcactagttctggtctcagtgtcatcttgtctcaattacttccaagcattgatctcatgcccactcttctcctagatccttggccacttgccagatcatccttgctctcacaccctaccatagccacctctctcccatacctgtctttgtgattcccaccatgaccaaccatgtccccaagcaggagagccagtagtgacccccaaccttccttccctgggctggtaatagcattaccaaagtgatcacgattccacctcctaattgtgtcccaagctatacccctaggcaagtagtggccaccaccttttaaatgtctctatcctgaatccctcaacacagttctagtcctgtaggataaactatccacttcatgtctaaactaactgttctttgaaacatctcagactctaaaagatgtcccattgggccatgttcagatgatttttattaaaaaattttaaaaataaagatggtccatatcaaaatttctgattatctctagagataactgactctactaccaactttacaatcctcgctagtggagcttccatatttccagctgctaaacccaaacaccttgcttttacccctaaatcctacttttctatctcaaaatccaggcttccctacttaaaaaaactgatctaaaatccaactaccacctccacagccaccacacaagtccagccaccagtaacactcacctggactactgcagcagccttcttcactatcttcctatctcatacctcacactcagcctgttctctcagcttggccacacacagggaacctgatgagacctggatcagatcacatacctcctctgcccccaaactgtcattgctcatcacacactccagaagaaacacccgacaactgacagccattttttgtctgattcctgcatcccagctttcagttcccatgagaaagaaaacagctgtagtttcctaaaccagctcagcctgaccttcaagcacttgctcatctggtatctaagcctgagacaacgttccacaccttactttactggttcccagcaataggaaccattctataccagcttccagcctggatgtatgaccctgggactgatgtttgttcaggattcctagaaccaaggacccaaagagtgccaagagaagagtcccagaacacaatctcagagacaaacactggggtcagcatcagtgagggcccgaaacactctccactcacctgtgtaaagcccataagtttagcttctgcagtcacgggaacctgcgggaagaggaaggctatgagaggcaggtaactatggtggaagctccatgggctgatgcctccttgtttccctgcgcagccctggagccaggtgacttggtgatgactaaattattattgctcctcagttccgtgtgactcttacctgctgtgggaccttgcacaaggactcaacttccctgtgcctcggtgttatcccccttccaggctgttccaactctgagtaactttagaaaaaatttgaaaagtctaactcagaccatgtgcctcgtctgttcacaaccacccatggctctcagcgtcttgaaaagaaagagcctcattttaccattcgggcgtgaacgttactggctcaatcgtcccagcaagattcacagaaaccggcccctccgcctgccacaccctccacagcccacgacaccaggcttgtaaatgggagccccacccgcgagggcctcatagtcctggactctagggtcgggctgcagggacgcaagcaggcgcccctcatgcagggtgttggatttccggcggagagggcaggtgaggcccgggagacgcagcactcaccgaagtcgaatccctaagcacggccgccgccatcggattgtgagcggagcggggccgggagcggcgggcgacccggggcgggaacccaggcacggctgccaccagcgccagcgacccaccggctgatgcgcagcggggcgacccccgctctgtgccggaggcagcgtttctaactcaggcggcgtgggccgaggtagagaaccaccaaaattaccatctcggagcggtgccggaagtcccgccttaccgtatgcaacaaacggagacaggtccgttcctgaacgttgattggctccgcgtctttgcagcttggcgctcggcattatgggtaatgtagttctcagaagcccagggttccggtgccctccctgagattcacccggaacaagggctaagcggcccgcggagggcgctaggaaaaggcgcgacaccaagagcgagacagggacttgctgctccttaaaggggccgctggccgatttccgcagtcccatacccactgaagggagtgtctgggttaagataagaggttgtagagaccaaggttcttattaagcagatgaagctttcacgcagcaggcttcagagggaatagattgtaaatgtttcctatcagactttgaaaggtgccagactcttaattctttcctggaccatgaaaataaaaaaaccctggagaggaaaggggattctcagcaaaatgcagattccacaagacacacctttgcagggcctcttcaaaatatgtcaaataaataaagtttagagtaaaatacttcaattcctttcagggcctgctatctgtcatgtaatgctatactacaatcaggctggaattcactgtcttattgctacaagaagtcttaaaatctctgttttaatgttaatgctggtcagttgtgcctgaattccaaggggaggagggcaagtctgaccctcacttcccatcacgtcctgaactagtttttcagattaactttggaatgcccttggccaagaggaaggatgcattcagatggttggggggctgggaattttatttttggtttacacttctcatgcctcttggaatctctgaaccacatacaacggccatttgttgagtaaaagcttccaatgcaggaaactgtctctttcagcctcatgctatacaccattaaaacagtaattactggcaataagactgggctttcttaaacatacaggatctcacagaccataagcctatgatccttcataccagctgcccataatacttttggttttggaagcagcaccccataacctcagcatggctaccaaggcctccttaagacagggtagaatgaataagatctagtatttgatagcacagtagagagactacagtcaacagtaatttattgtacattaaaaacaactaaaagagtattataactagaatgtttgtaacacaaagaaatgataaatgcttgtgtaccctgatatgattattacacattgtatgcctgtatcacaatatctcacgtatcccataaatatacatacatactatgtactcataaaactaaaaattttaaaagacagataaatggcaagcaggtagatgaaaacatgcttaacatcattgatcactataaaaatgcaaatcaaaactacaatgagatatcatctcactctagttaaaatgacttttatgcaaaagacagggaataatgaatgctggccaggacagagaggaaagggaaacttcatacgctgttggtgggagtgtaaattagtaaagccactatggggaacagtttggaggttccccacagaagtaaaaatagaattaccatatgatacagtttacaccacccagaaaagaaatcagtatatctaatagagatctgcactcccatgtttattgcatcactattcacaacagccaagatttggaagctacctaactgtccatagataaatggataaagaaaatgtgatgcatatacacaatggagtagtatttagccataaaaaaagaatgagatcccatcaattgcaagaagacgggtgaaattggaggaaattatgttaagtaaaataagccaggcacagaaagacaaacttcacatgttctcacttatttgtgggagctaaaaatttaaacaattgaactcccggagattaagcttagaaggatggctaccagaggctgagaaggatagcagaaatggaagggaaagtggggatagttaatgggtgcaaaaatatagtcagatagaaggaataaggcatagtatttgatagcacaacaaggtgactacagtcaacaacaatctattgtagaattaaacataactcaccgggcatggtggctcacgcctgtaatcccagcactttgggaggccgaggcgggcagatcacaaggtcaggagatcgagaccatcctgactaacacggtgaaaccccatctctaaaatcaaatctctataataaatctctaaaaatacaaaaaattagccgggcgtggtggtggtcacctgtagtcccagctactaaggaggctgaggcaggagaatggcgttaacccgggaggcgttgcttgcagagagctgagatcgcgccactgcactccagcctgggcaacagagcaagacttcgtctcaaaaaaaaaaaaaaaaaaaaagaattaaacgtgactaagagtataactggaatgcttataacacaaagaaatgataaatgcttgaggtgatgaataccatttatcccaatgtgattattacacactgtgtgcctgtatcaaactacaccatataactcataaatatatacacctactatgtacccctaaagactaaagataagaaatcaaaaaaataaagacaggatggagctaaacctgggccctctggaatgttctacctgcagatggagctggcctccactatcttcagtcccttgctagatgtcatggtccttgaggtcaacactccccacacctgcggaatcccttgggattaactgggtgaacagtaatcgaagttagtggactatatgaatgacgctgccaagctatacttgaatagctgtgccaaatagacaaacacagaaagaaaacacaaaacaacccatccacatcctaagggcttcacactttcttgcactctatcttcaatgttttttcagctttctctttaggtacttattgactgttggtctcacataagtttagccatagatggaatttattactgctttgtgaccactggcagcctccctcatctctggctgggcttctccctgaaggactgggcctcaggagtaggtgggtcatttgtcccctgggcatgccacacagagcaggttttccgaactaggctatccctcctccccaagttatccaggcaattccgctagttctatgcctagatggacacacatgcttgaagtttggggagccatgtttgatgtgatgtggcaactctgaaaggacagtgagggtgagggcaggtgttaggtggccattgtgggggctgctggcctctgggaccagagggtaatgaggtgcacaaccgtgtcacctagagggtgccagtgttaataaggaaaagggttgctgtccgacgcacacagaagccaatgccatggcaccaggtttttgagaaaagcaaacctttattgcaagtcgacaaacaagaagacaggagtccagctcaaatctgtctccccaatatggggtttggggcagcttttaaggattaggaaggacaggttggtaagcactggaagggtggattttgattggaaggacttcaaacaaatctattgatggcaaggcggggatggggttgttatcacccaacattcagagacaacagaccccttgctttcggaagtgtttcagcacttgggttccagccatagcctgatattttggtttcctgtggtgacagggtggagtctggtaggtgagacttcagctccgagtgttgggtcaatgttttcttttctcttttctttttatttatttatttatttacttatttatttattgagacagggtctggctccgttgcccaggctggagtgcagtggcataatcataactcactgtaaccgtgatctcctgggctcaagcgatactcccacctcagcatcctgagtagctaggattacaggtgcaccaccatactcgggtaattttttagtttttgtagagacggggtctggctatgttgcccaagtggtccttccacctcagcctcccaatgtgcttggattacaggtgtgagccaccgcgctgggcctgacattttcttttctgcacattctctagctgtgtaacttgcaactctttagctctgtgcctgcaaaataactggacattatgttaccaacagaggatggccagatgagactggtccagtggttaaacctgcaccttcatggaggccattatgagtatccctacaggccgagtctcagggtgcccccagaagcccataccagccgctgtaaggcagagcatggacttcccctcggggactaaatcccattcttgggctccagaggccttgttcctaccactgtacgccaccgcttggggtgccctgggaacccgcctacctccctactgccctgagggcggttggagatggtcccagcaggtgtgggagatgaggtaggagacgtcttcaacggggtccaaggctcatctggacccagttctcagccgaggggcggtggagagggcgtcagaaaacgcaggaacggctcctagacccaggaggggactcagggaagcagaggcgctttcctcggcggctctggggccttcccagctcgcccggcccccctggaggagacgtcccccggggtggagctacggagaaccccttcccatgggacgtctcggccccgcctcccgcctctgggtacagtcaaagggctcaggtcagagcaggagcagccgggggcgcggcccccacgtggcctcccgggacacgtgcccacagcgcgacacctaagtcgctcctttcacagaatagccttggccccggcacggcctcgaacgccttgaccccgcaagggaggggcacgaggctcctttgctcccgcaggagcgtcgaatacgtatggaatacgcgtcggtgtggatctggcctcagcttcctgagcctgaatcaatgcttctaatcacgtgggcgctcagccgcgacgggaccacagaaatcgaccagcggcctgtttaaggagcgacaaggcccagccctctcctgcattgtggcgacgccatttccctgcgcccccagcgcggccgcttggcttttgtttgaggtgacgctgggcggcagcatccttccctcagccctggggaccagcggggactacagaacccagaaggttttgtctccagccgcagggatgctgagccaatccgcgctgagaaaagggtcgtttccgctttgggaccaatgggtcggggagggacttccggtatcacttcagtggcggtcatttttgcagcgcttgggtgcatccagaccgtcagagctttgggagcgctttgtttggcgacagtcggaaggcgcgaggggaggggtcctcccgctgaacagtgggggttctaagggtcggcggcggcggggttgacggctttgcctaggtccctccgcccgtagctgtcgggtcccggccccgctctgcccacagactccgatggctgcggccgcgctgagggccccgactcaggtgagcgctgcctctactgggcctcaccctccatccccaaattagtgccttcttgggtcactacggtcgagatcctcatgtccagtacagtgggggctcgtgggtggggtccctatttccagaacttgggtgatggggcacggaagagggttacaggcaaagggaccagcgtttctaaactcttggagacacagtgaagaaggttcatacctggagtgccaaggtgaggagttttccctcaattcttaggatgctaggagccgtggagggttgtgtacagaagcggcatatggtctgagttaggtctttcgaagttttccaaaaacctcatggagttagactagaatagaatggaataacacagaggcacagggaggttgagttcttgtgcaaggtcccacagttgctaagagttggcactgaggactggaacgctgaggctcagaaataatgcaggcatcctcagtccacctggctctggcctggacaggaatccagggaagcctgaatccgtagagccctgtatggtcacctgcctttcatgatctttggctttccacaggttactgtgtctccagaaacacatatggacctcacaaaggtgagtggagggtgtcccaggccctcactggtcctggccccatcctggggttttttcatggatctttttgccaccatccagttctttgacctaaggactcttcacaaactggaagcttgacatcctgattctagactggtggttatttgtagacgttcttattgctggcagacaatggaatgaggtgtgaaaggttgccccgcctacgtacaataatgtgtaaggttggcagtgaagctgagctgattcagggaaacacaactctcctttctttctcatgggaactcagagcagcagggcaggactcaggcctggaatggctctgagaaattgggtgttttttctggaggtgatgagaacaatgggaggtttagagaagagaacggaggttatctgacactggtctcatcaggttcactgttaatgcagcatagagaatactctgtgggtgtgatggaggcgatagaaagaccagggaggaggctactgcagtggccaaggtgagttttgatagtggcttcaccagtgtggtggctgtgaaggtagaagaagtggctggattctgggtcagaattttaattaggcctgcttgcattttcagattttgagggtaagagatactggtcaagcattactccaggcattttgaatttagcatctggaaggatggaatctccatcaaatagcatgttataggattgattttatttttattttatttatttatttgtctatttttagacagtctcactctgtcactcaggctggagtgcagtggctcgatcttggctctttgcaacctccacctcccgggttcaagcaatcctcctgcctcagcctcctgagtagttgggactacaggcacatgctaccgtgctaccatgcccagcgaatttttttttttttttttttttgtatctttagtagagacagggtttcaccatgttggccaggctggtctcaaactcctgacctcaggtgatccacctgtcttggcctcccaaagtgctgggattacaggcgtgagccaccatgcccagccaattaattttcattaaggataacaggagttttgtctttagctattatcatagtctgagatattccaaagaatgatatatggagacatcaggtgagtagctgtccatgtacatctagaattctggaagtggtttaagatggagaaatccaaaaggtggtggccagtgtttggcccagagtagctatgggtcacaattaggagtgggtaatcctggtcttgaagataatgctatttataatgcaggaaagggctgggtgtggtggctcacacctgtaatcccagcactttgggcggccgaggcaggcggatcacttgaggtcaggagttctagaccagcttggccaacatggtgaaactccgtctccactaaaaatacaaaaattagccaggcgtggtggcaggcacctgtaatcccagctactagggaggctgaggcaggagaattgcttgagcccaggaggcggaggttgcagtgagccaagatcacgccactgcactccagcctgggtgacagagtgagactccatctcaaaaacaaaacaaaaaaacagaaaagggaaggttggggctatgactgtgtctcatgcttggacacgtggtagaggtggtgagcatcacaaacagttgtgagagaaaagtggtcatgggaagattgtaggaaagaggatgatctggtgtatcagtccattttcacactgctgataaagacagcaagtctctaggaagttccagactttcccatattttcctgtcttcttctgagccctccaaactgttccaacctctgcctgttccccaattccaaaattgcttccacattttcagttatctttacagcacagccccactttactcatactgatttactgtattagtccattttcatgctgctgataaagatgtgctggagactagataatttgtaaggaaaaagaggtttaatggactcatgattccgcgtggctggggaggcctcacaatcatggtggagggtgaaaggcatgtcttgcatggcagcagacaagagagaacttgttcaggggaactccccccttataaaaccatcaaatcttgtgagacttatttactatcatgagaacagcatgggaaaggcctgcccctatggttcgattacctctcaccaggtccctcccatgacatgggaattgtgggaactacaattcaagaagagatttgggtggggacgcagccaaatcatatcatctgataagtggtcaaggcttccaaggcattagggacataagacagacatggagataaagaaataattggtagaagatgacactgaggccaggtacagtggactgtgtccccgcaaaattcatatgcttaaagcctaattccagtgtgatggtatttggaggttgggcctttgggagataattaggtcatgagggtggagccctaatgaatgggattagtgagtgctcttaaacaaagaggccagagagctactatctagtgctctttccaacaagtgaggatacaagaagtcagcagtctgcaacctggaaagagtccctaccagaacctgaccatgctggcactctgatctcaggcttcctgcctgcagatctgtgagaaataaatttctgttgttgataagccacccagtttgtggtattatgctagcaggccaaactgactaaaacactaggactagtgcttattcaccatggtaaaaactcgccaggaatttgttgtgacccttggtgagtctggggagggtgtgagtcaagcagttgaataagtttaggagtacaagtgttcatctgtatgagtcattaggttggaggtagagagccactgagagtctgtgccactgaggccactgattttgaatgagggttaagaggtgagaagaaggttgttgattgaagaggggacatcaagtgcagcacaagtggaggacggccatcggtgtctgacatcaggtgattcttggtggctgaggttgaagcaaggaacagagtcaggaagatagcccttcagagcagggtgggggctgtctatgacagtaggaaccatcagaggtctgtgtagcactggatgatgtctcaatttggcaggcagaggggtggaggtagccgtgggagtgagactgagcgagtatggttcaaagaatgatgtgtacatggagagggagtgtgaactgaaggacccaggcccctggcattgaggacttaagggtcaaaggtgaagccacatttgattgtgtctaggaggcactatctgaaagacccttggggaactgcctgacaagaagggatacactcctacataccgggcccaaagtttagatgtggtgcatcctgcccacctcctggttggtgctgtagaaggatacagtgatcattgggaccatgaaaagagagtgggcatctgtgtcaccagggcctgtatttccttaaggtggggatgattgcgtgggtggatgaacttgtggaggcgttgattgtggagtgacctgtccccatcatgacagggctgtgtgacctttgaggacatcgccatttacttctcacaggacgagtggggacttcttgatgaggctcagagactcctgtaccttgaagtgatgctggagaactttgcccttgtagcctcactgggtaaggccctaataccaactccagtgtcctggtctgtctatggtcttttgctgacttctccactttcttgggatatgtgctatgggatccagcactgtgcactgcctgagtagccctaacacctgctgcccagtggtctgggaacacctgctgcccagtggtctgggaacacctgccactgggcagcaggtgttcttcagtcagccaaatggatctctgttccttgctctcttcttggctgggtgtctgtgttcagatccatgacaccttgtgtcccaagttccctgcacccccatctgctagctgacattttcttgtggctacctgtgtcatgattgtagtcattgtcattgtctatacttatggggacaatgggctcttcttactcactccttctagtttgtttgtttgtttgtttgtttaatgatattaactttcttgcccatgggctgttgtgtgctgagtcgttctgcatcagtgctgatcactcacatgttctgtctttctggtaggacttggcttcatgaaggtcccacatagctagacaactgagggtgtgcagagaaacctggttgctttatagggtgaacatggtctcagagaaggcctgggcttgttgagtggcaactggttgggggcatgatatccgggctgttttccgatcacataaggagcctgtcctgtcttcaccactgtttgggtgcacatgccactggccaaatctcatttctatattttcttctcagtacttgacacttctctctcttattatttttatctatgacttctagcacctggctacctccacctttctgatcttcatgcatcatctgcttctctgcactgctccctctgcaatgttttccaacattgacacacacataatgtctcatgaagtatgtatatatgaccacatgaagatatgtgatcatatcacttgctactcagtttcaattgtattttcctgggcttgggcacagtcaaccttctgcacagcatgcaggtgtcaccagcagacaaggtcctcctgaagactatgtggtgagttttaggaattggaaggctactcaaggataatttttgaggctgttggtagaggaatggtttgaaggcaatgccattccctgtccttcatcccatccttgtgtcctttatttggtgaggcctccctcattctgtgatctttagagatccagtattgcaaagcaaccccttcctcaacttgcccccagctccattatcctcaaaacaaacctggtgaatcattcgtttggtatgtgtgtaatggggcttcttgctctcagcatagtcaatgtatatttcatcagcggttctctgctttcaggttgtggccatggaacagaggatgaagagacaccttctgaccagaatgtttctgtaggagtgtcacagtcaaaggcaggttcatccacacagaagactcaatcctgtgagatgtgtgtcccagtcctgaaagatattttgcatctagctgatctccctgggcagaaaccatacttggttggagaatgtacaaaccatcaccagcaccagaagcatcacagtgcaaagaaatccttgaagagggacatggacagagcctcatatgtgaagtgctgcctattctgtatgtcattgaagccctttcgcaaatgggaggttggaaaggaccttccagccatgttgcggcttctgaggtccctggtctttcctggaggcaagaaacccggcacaattactgaatgtggggaggacattcgcagtcaaaaaagtcattacaagtcaggtgaatgtgggaaggcttccaggcacaaacacactcctgtttaccatccaagagtctacactggaaaaaagctttatgagtgtagcaaatgtgggaaagccttccgtggcaagtactcacttgttcagcaccagagagtccatactggagaaaggccttgggagtgcaatgaatgtggaaaattctttagccaaacctcccacctgaatgatcatcggagaatccacaccggagaaaggccttatgagtgcagcgaatgtggaaaattatttagacaaaactccagccttgttgaccaccagaaaatacacactggagcaaggccttatgagtgtagccagtgtgggaaatcctttagccaaaaagccacccttgttaaacaccaaagagttcacactggagaaaggccttataagtgtggtgaatgtgggaattcctttagtcaaagtgccattcttaatcaacaccgaagaattcacactggagcaaagccttatgagtgtggccagtgtgggaaatcctttagtcaaaaagctaccctcattaaacaccagagagttcacactggagaaaggccttataagtgtggtgactgtgggaaatcctttagtcaaagctccatccttattcaacaccggagaattcatactggagcaaggccttatgagtgtggccagtgtggaaagtcctttagccaaaagtctggtctcattcaacaccaagtggttcacactggagaaaggccttatgagtgcaacaaatgtgggaattcctttagccaatgctccagcctcatacatcaccaaaaatgtcataacacatagaggcctcatgaatgcagcaaatgtggaagcgccttcaactcaagatctatcatcatttagctcctgaaagtccacacttaagtagagccttagacctacagggaaagtgctgtctctgtagtattgtagcagtagagagcctttgtgagggagccatctgcctgaagttgaacctcattcttccttgtttctctggtagaaaccatctaccctctaccaccttgcacagtgggcactggtcactcctatgtgctaagacaaggcagacatctgtgtgttctcttaagtctttggaggaaatcttgagcagtctaagcctttagagaaaattcattcttttttctgactgatcacagcatacgtgtgacccagtttgggtcaggagggcccagccttggttctgctggacacttatgtgcaaggattcccttcatgtaaattcttggtctcacatgacacttggtcattcttccagcctccatgtcaccacgtggtgaatggctgcctcacattgctccagtttgtgcactaataaaagccttatatttgaatctacctgtagtcttggggttctgtttactgtgtggggtggctgggagacagacttcaactctatatgaaggaatggatggcttttgtgggcctctgcaggaaagtaagatgacagagtaattctaattctggttttggtcatacttgctttgctacctaaaatctcctaggaaaaaatgcaaggttttggttattctaatttgtggcctggatccctattctttctgtgagactagaggtcatcctgaggagaggccagctgttatgacaagcatgtgtgcttcagggaataggacaattttattccattgtttccagaggatgtcatatgatgcccagtgctgctgagaagcttttcatggggttctataaggaggcatgccctgatatcaaacattccataggccgatgtcacgcagaagacaacgcgagtcacatgtgaactgtaattggtacagaaatacctgggtatttctgtactgtgtgtactgtagcaaactagttggaatgtgcctcttataaaagtacatttacaaatcttcccgtgactgtggctttgagcagtcataggacctagaaatctgtgtatgtccaatagctgaggttattttcagcaaaaataattaaagggttttattttttaattcttgttggttttctaggttgttcacctcaagtgcattgctgtagaggcagaaaaaggaggataaagataacagaagtcctataggccagggatgtattgatagctcttgtgatttccaccagtgttgctgttgtctcaaattgccacagccttcattgcttgccaacatttcctgcatggagggactcatggttgcccttccccaggcctgaagagagagtgcagtcaacatgagattgctaggcattctggtttctgaaagttgggtgatcagatactttattgtgaaacatgttttacaaactttcttgatgtgtaagtgacatgccatagtttacatccatttatggtgtataatttgaagagtttgtcatacaagcctgtgaaaccataatcatgatcatgaacatattcatgattcacctcttgctgttttacaatctctgcgtgtactttccaggccttcaggagtcctgtcatttactttccctacaggagaatagtttgtgttttctaggattttatgtgaattgaaacgtaaaatacttactccatttttcctgatgatgcacaattttttttttttttttgagatggagtctcagtctgtcaccaggctggagtgcagtggcatgatcttggctcactccaacctcctcctgggttccagcgattctcctgcctcagcctcctgagaagctaggactacaggcatgcactaccacgcccaactaatttttgtatttttagtagagatgtggttttaccatgtttgccaggatggtcttgatctcttgacctcgtgatccgcccgcctcagcctcccgaagtgctgggattacaggcgtaagccaccacaccagctgatgcacaattacttttaagatttatcaatattgcttatgtgaatagttcatttgtattgctgagaaatagtctgtggatatgtcacaatttggataaacagttggatgctttccagttttgggctgttgcaaataatgctactatgaacataggcatataactcttaatatgcagaaatgctttatttctcctgtgtcagtagtacagtgtacgtgaatgcgtcacttttaaagacaaggccagactataacctaactgtaccatttgcattctcatcaacagtatgtgaaccttcttatttctctacattcttgccatacttggtatggttagtctttttaattttagttgttttaatagctgtataatagcatctgtctgtgattttattgcatttttctggtattttatggtattgaacatttgaacatcttgtatctagttgccacctgtatatcctctttggaagaatgtttattaatgtcttttgcttatttttaaatggatgttggtgatactttttcattaataaatagacgtataacaaagacttatgttgaaactttactcattcttcagtaatgtgatgcacttatttgctaaatgataaaattgttttcaaatactgggaaaataatttctcagttttttggtctattcacagtgtaacaactacagacactatatacctgaaacactaccttcattgacaaattctccatcactttcttaggtctaaccattcaatgaaacaaataagccctggtttttaatatttgccaatttccctggtaaaatactcccaccatggccaattacaaggtgtcaaaataatgtcactgaacatgaattgagaagaagtgggtagcgtcacaccactgtattctactttcaccatgccaatacagtagccgcagataacctgaagatcatgtatgtaggaaccatacagcctgtggtgtggcaagactgatgccatcttgaagtgaagctgtcatggtcacctatgttctgaagcagtagcatagatatcatcaaaatgcttctctcccccaatggtcatgagtcttggcaagaaagtctgaagacgtgaagagctgcacgttttaccctaaaaactccaggccgggcgtgttggctcttgcctgtaatcccaacactttgggaggccaaggtgggcagatcacgaggtcaggagatggagaccatcctggctaacatggtgaaaccccatctctactaaaaatagaaaaattagccggttgtggtggcttacgggtgcctgtaatcccagctacttgggaggctgaggcaggagaatcacttgaatccaggaggtggaggttgcagtgagccgagatcacgccattgcactccagcctggcaacagagcaagactccgtctagaaaaacaaacaaacaaaaaactccagccttgttgaccactacaaaaagggtcctataaaggatgtaaaggaaactgccttctggagggcagatacagggatccattgtctcacagctgcacaagacatcacttctgttcatgagtccctatgaaatgtttctgaaaacaatttggcctcttcctccttctttggcctttcagcttcgttggcctttgggatagattttcatacacctgctcactatagaacaatgtatatataagagtaaaacagtaaaatgattaagaattgacttttgagtatttattacttgtgtttttaaaagtggcttaagtgaaatctagttgtcttaaattctgcatatttaaagtatacaatttctattttaatatatactcgaaaccataagtttccacctgccctttttagtccatccctcttaacaagtaatgggtacaaaaacttatttttcctcttctaatggatattttcaagtatatacacaaatggaaaggactgtgttcagatgcactatgaaacctttctaaatcttccattattacttatcatttagtagccattcttgtttcaactcttttcacacataattattttacttacaattcccacatcttgtcattcaatgctgcacctcttcagaatgcattttcaagcataagagctctttcataattcctataactttatcaatcattatttaaggcatcataaaatatatcatcagtgctcagtcacctcgaattgtctccaaaattgatttttaagacaaattcattgcaatcagatccaaaatgaatctatatggctattagtagtttcatctggtgagtctataataatacacagctaccactttttattattattcttgaagttgatgagacatttgtccagaatttgccacattctggaatggtgcgtgtttttgttttgtgtctctctgatgtcatttaacatgctgaccctttctccatattcctgtgcactagatattaaggaaatgggtaactgaactctggtcctgcagataggtgtgcaatagtaacacacttatgcagtgtgactgtgttgtgtgtatgtgtatgtctattcaaaaggtgacattcacagacatctggaggcttagagattattgaaaaagtaaaaaaggaagaagcactttgtttttgcttcctctaagatacctgagaaggtttctcaactgatttgaaatgtgaaacaatgccaaaacaattaccatagatccagtaatactgcttcttggttttactgaaatgagttaaacatttatgtccacacaaaatcttgtacatgaatatttatagcacctttgttcataattggcaaaatttggtagcaaccaaaatgtccttcagtaagtgaacaggtaagtgtggtacatttagaaaatggtatatttatccacattaaaataaataataaaagatatggaagaacttaaatacatatttctaagtgaaaggatctgatatggtttggctgtgtccccactcaaatctcatcttgaattataagtaccacatgtcatgggaggaacccagtgggaggtgattgaattataggagtgggtttttcccacgctgttctcatgacagtaaattagtctcacgagatctgatggctttaaaatcgggagtttagctgcacaagcttattctctttgcctgctgccatccacctaggacgtgacttgctcctccttgccttctgcaataattgtgaggcttccccagccacgtggaattgtgagttctccattaaaccgctttcctttgtaaattgcccagtctcgggtatgtctttatcagcagcgcgaaaacggactattacaggatccaaactaaaaggactacatactgtgatttgaactatatgacattccagaaaaagcaaaactatggagacagtaaaaaatgagtggttgccaggggtttgggggaagggaggaagggatgaacaggtggagcacggaggacttttagggcagtgaaactactctgtgatactaccgtggtgtgtatacaagtcactatgcctttgtcaaaacccatataacaaccagctagagtaaatcctaatgtaaactatggatttgggatgataatgatatgccagcgtaccatcaattgtaacaaatatactattctagtggggaatatttatagtggagtggctgtacatgcatgggacaagggatatgtggaagctctataattttttgctcaattttcctatgaaccaaaactgctctaaaaaataatctattaaaactttaccagcctgagcaacatggcgagaccccgtgcctacaaaaaatcaaaaaattatcagggcatggtggtgcaggtgcatgtctgttaccagctattctggaggctgaggtgggagtattgcttgagcccaggaattcaaagctacagtgagctctgattgtgccactgcactccagcctggatgacagagtgagaccctgtctctaaaaaaattaaaattaactaatttgcaaattagtttaaaatatgtattttgcaatgtttgtgctgtgtatttgtataactcaagggagattaattttaacaaattgaatttggcaagccagttatttccatgagcagcctagttaatttatctacttaaacaacaaaaacaagtagatacacagattttctggcactttccaagctcactatttccctactttgactattggcctaagaaattgccataagagctgtgtgtacctgtagccccagctacttgggaggctgaggcggaaggatcacttgagaccaggagttttaaaccagcctgggcaacatagcaagaaccctgtctgtaaaaaaaaaatatatatatattttaaaaattagctgggcacagtagtgagtgcctgcaatcccatatactcaggaagctgacacagaaatgtcgctgaagccgaagagtttgaggctgcagtaatctatgatcctgccactgcactccagcctgggcaacagagcaagactcttcctcaaaaaaaaaaaattaccattagacactcaaatatgcaggcaaaatgagtcctttgtggagtcactcagaagggctccccacttacctttctatatgaaatcatgctggagccacaccttctccctttccttttcagacaggacttaaattcagcaactgaagagctatctgctctatgtgtcttcagggtaaacatttccagagccaagccaaatgtacttatagacttatatatgactgcactaaaaaaagcaaagtaagtctatgttcagttcaattaattatgttcaatattctttttttttttctctctactgagatggagtctcactctgtcaccaggcaggagtgcagtggtgtgatctcggctcactgcaacctccacctcctgggttcaagcgcttctcctgcctcagcctcccaagtagctgggactacaggcgcacgccaccacacccagctaatttttgtatttttagtagagacagggcttcaccatgttggccaggctggtcttgatctcttgacctcatgagccacctgccttggcctcctaaagtgctgggattacaggcatgagccaccgcgcttggcctagccacaagattattaatagttgtgacgtataatgttttgtgtcgacttgcctgcattaagggctacccaaatagttgggaaaaccttagtacaggatatgtctgtgagaatgtttatggaagatattagcagttgagtctgtagacaatgtaaaggagatctggcctcatcagtgttaggggccaacatccaatgctttgagagccaagatagaacaaaaaggcagagaaagagcaagttactctcttcttgccctggatcatccaccttctgttttccaacattaaagttcttggatcttgggcctttggactctggaacatacaagaatgaccctcacccagttctcaggccttcagcctccaactgggaatttcaccataggctcccttggttttcaggccttcagatgcagactgaatgataccacccaccttcgtgtcttaccaggttgcaaaaggtatatcctgggacttcttagcctccataactggatgagccaagtcccataataaatcccctcttgtacatctatgtatcctattggttctgtgtttctctggagaatcctgactaatacaataggtttcagtaattttcatttcacaactgtttttctaagatgatctcaactccccatgcaagcactgtccctgcagtaacagtatcaatgatcaaaatttcccatcaaagagatgaaagctaggtgtcccaaacctttattctggtattctgatgtcccctttgcacaagtgctctgactgtgaacactacagacactgttctactttaaaatggcatatgctaagtggctcttctgtttagaaagttgctacaatcctaaaagaagcatatctaagaatatggaggaagaaatattatatgaatacaacactgttccttacagggctagacacactcaccgattacacaggcaggagaggcattttctgtgagacaaaattcctctttcgtcctccagcttcggtgcgatctaacggatgttttatcattcctgtcatggcgctatgtaaactctatttcccttattccttactgagcataatgaaactcacaaagctgactctaacgttctactttacataaatgtgtggagaaagaaggtaatgtttactaggctctcgccaagggtagaggcattttgtatctgaataactctgactacctaggtgactagttgtacacaataccctccaaaaatctctgtatggtaccttaaaaaagcagcgaagctcctcccttgtccaaggaggctggagacaccacctctcagccttcccctccacctttctccatagcaacggggtcattcctccctgaggtccaggagaagggcgacctctgccagcccaagaagcggtgagaactacattacccagaggcccgtgagccaggttcttggcgtggagccaatgaggctcaggggagggacatttccgctctgtccaacttgtcggagcggaacttccggcgtcctccctgtggcgggcactttggcttgtgtcagttccatccgcgggtgccggatctggacctaggtgctgacagcgagaaggcgcgaggagagtcgttttctcagctgcacagccggggcctgacggtcgccggcggtggtgacagctttgctcttgtctccgcccggatcgtccaccgctcccggcccgctccgcccagagtccgatggcggcggcactgagggccccgacccaggtgagcgctgcgtcctcccggcctcctctgccctccccacccgaaactgagggacgcgtgaagggttttctgcagcccggaccgcactgtccggcacagtgaggcgctggtgctggatctcgtttctggtagtgtggcagggagcgggagagcgacacggtcagggggctgcgcgggcaacagcttggagctgcgcctgagccgggaggctggggagacccaggccggcctcacgcgtgcaggtagcagagggtggggcagcgccgcgctgcattggccccactgagtttcaccagcacactgagggccacagcgcgtaggacagaagaggggcacggccccagtcacgcttctaaaagtttcacaaaagctgttcagaggaacgcgctggaagggcagtgatgatagcaggcatggagggacctagtctttttacgaggtcacaaagctggtaaaagtcagcaccaaggactgacacccagatacaaagcagtcatccctggacacctggctctggtgttccacattggaaccagaagtccatggagccacactttggtcacctgcctctcagaacatgtttcctcccacagattgccactagtacttacaggtccgtaagaagcacttgaagaccctacaagggtaagtggaggaaatccagaagctcattgattccagcaatgggatctctaggattgggactgtggtgacctgggattctttacttaccgcttttccaggccttgagcctagggactctgaacaaaaatatgtccagggtgagtattatatgaggtggtgcctgttgctggcaaataataggatgaatgtggaagtttgtcccagagataagtacaggtgtttggagctgcttggaggtgaggctgagctggttaagagaacctcaagtctcatttccttctcatgggaacagagagcagaggtacaggagttagaaactaaatggctgtctcagatgtctttgttctggagatgatggcagcaatgaagatttggagcagaagagggaggtgatcttccccaggcctcatgaggctcctgtggctgagcacagacaacagactgtgggtttaagggagttggtagcaataccaaagaggaaagaggagactactgcaatagtccaggtgagtgtagatgatgtgggccagagtagtggccacagtgtggcagaaatggttgaattttggattgtaggtcggctctgattttctggtattgggactgagagataagaaggggtgactcaaggctttttgagtttagtagctggaagcatagaagctccatctactgggagagccaagtagatagtagaattgtttttcactcaggacatcaggaatgtgttttgtccatgttaaaaatatgagatgttttagagaataagtaagtagctatatcaagtggctaggtggacacacaggtcttggactctgaggaagggtgcaggatagagacttctacaaagagtggaggatattattgaactaggatggagccctatgtctgttaggccatttgcattactataaagaaatacctaaggctgggtagtttataaagaaacaaggtttattacagcttatagttctgcaggctgtacaggaagcttagcgctagtctccacttctggtgagggcctcaggaagcttccaatcattgcagaaggcaaaaagggagccagcaaggcaggagggaggcaccagtctctttttagcaaccaggtctcatgtgaacttattactgttggaaggatactatgccattcatgagggatccacctccatgacccagataacctcccactaggccccacttccaacattggggatcacatttccaggtgagatttgaaggggacaaatatccaggctatatcagtgtcttaccttgggttgataatgaaataacctatattggtggcttaaacaacaaaaatttgtttctcacagttctgcaggctaggaaattctacatcagggtgcctctagattcacttatttgtgatgggctgcttcttgacttgcagtggctgccctcttgctttttcctcacatggcctttcctgggagggagtatgtaaagaaagcaaggaatctctttctttctattcttacaaaagcattaattccatcatgagggccccactcttttgaccttatctaaatctaattaccacccaaagattccatctccaaatactatcacattatattaggcttcattgtgttagtgcttcaatgtaagcattttgtgggtgggcgtggggcagaaacattaagcccataacatcatagatcccatttagtagtgggattcctggtcatgatgataatattaatagcaggccaggaaggggaagggtgggagccacaagagggtaccatacttgggtatctggatggatgttgtggaaatcacaaatacaggttatagagggaagcagccctaggaataatacagagagaggataccaggcaggtggccaagggttatgaaggatgagtgaatataagatggatgtggaggctgcattagtccattttcgtgctgctgataaagacatacctgagactgggaagaaaaagagggttaatggacttgcagttccacatggctggggaggcctcacaatcatggtggaaggcaaggaagagcaagtcacatcttacatggatggcagcaggcaaaaagagagtttgtgcaggggaactcctctttttaaaaccatcagttcttctttttttgagatggagtcttgctctgttccccaggctggagggcagtggtgagatctcagctccctacagcctccacctcccagactcaagggattctcctgtctcagcctcccaagtagctgggattacaggcatccaccaccacacccagctaattttcgtatttttagtagagacggggtttcaccacattggccaggctggtctcaagctcctgatcaagtgatccacccgccttggcctcccaaagtgctgggattagaggcgtgagccactgcaaccagccttaaaaccatcagttctcgtgagacttattcactattgcgagaacagcacaagaaagacccacccccatgattcaggtacctcctactggatccctcccatgacacatgggaattgtgggagttacaattcaagatgagatttgggtggagacacagccaaaccatattagagacataatgggatttcagacaagatgaggctgaagccagacctaatgctttactgctatatagcctcaccaggatcttatgactggctcctatgcctagggagtttcatgcaggctggtggatcagtttaggggcagaagtagtcatctgggagcatcacttaaccttgggtggagggccaccaggcaaggttttgaatgaagggtagcaagacagttactgttactgttactgtttagtgcagttactgtttagtgcagtacaagttggaaagggccatgtgtatctgagatatgtatgtggttctgggtggctgaggttgatgaaaggagtagactcaggtaggaagggcttcagagcaggatatggggctgcctgtggcagtagggaccatcataggtctgggtagtcctggaacttgtttgaatttgcaagcactttctagatgtcttgtgctgagtaacatataggaaggcaggagagatgcctgtgttgtgggatcggggtggaggtggctgagggagtgagttgggtaagagaggtgtggtggaaagagtgatgcacatatgaagacggagtgtgagcttttgtttcatgagtctggacattgaggacatgagggtgaaatgtgaacccagaccttcagttgtgtttgggagccatggtctgagggattccaggagaatttatagacacaagaatgtggtttctatctgtccacctgcctgttgttgctgtgggagaacacagtgaccaatgagaccatgagagagtaggcatcagtggcatcagggcctgttgtattcgctgaggtggggagatggggaggagggtgagccagggatggatgtttgggggaatcaacttggggtcctaggaaagatgctgaccatggaatgaactgtccccatcatagcaggtttttgtagcctttgaggatgtggccatttacttctcccaggaggagtgggagctccttgatgagatgcagaggctcctgtaccgcgatgtgatgctggagaactttgcagttatggcatccctaggtaaggccctcctattcctcccagtttcctttgtgggtctctccttttcccctgtccctgaggcagctctgtcctttcttcagttagaccctgagctctacagaccttcccactttcttggcatatgtattctgagggacatcgccaagcaaggcactctcagactgtcctaacacctgtttcctctaggtatgcagtgaagggtctgggagacaggatctttctttcaacctaaaggatttgtccttgccttctccatgacaggatggctttctccagttctaggatgctctttgttccatgttctgccttttgcttctaactaaaatctcaagctgcctgtttcaggaattgcaggtatcatcatgttaactacttaactggtccataggcttttcataaagatccacctgaaagattttcttgtaacattatttttcactgctgtagtttgtcatgtgctgagttgctctgtgccagtgctggctgtgcacctctctggtcttccctttagggcatacatcttataggtctggtatagttgcacaactgggattcgaggatggctctggttgctttacagggtgcaaacagcaagatagtctcagaggaggcctggccctaatgagtgacaactaagggagggcaagacactagggctgtttctaatcacaccataaacctgtcctgagttctcagtgattgggtgctgattccataggacatatatcatttctctcttttttttcttttctacacatgttctgatttttatttcatccatgacttccagcccttagctgctaccaatttctggcctccatgtgtcacctgttcctttccagtgcaacttctagagtgttctctaacactgacccacatgtaatatgttgtcagatgtgcacatgtttttaaatagtccttccacacctagtattcagttcccatgggtgtctactgggcctggacaccaataatcttctgtgcagtgtaccgaagtcctctcttctcatcaggggaggaagtcctgataaaagcttttggcagaatagtgagtcagagaccctacctgttctctctgagttgtgccccatctttgtgtctttcatctcataaggcctcccttgttctgtgacttgtagaggcttttttccacaaatttccaccagctctcatatcctaaaaacattttcttagactcattctttgacacacatttttgatgtaacttctcacaccatagtaaatctgtgttttctcagcatttctcttctttcaggttgctggtgtggagcagtagatgaggggacgccttctgcagagagcgtttctgtggaagaactgtcacagggcaggactccaaaggcagatacatccactgataagagtcacccctgtgagatttgtaccccagtcctgagagacattttacaaatgattgagctccatgcctcaccctgtggacagaaattgtacttgggtggagcatcaagagatttctggatgagttcaaaccttcaccagctccagaagcttgataatggagagaagctctttaaagtggatggggaccaggcctcatttatgatgaactgcaggttccatgtgtcaggaaaacccttcacgtttggggaagtcgggagggacttttcagccacctcaggacttctccagcatcaggtgactcccaccattgagagaccacacagcaggattagacacttgagagttcccactggacgaaagcctctcaaatacactgaatccaggaaatcttttagagagaaatctgtattcattcaacaccaaagagctgactctggagaaaggccttacaagtgcagtgaatgtgggaaatcctttagtcaaagttctggctttcttcgacacaggaaagcacacggtagaacaaggactcatgaatgtagtgaatgtgggaaatcatttagtcgcaaaactcacctaactcaacaccaaagagttcacactggagaaaggccttatgactgcagtgaatgtggcaaatcctttcgccaggtatctgtcctcattcaacatcaacgagttcacactggagaaaggccttatgagtgcagtgaatgtgggaaatcttttagccacagcactaacctctatcgtcacaggagtgcccacactagcacaaggccttatgagtgcagtgaatgtggaaaatcctttagccatagcactaacctctttcgacactggagagttcacactggagtaaggccttatgagtgtagtgaatgtgggaaagcatttagttgcaatatctaccttattcaccaccaaagatttcacactggagaaagaccttatgtgtgcagtgaatgtgggaaatcatttggccagaaatctgtcctcattcaacaccaaagagttcacactggagaaaggccttatgagtgcagtgaatgtgggaaagtttttagccaaagctctggcctctttcgacacagaagagctcacactaaaacaaagccttatgagtgcagtgaatgtgaaaaatcatttagttgcaaaactgacctcattcgacaccagacagttcacactggagaaaggccttatgagtgcagtgtatgtgggaaatcttttatccgaaaaacccacctcattcgacaccagactgttcacactaatgaaaggccttatgagtgcgatgaatgtgggaaatcctatagccaaagctctgccctccttcagcataggagagttcacactggagaaaggccttatgagtgcagagaatgtgggaaatcttttacccgcaaaaatcacctcattcaacacaagacagttcacactggagaaaggccttatgaatgcagtgaatgtggaaaatcctttagccaaagctctggcctcttaagacacagaagagttcatgtgcagtgaatgtgggaaattattttgtcacttttttttttttttttgagatggaattttgctcgtcacccaggctggagtgcaattgtgcaatctcagctcactgcaacctccgcctcctgggatcaagtgattctcctgccacagcctcctgagtacctgagattacaggcacccaccaccatgcccagctaatttttgtatttttaatagaaacaaggtttcaccatgttggtcaggctggtgttgaactcctgacctcaggtaatccacctgcttcagcctaccaaagtgctgggattacaggcgtgagccaccatgtccggcttgtgttgtgacatttaacacaagatttcccaaagaagaaaggccttatatatgctgtgaatgtgtttttgcttgttagtttgttttaacttggtatgacggcactggaggctagcctttgagaagagccttctctgatgtgactcatgtatccaaacatccatggatttcccataaatttgaggtatgtgggaagcatgtgtagctatgttgtactctctaaacctgcccagggaccttaccagattcgtgtcactgccagtttctgcggctgaagccttttcatcactacccgctgggagacccacagagtgtgcatcagtcaccaccccaacatgctcagggaggcagagttcttccattagttggaggaaagcacgagtagtctaagctcttaggggggtttctcatttcctcctgtggctacatagtgcatataactaccccagtgttggccccaggacctgatctgagttctgctggcagcttccagaggattgccttttttgaggacattgttgatctcaggcgatgcttgtgatgaagcattttttagcttccaccacttaccaggaactgcctgttaactggcttgtgcaatgataaaggccttttgtttaagtacctttaatcttgtaagttgtattaattgttgagtagtttggaaacataataggactctgtcagcttaaaagggtatataacatttgtggggattcaaattttgtttgcctcagaggggacagtatgctcacagaatatagattttgctccatttttggcctatttcgcattgtttccaaggccttctaggagacactgcagggctttctggctctgatttttgcctgcatgtgggctcagaggtcattctgcagagggggcagttgtggcaacttccattgtttctggagacaacacaaagtttttcttgttgagtgaggatatcacataatgccctgcaatgtttagaatcccttaatgaggtcctgtgaaggagctgtgtcccttgaaacacagaattcagtgagctagtgtccctagctataaaaccatggggctggagcgaaacataattggtaaagaaacgctgggttgaataatagggaatggaggagactgcagcaaattagatggactgttcctcatataaagtttcatccggccgggcgcagtggctcacacctttaatcctagcactttgggaggctgaggtgggtggatcacaaggtcgggagttcaataacagcctggccaaggtggtgaaaccctggaaggctgaggcagataattgcttgaacttgggaggcagaggttgcagtgagctcagatcacaccactgcactccagcctgggtgacagagcgagactgcgtctcaaaaaaaaaaaaaaaaagatccattcaggccagtcacagtggctcatgcgtgtaatccctacactttccgaggccatggcgtgcagatcacttgaggtcaggagtcagagaccagactggccaacatggtgaaaccccatctctactgaaaatacaaaaattaaccaggtgcagtggtgcacgtctataatcccagctgctctgaaggctgacgcaccaagaatagcttgaacccggaagtggaggttgcagtgagctgagaccacaccactgcactccagcccgggtgatggagtgagactctgtttccaaaaaaaaaaaggctgggcgtggtggctcacgcctgtaatcccagcactttaggaggccgaggtgggtggataacccaaggtcaggagttcgagaccagcctggtcaacatggcgaaaccctgtctctactaaaagtacaaaaattgtaaaagtaaaaagtaaaagtaaaagctgggtgtggtggcaggcaccagtaatcctagctactcaggagacaggcagaagaatctcttgaacctgggaggtgagccgagatcgcaccattgcacttcggcctgggcaacaacagcgaaactctgtctcaaaaaaaaagtatccacaaatgttccagtgactatgactgcaagatcactgtgtgcagaaatctctagaaatgtgtgtcttgtagctcaagttattactagagacaacaagggttttgtggattcctgtagcctctctggcctgtttacttcaaggccattgctgcacagacaaaaaaaaaaaaggatgaagtcaagagagattcggttgtccttggtgcggcttttgtgatccagtagcaatcctcttaacgctgatggaaatggccttcattgctcacctgtatttcctgccactgaagcaggtctgcctctacgtggcctggggagctagatggtagagtcaatagagacttagtaaaccagactttttgaagtgtcaatgaccaagattgttattgcatccattaaaaaaaaatcaagttataattgatgtggaataaattatatatatttaaagtgtacaacttgataagttctgacataaatgtaaacccatggaagcattgttgtaatcataagaatgagcatatctcacctgcatattttacttttgctcttttataatacattccagaatatgcaggcaacttttaacattcctttacaattgattgacttgaattttctggaattttattttagacatcataaagtgtgtatttttttgtgcttttatttataaaacttccccttaggtaagggcctgaggttaactttggaggtgacagatatgtccaacaccattgatagggtgatgatttcaaaagtgtacatatgtgtgtgtgtgtgtgtgtgtgtgtgtgtgtgtgtgtatacttactgttttaatatgtgcagtacattgcatgttgattacacctcaatgaacctataaaaagttattccatttaaaaatctgggcctcccacttctattggaaactggacaacttgacagcctgcagtgttttgaaacagcatggattgggtgtcttgtttccagcatatgtcccatgttccccaacactgttcctcaggaaacagggaggaacagctgttcctcaggacctgctgagtggccatattccctgaaggccagaaaagtaacaaggtgaccgttttggacaaaattctgagcttaaaaccttgcctgaatcagtagcccccaaattcattgtgcacatcttataatttccaagaacacacatattaagtgaatatttttatgtttataattgtgaaatggtctgttcagggctgtcattcctcaaccttttttttcaaccaccctctcattaaggaagcatatgtattaatcatggtttctgttttttgtattatatgtcttgacatcttaaaattcttgctggtgacagagagacttaccctaccagaggtagctaatttctaaaaatagtaaacaactaccttgagagcaaggcaagccaactaccctctttatctaactcttactcaccaagccaatactttccctgcactaaatcatcccagcgttactgccagtgattttgcagcagtctgcagcaattttggtccttgcctcctcagaagaaaattcaaccgaggaggcagaggttggcttaaggcacaggaagagaccaaggcaagttttttttagcaggagtgagagtttattaaaatgttttagagtaggagtgaaaggaatcaaagtacacttggaaaagggccaagtggataacttgagaggtcaagtgccccacttgatccttggcttgggactttatacatttgcttatttcccaggctctttattctccttccttcggtaggctgttgcttgactactgcatgcacagtggtctgccagtacttgggaggggccgcatgcagtttgtttactgaagtcatacatatactcatttggggtgatcttcccttaacaagtcatgcacccccagaggaaggtcaaataccagtcaaattttgccatcttgccccattttgtgcatgctcgaaaccttatcaggggttgtggttcactggctccaggtgttttctatctgttggaaaactcttttccctcctggtaccaatcatggccacttatcatctcagagggatagttttatgctttcctgtccttcacccaatgagagctggacatctcgggggtccctctcttgttttgtttattatctcagaggaaaagatttatgattgcctgtccttgactccaaaattgcctgacattcctggggtccctctctcctgccctactcttatctacctactctaacaccagggtgagggtatgaggcaactagagaccacccctgtaaatcgaagccaaccagaattattcagactagccagtactcagctgtttgctctgatctggcctaggctttcccctagctcttgcttcttcctttagactgaaacctgttcctcctgtggccctgcatggcatactgtacttcccatttctagggaaattctgagtaacattaaacttttatttcactggcattgagctctccatgtccttttccaataaagacccatccacaaattggcctctcttggctatgtaatattacatatctttccagcacttctcaatgccttcaccttctcttttctccattatgcctgccacattctaacattccatataatttagcatttttttcatatttcctcctctttcttgagtacagcgtaagctattggggtctgtctcttgttttgtaaatgtcccatgcagttaagatagtgtctgaaatacagtaggtgttccttgaatatttcttagaactatgaataagcataatactacagcatccctgttcaccttaatattctgatagcactttctaaatgttttctttacttctccttccaggtattattgagtgttttcaagaatgaaaagaggcctggcatggtggctcacatctgtaatcccaactttttgggaggctgaggtgggaggatcccttgagcccaagagtttgaggctgcagcaagctatgatcgtgccactacactccagcctgtgcaacacagtgagatcctgtctccaaaattaaataaataaataaaattacattttggagactaaacgctgcttgtagtcatagttctaacacagctgtgtgctcagcttcatttgctcacttctcagaattcaatgtctcctgctcaaattttgctgtcatcttaaccgttttcacttatcacagatatgtttctccaggtccatttcgtcatgtatctgtgaataactacagaattattaactttgagtaatttggccgggcgcgggggctctcctgtaatcccagcactttgggaggctgaggcgggcagatcacgaggtcaggagatcgagaccatcctggctaacacggtgaaaccccatctctactaaaaatacaaaaagttagccgggcatggtggcaggcgcctgtaatcccagctactccggaggctgaggcaggagaatagtgtgaacctgggaggcggagcctgcagtgagctatggtcgcaccactgcactccagcctgggcgactgagcaagactccgtctcaaaaaaaaaaaacacaaaacaacttttgagtaatttaaacaattcacaaatgtttttgtctttctttccccatacactcgcccttttcttttttaaaaccataaataaatctcaattctcaattcagacactgtcggtgtaattgcaggtgaaatgagaatcacctcccagccaagaaatctgatcccaattttccaaatctttatttctgggttcagacaccacattttcagcccctgtcttggcatataaaagcatttataatggttcttcttttcagataagaaacatcaccaaaaggaaatagatatatctcaacttttgggctaggaactctcatttggataaaagaatatttctcctttggttggacattagtgaccatacaggcaggaaaggtgccttccttgaccaccttctctcgcctgtcttcctcctcatggttctctcaggtattttttttctgaggaaaccagaggaagagctctatattagtccacttgcctcagggagctccagcatccctccatagccactgtctggagaccattcttccactccatggccctgcctggggacaattctctgttaactctgacccaactgaggctcacaaaactgactcaaagcttccctctacagtacacatattttttaaatgaaggaaatttgactgaactatgagtggactcagagtgacattggatgttgtgtgtccatttggtggtgtggcttcagggaacatctgtaagaatatatcccaatatttcggggatccctgcagacctcactacacaagacctggttgagggtcctttaaaaggagcgaagccacgccctgacctcagagtctcagggcataatttctcagcgcccctcgcagtaccatttggcctttgcccagcgtgcaggggagttagccgtcaccacggccaagtgcacatgagaactgcattgcccagaaacctgtgcgccgcccggcggcggcactcttaggggcgtctccctgcggacggaagctctctgggcgggacttccggtatcttcctcgcggtggacatcttgtcggctcttaggtggaaccatcggagcagaagctcggggttgctgggcggttccgaggtgacggaagcgggagggtgcgggagaagtcgctgttcgctctgcggagtggctcgccagcgaagaccccgcctgcgcccccggggacggacgaccgcggtgccagggtcccgcgacctgggaccccctcgcggctccgggtggtctacgaactgtgatggcggcggccgcggtgatgggcccggcgcaggtgggtgctgcctttcccagactttcgcccgccccaaatcctgaagttccaaatgaggagcgcctgtctgagtccctgcagcgcaggccccagtgtccaaggcagcggggcgctggtgggtgggggcgagtgtgactggcagaggggcagcctgagcataggtttggagctggactgagcccgtagcagtcgggagcgtgtgtgaaccgtagtcaggcctgcaatgtcgaggggagaagttgctccttcattgcgaggacgataggagccatggcgggttttgaatggtggagggaagggatccgaaaaaggatttttaaagtattccaatgtttgctgaggaggaaaccgactacagtgaggtagaaacgatgaggatggaggcaaggagacgtttgaggaggtccctgcaacaaactccagaagtgttgcggtggtggctgggccagagcagtggcaggaggggttgggtggggaagtcatgagattctgggtagatttttaaagatggaaccaatggggtttcctgccgcatcagatgtggtcgtgagtgaatgtagggaggaaagggctatccagggtttttttggcctgttttccttcctgaacgtgtgaaagaatggaaattggtaagtcacagcagggagcacgtttcaggggcatcaggaattgggttttggacttggtgaatctaaggtgttctgcactggaggttcatcacgggtagctgaacatgcaggtctggggttctagagagggagttgtgctagagacttcaatgggtgaggcataaggtcaaagcctgtagtagatcagatttagagggtggaatttcaaggaagttattttgtgtggtctctgaagtgagaggtgggtttagggtggaaggccagggatgaaggggtggacacttaagattccttccagaaaggaggggtcctggcatgtgaaagcattctagatggtgttgttggaagtcaatgcttggtgctgcaaagtgaaaccagcactcaggcaaaagttttctcagcaaggcaatttacttctgtgcaagtgtgctgcctgtgttaatcacgatcccaagagcacactgaacaaaggagggaaggggtttttatctctaacccatagtccctaccttcctctgtgtcactcccccatgggctggggtcggaccgcttaatctaagctgagccaattgggtatttgtgagtattttccaaataaggaagagggaaggggaaggtgagttacagtggtgggacatgtgagttgtgtaggacgtgtggttttggcgggggcaatgggtgcaaagtgagtaagggaacagatgtgaattattggttagtgcttacaggaaggttgtttatagtaactaggggcaaggaggcatggagaacaagaaaggtttgagaacaaagaacaaggaagttaacaggctaaacctttgaagaggaattttattatatcttatagtgtcagcaagaggagagggctgtagagcataagtagcctggcctgcactggagaccaaggtgagggatgcagtaggtttgccaccctacaggctcagcatgccttcatgggcgctgcctgtggagcagtcccatccccaaccagtgcattggtgcctcagttacccaaaccctcaggtaagcagaattgatgaacatctctaatgaaggatcactgcagctccccttcagaggaatatgtatcaggtaggctggtttagtgcaagggctagtgtacaccttgcaagtacgcagaaggaactaaaaaatgtatgtacaaagtaagggaaatttatactagcacttaatgattggtcaaaatattaagttgccttgaagtattttattacaatggaaaaatcttaaccaaattttcttaaaagctttaaagcaggcaaaacaaacctaatttttcaaaaactcatcagttcatttgcatggatagtagtagctgtttcaaaggcacttgagatgtacagacaagcctgatacaaacagtagccctatgaggtgggtgccattattatccccacttttaagatgaggacactcagacgctggtctttatgttcacacagctggtgggagccagcactgagatctgagtatctgaagttagagaggtaacccaaaatcattcctgccaaagggcagggtaggcagggcttagggaaacagttcagtcgatgagatcccactgtgggaacctgccactcccagcttccctcctcttgtgaggttgccatggtggcagaaacttatgattcctacctagatgagagtagattgtctcaggccctcacttagcccaacacacccccattatctcagcaactcagtgtggagaatgatagtgttctgggactcttcagtgtcccttctgcctaccgttcttggaggtcctgcagtcacccaaagctctgtgttgtaaattctgttttggaattatgtggaagggtttctatttctggcaagcaatgggatgaaatgtggaacattatctcaggcataggaaccagcatgtgcaaatacttaacttaaggctaaactaggagtgttcagggaacctcaggcctccattatgtctggtgggatcagacagcagggacaggattcagcccagaaatggcagcctgaggatctgggtttgtatgctgagagaattgggagccactgcaggtttggagctaggagggagtgatctgactttggtcttaaccaacttcctctgtacagtgaaaaaagactgtgggagtgaggatgaaggaaggaataccactgaggagcttaatgcaacagttcaggttggaccagagtggtcgctgtagaggtgggagatgtggatggattctgaatcatttttcttaaagtgggaccaaccagattttctgatgtggaagatgagaaagaaaaggcaaggggtgaaggaagaccctggattttttagtctgagaagatataaagatgccatcaactgaagtgacaaagttggtggtaggagtacctttcagaggtaatatcaggagtgcagtttggctatgtggaatctaccatgttccaaagacacttgagtggaggtgtcaagtagacagctggacacagagatctgaagttcagagaagggattcaggttggagctatccacagggtggcagccagcatgtggatcaggatggagctttgcttccaatttagagagagaatctttaggtcatggtgacagtgccatcagcacactgtaagggcagacacagcagggtagaggtaggggccatcttagagtctagaagagggagggaaatgtccctgggaggaaggggaataatagggtcaggcaggtggcaaagcgttccaggcagagagtggatgtgaggtgaagtactgtagtaatagaagtgaggtggcagtgaggccagagccagtgcttattcagctctttatgtgctcctcaggcttccatggtgacctttggtgggacctgtggagtttcagtcaagctagtgaattagcccagggacagattgggtcagtaggcagaatccctgtgcttggggtaggtgcccagtgagtgtaggttttgaatgagttaaatgttgagaagcctgtgactgacctcagtagtacaacaacaaagcagaaaagggctgagtttatctgggatctgcacatggttctggattgctgaattgacccatgaaatagagccaggaggggaagatttaataggtggattcagggcaacccatggcagtgtggccgttgatcaggaccagatgtaatcctggatgcattatccaagcattctctggatgctgtgtgcagatttgcatgtggggaagccatggaggtaccagtgttgtgggtgtccatagatgtaaaggaggtatagccaaaagggtgatgtgcacatggagatggagtgtgaattcatgagcccagagctttggtatggagggtttctgaaagaatgcttagctcaggtttgtgtatgaggaataatctgttgatccccagggagctggctgataggagaagggttgggtcctacataccaggcccatggtgttttatctgtccacttgcctgttctgagctggacaaaatgattaatggaatatgagtcgagaacaggcaccaatcacaccagggcctgttatctcatttgagttagatgtgacaaggagtcctggagagagaggctgtccttaagctcagttgtccacctcacacagggctatgtgaccttcaaggatttatttgtttacttctcttaggaggaatgggagctgctggatgaggctcagagactcttctattatgaaataatggcttctgtgcttcgcatttatagtctccctgggtaaggccccagtatcccatttttctgggctgggtcctactcttcctttttgccctaggggttgctctttcctttccatagctagagcatgggtactgctctcttctctgattccctcacataggtcccctgggtgcctaggctcagctagatgcattggcccctctcttccctgtgttcctcaactcctgctgccctgaagccttgccaggaagggtttggaggtcaggggtcctaaggtgacccagtgaattctgcttggcctctccctggccaggtgactgtccacactcatgacacctctggactccaggctccacccgcttcctctaattgtaatttccttgagtctgcctgtgtcctcaatttcagtcatcatggtcaccacttgtgggcccactgcactgttcctgcaggacaattttctgaggttcattttgtagcatttgttttcttgcaattttgcatgggtgggctactctggctagtgctctcagcctgtttcacctttcccctatgctttgtatcttccagatcctctgtggttgttgaattgtaacaagagagagaactctggctgcctgagagggcatgactctagtcacagcaggaggggcttggacaggccctggtgagtgggagctgagggacgccataacctcagggctgggttcctgtagttccggaaacctatgttgtgcccatcacaagtgccaaggccagaggccctaacttatttctacctttttatccccattctgtacactcttgtcatttctaatctgacttctgacccagggctgtcttctcccattctctaccagaggggctctagtagagcaatagctctctctgcgatgctttccaatattgtactacacttacactattgtgtcataagatgtgtgcatatctgtaaatagtccctgaacacgttacttatttttaatcacattttcctgggcctgtactcacatttcgcataggagtcacctgtcacccacagtcagccaaggtcctgctaaaagtcattgcagaggattaagttggagaccttgtactacaccccatcctcgtgtctttgtttcttgtgaggccatctccattctgtgactcttagattccagtactgtacagcagcccttttttcaacctgatcctagctctgttccaccaggaaacttaggtactcagtcctgggtacagcagacacatatttgtgatgtagttgccccacccaccaaagtcagcatgtacatcaatagtatttttctgccttcaggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtggggcatgtgggagacaattctggttcagtgcaaaccttcatcagtaccagaagtgttacagtatagagcaacccttaagaagggataaaagtgaggcctcaattgtgaagaactgcacagttagcaaagaacctcatccgtcagagaagccctttacgtgtaaggaggagcagaaaaacttccaggctactttgggtggctgccaacaaaaggccatccacagtaagaggaagacacacaggagcactgagagtggggatgcatttcatggtgaacaaatgcattacaagtgcagtgaatgtgggaaagctttcagccgcaaagacacacttgtccagcaccagagaattcatagtggagagaagccttatgagtgcagcgaatgtgggaaagccttcagccgcaaagctacacttgtccagcatcagagaatccatactggagaaaggccttatgaatgcagcgaatgtggaaaaaccttcagtcgaaaagacaaccttactcagcacaagagaatccacactggagaaatgccttataagtgcaatgaatgtgggaaatattttagccatcactccaatctaattgtacaccagagagttcacaatggagcaaggccttataagtgcagtgattgtgggaaagtcttcagacacaaatctacacttgttcagcatgagagtattcacactggagaaaatccttatgattgcagtgattgtgggaaatcctttggccacaaatacaccctcattaaacatcagcgaattcacactgagtcaaagccgtttgagtgcattgaatgcgggaaattctttagtcgaagttctgactatattgcacaccagagggttcacactggtgaaaggccttttgtgtgcagtaaatgtgggaaagactttatcagaacctcccaccttgttcgacaccaaagagttcacactggagaaaggccatatgagtgcagtgaatgtgggaaggcctacagcttaagctcccacctcaatcggcaccagaaagttcacactgcaggcaggctttaggagtgctttgaatacaacaggactcatcaatcagatgttgaatttcatgtatctgaacattgacacaaaggagataccttatggtgccaggtacgtgggaaccttctagggatatgttgcactttctgacttgctcaggttttttgccagagttatgtcactgtcaatccatgtggccgaaaccatcttaactctaccagctaagataccccagcattggggaaggcagggttttgtattgtccagtccctggagaaaatcatgaaatgcctgagttcattgggggtcctcattcccttctgtatgacaggtataggtatggatatgacccatttttagccaagagggtctgagctgtatctgctggtggcttatacaaaaagtttactttcttcatggatattcttggtctcacatacttgtaatcaagtttttccagcctccaagtcacctggcctgggaaagtacttgcctcatgttgctctggtttgtgataataaaggctttacagtttaagccacatttaatcttggggcttcttcttatggtctggggtggattgaaaacaggctctgccaaactgaagacagcctttgtgcggtgcctccaactttgcctcaaatgggacagtgggttgagggagaacagttcttagtccagttttgatgttaacttccatagctgacaaagcttgttaagtaagaattaagatcttgtgtagacctgatttgtctggattttagagttatttgagagcccatatttcaccttgaggagggtgctgctgctgtgacagcctgcagtgttttgaaacagcatggattgggtgtcttgtttgcagcatgtgtcccatgttccccaacactgttgagggaaagctgttcctcaggacctgctgagtggccatattccctgaaggcctgaatctgtttcacaggccactgttggtaagatctaaagcatccagtagggaaacaaaattgataaatattgagtgtgagtaattgggattggggagattgtggcaaactagaggggaagtgcccattgtaaaaacacatccacagacagtccaggcactaaggctgaatgggatcagggtatccagaaatctcaggatctccagggccatgttactgttaggtcaaggtcactggtgcagcaacgaatgtagtttttctagattcctctccctccctgggctctttacctaatgtctttgcggcacaggcggtaaccctgggagtaaagaggtgtggtccaaggaagtagcttttgtgaccagctggagtttctggtgactcttttggcaatggtcctcattgtttgccagtttttcttactactgaggaagagattgtcttcccaagatatttggagtgataagagtcaccatagtgaggtagagtcactcttagtgatgtccagttgtccagtttccaatagaagtgggagatccagatttttaaatgggataactttttataggttcactgaggtgtaatcaacatgcaatatattgcacatatttaaagtgtacgagttaagtcttgatacacacacacacacacacacacacacacacacacacacttgaaactatcaccctatcagtggtattggacatatctgttacccccaaagttaacctgaggcccttaacctttctctcagtgctcgccttcccccagaatccctaggcaaccactgagtagttttcactgtaggtaaatttgtcttttctagaattttatgtaagtctgcctataaagtgttaattttgcatgctgtctttcatgcaacataatttgaaatttgtccatggtatgtatgaacagtccattttaaaattactgagtcatattctgtatggatataccacagtttatccatttatcttaattgatgtctgtactccacccccatttttaaatattaaaaagctgctgcaaatattgatgcatgagtctttatgtggacacttagctgagaacatttttaagcagaggttttgaaggtgtgaccatatatcttactaattatagtaaaatatattggaaaagagatacatacagggaagaactgtgaaacagaaaagacctaagatttgatgatttgggaaattctcagcccatcttaattggaaaaaaaaaacaaaccattgaaattaagagattcattgttaggaaagatagatgttttagagagagagatgttttagagagatagccaaggatgtttgctgataccgggatcaaaacatacatcagaacactgtcacacaaaaagctctttgaagagattaaatgtgacttgtagatcccctcaatacaaacaatttataagaagtttaaactatcactcatctcagcaaaagccaaaaatatagataggggattccctaggaggaataatctgcataaacctcttttctaatgttgtgaatttcagtgatgtacaggagactcacaaaattcttgaaaattttataccagtggaaatgctcaccttgggtctaaagggaccttgaaagtatgaagttaaagggtgtaggcatgtaaagtgtgaagttaaaggttgtaatattctatacatgggactggctgcggaaacaggtgcaagcccttgctacctttcatgagaaaggaaggatgactcagagcagaggagagtccagtgggcagagtcctgaaccatgtgatattcccatgtcttgactcccagtggcatttgccaaactagatttcagattttcttgggattggtggttccattttttttgttttccccccttccatttcctccccttttgaaacaatgcatatacatataactattatcctaggtctttcccaaccttttgtttgggagcagataactagttttctagttttacagatccaaatgagacaggaatagcactgggtggtcacaggaggatggaaaatctcaacaccctggttttggtgcagctgaaaaaaaaaaagaaaaacccaaacaacagctaaaacgggaactaggcaaagaaaccgtgggataacagaaaacccaaaacaaaagagaaaactgccagaaccccagtcagggtgacatgtctgtaactcttccaggcaaacccaaataagggaggaggggtggtaatcaggggtccctgaaatcccctcttttcccagaatacctaatgattacccctattaaaggaacacccatacaattagaaacccaaactttgttttgcatgacttgctctcaggggcactcccacacttctctcttgtgtgtacttttgcttcacaataaaagctgcttgcctttgcttcactgtgactcgtcactgaattctttcaatggtgttaagaacctggatgctgctggggctgggatctcaccaacaatgtccagagacccccccgaaccccccagcaacacagagaagaattgtgccccaagatgggattatacctagagcctcatccatattggacttagacaatttagatgaaattggagactttagctcagtgtggaggcgcacacctgtagtcccagctgctcaggaggctaaggcaggagaatcgcttgaacccaggagacagaggtggcagtgagccaagattgcgccactgcactctagcctgggcaataaagcgagactgtctcaaaaaaaatcataaaatagtaaaaggcatcaaatttttgaggggaaatacctattggtgaactgaaaactcgacaacagttctggtgtgtgggataacatgttaatagccttgatcattttgaatttcataatcataaatgggattttgtttttgagatggggtttcactcttgttgcccaggctggagtgccatggcactatctcagctcactgcaacctctgcctcctgggttcaagcgattcttctgcctcagcctcctgagtagctgggattacaggcatgcaccaccacgcctggctcattttgtatttttagtagagacagggtttctccatgttggtcaggctggtcttgaacttctgacctcaggtgatccggctgccttgacctcccaaagtgccaggattacaggcatgagccactgtgcctggccttttgggattggtttaaagagctgtggaagacaattgagcaattaccacagagattagcaatggagttcctagtatatttgaaaatgaataaaattgttcctgggaaaattaacaatagtgatctcagtctaaattacagagtaagcaattcagagaggataatatgccacatatgcatagatttgtttaaaacagtaaattatatagcactgtaaaaattgaaaaaaatactattagaacaacaaacaattaggttgatgaagcacaataagagactaatgaaaaggaaagaaatgaaattacttaatatcaaaatgtatgaaataaatttaagccatatacaagcatgccaaattaacttgtgagattaacaaagagtgtattaattggggaaaaagactaggagtctgcaaatcctaagattaggcttaacactaagcctcttacaaacttcaagttttcaaaaaggctcaaggttttctggtacagaggtactatgggagcacagttcagatttaacttaacattacgttatttaggccaggcacggtggctcatgcctgtaatctcagcactttgggaggctgaggcgggcagatcacgaggtcaagagatggagaccatcatggctaccacagtgaaaccccatatctactaaaaatacaaaaaattagccgggtgtggtggcaggcgcctgtagtcccagctacccgggaggctgaggcaggagaatggcatgaacccgggaggcggagcttgtggtgagccgagatcacaccactgcactccagcctgggtgatagagcaagactccacctcaaaaaaaaaaaaaagaaagaaaattacagtctttaggaaactagatattcatcagagagtgtatgtgaccagaataagccatcttacgacgtctagatgacacagtaaatacttatgctgattcaaaattacctgagctacttcaacataggacatagcaaaacactgataattacattactgtatacttataaaagatgcttgtggctgggtgcagtggctcacacctataatcccagcccttcggaaggccaaggcaggcggatcatctgaggacaggagttccagaccagcctggccaacatggtgaaaccccatctctactaaaaatactaacattaggcaggagaattgcttgaatccgggaggcagaggttgcagtgagcagagattgcgccattactccagcctgggcggcgagagcaaaactccgtcaaaaaaacaaaaacaaaaaaaacaaaccatgctttcaaatctgcctaacaattatagcttcagagtccttgtattcaggattatctatttgtaacttactactttttacaaatatttttcttacactaaattagaaagaatgtttggtctcgcaggtgtctgagaatctttagtaaaatacccctacagattctattttggaatcatggttttaaaaaaagcaaaagtgtgtatttccaattaattgctacagagatgccaaatgtccactcagtagttgtgagtaaaacaaattgtcttattgctcttcacttcacaggcaaataaactcttcgagtgattgtgtgaagttcagagtattaggtcagggatgaaatggaggctaatccagacacgttataagagaaaatatggaatagagattctaggggcactaaagcaaatgcatgaggtggtctatgcttctgagtccctcatagtatgttccttctgagtatttgtattctaaacctcaaaattacaattttttgtataacatttcttactggattctccaagatataatctactttttgaagaatatgacatttatgtagaaatagtggttacttaccaaactggtatttgctactaggaaagtagcatcagtttttggcatgggcatctgaactctgagaataaggtttgggattccatgacctcatctccttgctgggaagtgatggtcattttattcttccacctgtaattgcagtgacagtgtctccaagaggattggagatgatctctgaaaaaaatttttgaagttagaaaattgtagaaagttattaacattaattactggagttatccatttagaatgacatcatacctaaaagagaaaattatctgtgaaatgggaacaaataaaggtaaatagaggaaacagttctaagacatgggacatgtaagttgaacccttggttatgctggaatcttggctcctatgaaatttttttttttttttttttttttttttttttgagatgtcttgctctgtcgcccaggctggagtgcaatggcgcgatctcggctcactgcaacctccgcctcccaggttcaaacaattcttcagcctcagcctctcaagtagctgggattacaggcgcccaccactgcacctggctaatttttgtatttttagtagcgatggggttttgctatgttggccaggctggttttgaactcctgacctcaggtgatccgcccgcctcggcctcccaaagtgctgggattacaggcgtgagccaccgcgcccagccgaaattcttatttctacaaagtctgacattttttcattcatatgaatggtgaggaataacaaacttggaaggaaagaaatagtaaaaagagagtgagagtacaaaggtgaaagagttgagggaaagcattactcaacatcttatctggttcagaggctcatctagatttgtatttacagcagtgaacaacctacaaagaaatgtattctcaagtaggctttattcaaattaagagatgtggtctggaaataataaagaaaatattggaaaatatacactaagttataaagagacagattctatggaaaatatcagaataccagcaccaagtaataacgaacacgtgaagtaggtagaatttctataggaaatttctatagtcagggttgtccttatagtggagataatatttgagcatatatttaaagcacagcagagagagagtgatttgtaaacacagagaaaatgtgctatggaaaagaaatagccagtacagtgtccaaaaagcctggaagtgaaaaatcatgtggtcaaagcacaattcaagagtgactggtgatggtttttataccatcaaaaatctccccaatgtgcacaattacccatgtatccattcacatgccattatctcagacctccttgtcaactgtcttctcaaacatattcttccttgcccttgatcacattgccaggtcatggactgctatcctgtaaaatacttgttctttggacacttattcctcctcataaaaaggtttacaaggtatgccacttgtgacttcacctatggggaaaattttgatccccaactatctttcaagaggatgcagaatatggctctgaggcagccacagttttgttttgtttttttttttttgaaatttatctttttttcccaccctgccttatggtgctgacacaatcttttttattactaggtttttaagagcacttttaggtttgcagtaaaattaaggggaaggtaaagagatattccatatactccctgcacctacataagcatagcgcccctcaccccaaccgcagtggcacatttgtagcaattataaacctacactgacacatcattatcatccaaagtccctactttactttagggttcactcttagtgttgtacattctatgtgtttggacaaaggtacaatgacacgtgtccactattagagtgtcatctaaaatagtaatcctctgtgctccacaaattcatccctcctacccttctaaacccccagcaaccactgatctttttactctttcatacttttaccttttctcaaatgtcattaattggaatcatacagtatattgccttttcagattggcctctttcatttagtggtatgcatacaaggtacctccatgttttttcacgtcttgaagattcatttaccttcagcattgagtaatgttccattgtctagatatactacagtttcttttctttctttgtttctttttttttttgagacggagtctcgctctgtcgcccaggctggagtgcagtggcgtgatctcggctcactgcaacctccgcctcccgggttcacgccactctcctgcctcagcctcccgaacagctgggactacaggtgcctgccaccatgcccagctaattttttttttttttttttttttttgtatttttagtagagacgggggtttcaccgtgttagccaggatggtctcgatctcctgacctcatgatccgcccacctcggcctcccaaagtgctgggattacagacgtgagccaccacgcctggcgatatactacagtttctaatccattcacttactgagggacatttttgttgcttccaaagtatgccaattttggataaaactgctatacacacacatgtacaggtttttgtgtggacataaattttccactcatatggataaattctgaaaaatatggttaccgtattgtatggtaaaagtgtgtttagttttgtaagaaaccaccaaactccatttcaaagtggctgtacaactttgcattcccgtcagcaatgagagctcctgttgctgtacattttctcaaccatttgcagttgtcagtgttacagaggttgttcattctaatagatgtgtagtggtatctcagtgctgttttaatttttacttccctgatgacatatgatggggattatcttttcatacacttatttgccatctgtgtatcttctctggtgaggtatctaaacctaaagtctttgcccatttcgttttttaattaagatgtttcttttttttcttttttttttttttgagacggagtctcacactgtcactaggctggagtgtcgtggcatgatctcggcttactgcaacctccacctcctgggttcaagcgattctcctgcctcagcctcccaagtagctgggactacaggcatgcgccaccacgcccaggtaatttttgtattttttagtagagacagggtttcaccatgttggccaggatggtcttgatctcttgaccttgtgatctgcctgcctcagcctcccaaagtgctgggattacaggcatgagccaccaagcccggccctgaaaaatttacacaattatacaaaacttacttaacctatgcttcattacctcatgaggagtactgggaagttttgagtacgtgcaatggatggaaacattgaatttggacataaagagttgtgtcctttttttttttttttttttggagtcttgctctgtcacccaggctggagtgcagtggtacgatctcgactcactgcaaccttcacttcccaggttcaagtgattctgattctcctgcctcggcctcccgagtaactgggattacaggtgccaccaccacgcccgactaattttggaatttttaatggagacggggtttcaccatgttggccaggctggtcttgaactcctgaccttaggtgattcgcccacctcggcctcccaaggtgggagcagcaatcacacctgctgggattacaggtgtgagccactgtgcccagccagttatgtcatttttcactagtttctcagttgattacctgaaagtatgaatttttaaagcacaataggattcagcagtctcaggtaggaaaaaggtaacctggaaagatccctgcatgtgaatgcacacacagctttcagggatctgaggaaattcagcatgtgtaggatatagaggagatacatggtaggaggtgaagcaatatgtaatggttggttctgtaatataggcccagccaagaactctaacctttttcctaaaaacaatgacaagcccattgtgagatctaaccagatgtacaatagtagtcattccacttataaatttttgtagtaaatgtgtaaacaaatacattatatatttgataaaatcatttcacaacttttaattttattttattttactggtattaatttgtcctaaaggatcatttttattgtgaaacgtaaaatttgatctatctaatatatataaaatgtatatgtgtacatttaacaatgtgcatatatgtaccttaaaataatataaactttctgggcgacggagtgaggccctgtttaaaataatgataataatttgatattttatgcattaaaaacttttgtctgggcatggtgactcatgcttgtaatctcagcagtttgggaggctgaggcaagaagattgcatggccctaggagtttgagactagcctgggccctatagggagactccattcctacaataattttttttttaactagccgggtgtggtggtgtgcttgtagtgccagctactcaagaggctgaggtgggaggatcacttgagcccaggaagtggaggctgcaatgagctatgattgttccactgtactccagcctggacaacagagtgagaccctgtctcaaaaaaaaattaaatgttttgattatacaaggaaaatgaacattcatgtattaaagcttcatgttttatgaacaaaactgactttgcaggcaggagagcgttttctgggggcaccagaagcagggaacttcccttgtccgttggcttcagggctgcccactatccctccactatcttcccattgtagccctgtctggtgtcttttgtccctgacaaaacctacaaaaagtgactttaacacttcaggctgcatgcatttgaagagcaataagataacgttttttcgcttcccactaccagtggagatctgctggggtgggctgcatggaatctgaaatgatgtctaaatactgaagtgaacctctacactagagactgatatacagctgacccttaaacgacgcaggggtcagggataccgacccctgcggaattgaaaatgcttgtattacttttgactcccctaggtcttaactactaatagccaactgttgcccggaagccttatgaagttgcccggaagccttatgaattacataaactcccagtcgattaacacattttgtatgatatatgcatgatatatgcataatatatatgatatatgcattttgtatgatatatgcattatatatattttagtataagaactatacttgtactaaaacagaccagagaaagggtatcaggaaaattgtaagaggctcgttgacattacacccaattaaaaaaaggaaaataaaagaatacggaagggaaaatacatttactaatcattaagtggaagtggatcatcataaaggtcttcatccttgtgttcttcatgctgggcaagagaatgaggtcttgctgtctctggggcaagaggtcggggagctggaagaggcaggaaaaggagcacactcgaagtaacgtttattggggaaaaaaaacgcctacgtgtaaatggacccgcacagctcaaacctgtgttgttcaagtgtcaacctacttaagacctcaaacaccgaagcccctcagtcgccctggaaggcagcagacgcagcttcctagcgctcccagctgtctgcacacaaggcgccctccgtcgcagcctgggggagactacattacccagaaagccttgcgtcgagcggcagtactttgatccaatgaaaatccaagacaggggcatttccgtgtgggtctacccccgccccccccagggcgggacttgtggcgtcttcgcagcggtcattttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggtgagcgctgcgatctccgggcctcccccggccgagattcttaagtcccaagtgagaggcaccagctcacgtctctgtagcacagggtcggggacactgaggctcgtgggtggggcccctatttctgacatccgatgtggtgggcagggggacaagggacaggaccggcgcgtgcagggcttggacgggcaaccgagaagggggcattcaggaacctgggctccacattgttactgcagggaacaaagtttgagagagatctacctttattcttagggccgtgggagccatagagagcttgcgcaaacgagagacaccatctgagttaaatttgaaaaatcctctgcaggctgttcagtggaagaaaagactttagagatggatgaggacgttgaggcagagggaggttgaatatttttccaaggccacacaactggtgagaggcagcactaaggaccgaggcgcacaggttagacagtcgacccaaagttacgtggctctgggccggggcaagggtacagggaaggcctgtgcccatggagcactgccatgatcacattcctctgaggcctgcgtctttccacaggttcccatagctacagaggtgcttttcaaacttacacaggtaagtggaggtatctcagcccctcactggtctggaatgtccctccaccctccccagacagatattttctttagatttgtggtgtcatgggactcacctaccattctctcagcgtttggtttgggaaccctggagaatccctgagctaagggccctgagtccaggccaatgtttccatttggagcagccaatggaaagatgggtgaaaatttatgatagaaacaggtaggtaccagcttttggaactccttggaggtgaggctgagctggttcagggaactgcaggtttcctttatttctgtgaagtttggcatctattgtgaggaagttggagtttgggatcagaggagggagatttatctaacccaagtgttgacaggatacagagtggaaaacagaatgaacacagtgactaatgggaatgtgaagagacagcagggatcaatgacaccaaggtctggtgtctcttctgacttggggatcttgggaggagaatgtatggggacatggattttgagtcttccaaattgagactgttcatggtttcatcaatccctattatgctagggaagtgtgacctttgaagatgtggccgtgtacttctcctgggaggaatgggatctccttgatgaggctcagaaacacctgtacttcgatgtgatgctggagaactttgcacttacgtcctccctgggtaaggccctcatactcacccttgtgccctggactaggctctctgtttctccttttcctcaggagcagctctgtcctcatatctggactataggcactgcctccttccccagttccctgggtagatgttgtggactgagtgcaagcctacttcccttatcgtcccagcccaaaagcatcttgggtaaggatttgggatcagtagtcttacagtaagcctaatagatcccacctgacttgccttctccctgtctggtgactttctagatctatggcacccagttttccctcccttcgtgtacctaacatttatttgtgctagactgtgacatgaaatgtagtcactgacattgccactatttacacagactgttcttcaaccaccaacctttccattaacagcagaacactctaacaaattgtgccgcagagacattacacagactgttcttatagaaacctccttcaaggtgtttttctttgtttttaattgtaaaatatatataacaaaatttaccattttaatcattttcaagtatatagttcagcgcatttagtacattcgcattattgtgcaaccatcaccaccatccttctatagtactttttcatcttataaaactgaaactttgtactcattaaataataactcttcccatcccctggcaaccaccattttacttttggtctgtatgaatttgtctactgtaagtacctcatatgagtgggatcacacaatatttgttcttttctatctggcttacttcacttagcataatatcttcaagattcatccatgttgtaatatatatcagaattgcttctttttaaggctgaataatattcttttgtatgtattacagtttgtttatccattccttcatcagtggacacaggttgttttcaccttctggctgttgtgaataatattactgtgaacatgggtgtacagatacgtatttgtgtccttgctttcaattcttttgggtattggcccaaaagtagaatttctggatcataaggtaattatttttaatttttaaggaaccactaaaattgtttttcatagcagctgcaccattttacattcccacaagcagctgacaaaggttccagtttcttcacaccctcaccatcacttgttattttctgatttttttgataagtcatccaaattggtgtgaggtgatatctcactgtggttgtgatttgcagattactgatattgagcatctattcatgtgctgattggctatttgtatatcttcaaatgatattgcttattcaagtcctttgcctatttttaaattaggttttattaattataattagaagtattaaatataattttttattgagctttaagggttatctgtgtgttctagatattcccttatcagatatgtgatttgcaaatgttttctcttattctgtgggttacgtttttagtgtgttgataggatcctttgatgtacaagtttctcattttgatgaattcagttttacttttttacttttattgtctatgctttttatatcatatccaaggaatcattaacaagtccaatgtcatgaagctttttccttgctttaagacttctatagttttagtacttacattcagatctttgatctgttttgaattaatttttatatgtggtgtcaggtaagggaccaacttcattctttcacatgtagatatccagttttcctagcatcatgtgttaaaaatttgtcttctttctcctggtcaaaaatcatttggccagatatttgagggtttatttctggggtctcttctagtccattgatctatatgtctttctttatgggagtaccacactgttttaatttctatagccttgcagtaagttttgaaattacgaactgtgagtcttccaactttcatccttttcaagattgttttagctattctgtgtctctcgatatttcaaatgaattttaggatggatttttttatttctgcaaaataacgtcatttggattttgataggtatcgcactttctatagattactttggctagtatagacatcttaacaatattgagcactctagtccatgagcaggcatgtgatctattttattaatgttttatttaattcattttagcaaaattttgtagtttctagtgtacaaggcttttacttgtttggttaagttaatctttaatgttttattctttttgatataagtggaattgtttacttttcaaattgttcaccattagtgtatagaaacgtaactgatttttgcatgttgtatttatattctcctatttgctgaatttccttattagttgtaacagtttttcagtggaatctttatggtattccatgtatatcatctgtgagcagggataattttactcctcctttcccattttggtcccttttctttctttttcttgcctaattgctatgttgaacagaagtgctaaaagtagcatccttatcttgtccttaatcttagaggaaaatctttcagtctttcattgttgagtataattttagctgtaggtttttttttttgcatatggattttattatgtttaggtaatttccctgtattcctggttttctgagtgttttccccacgaaaaagtgttgcatattgtctaatgctttcagtgcatcagctgagatgatcgttttaatttttttagagatggggtcttgctatgttacacaggctggtcttaagctcctggccgcaagcgatcctcctgcctcagcctaccaagtagctgggattacaggtgtaagccaccactttgatcagtttttgtttgttgaaccatccttgcattccaggaataaattctatctggtcgtagtgcataatccttttaatatgctgttgaattcagtttgctagtgtttggttgatggtttttgcattaataatcatcaaggatattggtctgtagttttattttcttacacaatctttgtgtcatttggaatcagggtaatgctggccatacagaatgagtttagatgtgtgtatgctacagttttttgagagaatttgaaaaggataagtattagttcttagttaaatggttggtagaattcatctgtgaagccatcaagtcaagggcttttctttaaggtttgtcttttttttttttttttttcttgagacagagtattgctctgacacccaggctagagtgcagtggtgtgatcttggctcactgcaacctccacttcctggattcaagcaattctcctgccttggcctcccgattagctggggttacaggcacatgccaccacacctggctaatttttgtattcttagtagagatggggtttcaccatgttggccaggctggtcttgaactcctgacctcaggtgatccacccacctcagcttcccaaagtgctggaattacaggcatgagccactgcacccggccaggtttgtcaattttgataaccttttcaaagaaacaccttttggttttgttgattttttttttatattgtttttctcttctctattttatttatctagactttagtctttattatttttttcctgccagctttggttttagtttgttcctctttttataatcccttaagttgtaaaaatagattgttgagttgagatctttcttctttttaatgtttatagctataaatttcccctttagtactgcttttactgcatctccaatttatttcccttctgatttcttcatggccccattggtttttcaatattgtattaatttctacagatttgtaaattttttagtttccttctattaagagttcccaacctcatcccactgtggttggagaagatactttgtatgatgtgtgtctaaatcaaatgaggcttaatttatggtctgtcctggagaatgtttttggtacacatgaggggaatgtacattctgttgttgttgggtagaatgctctttatatatttgttagagctagttggttgtttaggtcctctgttttctctcttctctctgattgttctatccgctgctgagagtcaggtattgatgtctctaactgttattgtagaactatccatttctcccttcagttctgtccatttttgcctcatgtgttttgatggtctattattaggtgcataagtgtttataagtgttatatcttcttgctctactgaaccttttattagtatataatatccttttatatctcttgttaccctttttgatttaaaatctctattgtatgatattaatgtagccattcttactcttttttgcttgctatttgcatggaatatctttttgtaggctgtcactttcacctcatttacatctttggatctaaagcaaatctcttgtagacatcataaagttggatcatgggttgtttttattttaacccattctgccaatctttgtcttttggcagagtttaagctaaaagttgggagcatttaaggcatttacgtttaaggtaatcactgataaggaagggcagacttctatcattttgctctttgttttccccatgtcttatagccttatagcttttttgatcctaatttcctgcattactgcttcttttgtgtttggctcacttttttttttttttttttttagtgaaacttcccttgtcatttcctttatgtactttttttttttttttttttttttttttttttaatggtgtctcactctgttgcccaggctggagtgcagtggggcgatctcggctcactgcaacctctgcctcccataatcaagcgattatcctgcctcagcctcctgagtaatccctcctgggattacaaacgcacaccaccacacccagctaatttttgtatttttagtagagacagggtttcaccatgttggccatactggtcccaaactcctgacctcagttgatccacccacctcagcctcccaaagtgctgagattacaggtgtgagccaccacgcccagttctttgtatacttcatgtagctctttttttaaaatagttaccatggggattacatttaacatcctaaagttacaacactctaacttgaatttatacaaacttaacttctttaactttccttgttcttttttgtgccgtgttgttctgggccagtgttagttgctcacatgtcctgtctttcccttaggacttatatcatcctggtctcatgtagttgctcaactagggctaggggaagtgccctctgttcttcacaggatgttcatgactccagcctcagcaagatgggatcagagagggcctggcctacatgaatggcacttgggaaaaggcatgtcatcaggtctgtgtttaaattgcaccaggaacctgtcctgtttgacttgtcttgatgccattgccagagacacttcacttcgaccttcccctcttcactcttaacagtttacaaacttgttatttctactacttgtcatttttattttgacttctagctaacgctaatcctcacctctctggactccttatcctacctgttcttttcactgttccctctgtagtgttctttaatattattttgtcctgaagtgtgcatatctcccttaatagtccctgaacaccagttactgttccagtgagattttcctgggcctgggcatacacttcacagcatcacttgtcaccagcagatgtgatcccactaaaagctattatcagaagaattaattgtataacatgcctcttagtcctgggccataccttagccttgtgcactgtacctgggagggcctaccctattccgtaaccttagggacaagtaatgcacaacagctgcttcctcaacctgaccccccaactcacttttcctaaaaacaggcccatatactggttctttgctgtaactgatgtgcatttgcaattgcattgtctcctcctaataaaggtaacatgtacttcaccatgatctctttacttttaggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctacctttatcttggcatttgattcactctttgaggtggttcaaaaacagaatcgggccctgccagctttacagagtaaacacctttggagggagagggaggtgtcatatgcctcagtgacaacagtataatggaaaaatacaactgtctttccagctttggcctaatctgaatttgaattattgcccaaggccttctaggaaatactgcaggatattatggtcttaattcgtggactggatgcaaggattttttgtgggctcaaaggacaccctgaggaagtgggaaattgtgacaaattccattgcttctgggaacaagatgaattttgttgttattcacaagggttattacatactgcccagcactgttgaggcagtctacccccagtgctgccaaggagccaagtgccccaatacaatttagtaggctactgtcactgtaaaatgatgggggaaccataattggtgtggaaacactgggttactagggagtgaaggagactgcagcaaactagatggaatgtgctccttgtaatatgttctagtaattgtgcaggatcagtgtgtacagacattcttagaatttccaggcatgtgtattttttgtagctgaggtgactgtcaaaaaataataaacaacctaaaggttttgtgtattccaatagcctttctgggatgtgcacctcaagaacattgctgcataggccaggaaaacaagcatagaaagaaggggcgggggatgtccttccaggaatgtgactttgtaacctaccatcatcctgtgtttaaatgaattcaaatcagtttcattgattaccagtatttgctgcccactgaggcaaggtgtccctccaaggtcatcaggaaagagagttaatgtagggttaccaaacctagtcaaaaacacattataccatcattataattattacaatgaacatatcagtcacctcggatttacctcaggcctttttctaagctctccctcccctctctggccctcaaggcaaccattgatttataccttcatttataataggtttgtttgtattttctataatatatgattttattaataaaatgtctttttttccagtttcattcatgatgcataattattttgagattcttcaatggagcttatatgtggtggtcattctttttattgctgagtggtatattttttatggatatactatttgttatccatttgtttataagcatttaggttttatctagttttggctattacaaataaagctgctagaaatgtacaattcttcatatgtgcatttttttcacttctcttgtgcaatgcctgagacacaggataaatgaatgtttaacttattaagaaatggccaaaaatgggctgggtgcggtggctcacgcctatactcccagcactttgggaggccgaggcaggcagatcacgaggtcaacagatcgaaaccatcttggccaacatggtgaaaccccatctgtactaaaaatacaaaacttagctgggcgtggtggtgcgtgcctgtagtcccagctgcttgggaggctgaggcaggagaataacttgaacccagaaggcggaggttgcagtgagccgaggtcacaccactgcactccagcctggcaacaaagtgagactctatctcaaaaaaaaaaaaaagaaaagataaatggccaaattgatctaaaatggctgtttgctcttgcttacctactgggaatgtgtgagaattccagctgtttcacatccttgccaatacttggcatggtctatcttttagaatgtacccttttaataagtgtgcagtagttttaattgcatttccctaaggattcatgatgttgaacattttttcatgtgtttatttgccaaatgtatatcttcttttttacacttttttttttttcttttagacggagtcttgctctgtcacccaggctggagtgcagtggcgtgatctcggctcactgcaagctccgcctcccaggttcacaccattctcctgcctcagcctcctgagtagctgggactacaggtgcctgccaccatgcccggctaattttttttttttttttgtattttttagttgagatggggtttcaccatgttagccaggattgtctcgatctcctgacctcgtgatccgcccgcctcggcctcccaaagtgctgggattacaggcgtgagccactgcacccagcctgccaactgtatatcttctttgataaaatgtctgttcatatacgttatctgtttgttaggaattgtgtctattttgcttttcattaacaaatcactagtttttgttccacaattaatttcatgctatgcacagtgtaattaccatatataccacacacttttaaatttaatctgtattattcacatattctctatcacattcttaagtctagacacttagtagtacagtgaatcaagctatggtttatagtgatgccagtttccctggtgtaaaacttcccattgtggccaatttcaaactgtcatcatgtcactgaatttggggttgggaagagccatcagaaacataccatttccataatagtgatccatatttaaatttacttctaaataaatttatttgcaagtttactacctgcaaatagcctctagaatgtagacaataaaacatagtaaaatgattaggaagtgacaaattttgaatatttgttttttaaaaaatataaaagaggtataattgacaatgcaaactgcacatatttttaaatgtacattttgatattttgatacacgcttatacccttaaaatcaaaaatttcattgaaaacaagtgaaaagacaatctgtaatactgttaacagttaacagttaagttattctgttaaatacatcagttgtccaaaaaacaaagtaggcaacatatttgaaatacaggcagttcttgctctattcatcttcatgaactgaaaatgccttgacaaaacatgagaaagaatggaagttaacaattgagatgaaatttgccaacatttattttggaatcaaagtctattttcattatgaatcctctgggattttgtaacataaagttttctagtgcaaatacattgggatttattaggatttactgataaagaactctcagtcacattttagttgtccatattatatatttggtacattctgtgataacggaaagtacaaatagcactaatgttttggggaagaaaatagctacttgttgcctccttcccacagaaccagggctagataatgaggagcacatctcactaactgatcacacagctgtctgtagacatttggccaggaagagcactgtgggatgaatcaaacaaccaggaaatcaggtggaggagaatcagaagagatgctactgtttgttttcaagtaaatcaggctatctccagaaggatcatcaatcatagataagtgtttacttctagtgttacacaggtagaacagaaagtatgttaaatttatatgtatttgaaagaaaaatttaagcatgaagtaaaaactgaaggaacattctagaaaagttttagtacacaaaataagagaatgtaattaaacggtatttcactgtagatttctgctactttggtctcacccattaaatcccctatacctcacatagttgacatgaacaaagccattcattattccactggcaaatactttcctgttatatatgttctattcattacctattccaacagcctctcatacacattcaccttcgaaggtgatttcaacagttctcagctgggcgcagtggctcacgcctgtaatcccagcactttgggaggccgaggtgggcagatcacttgaggtgcacatcatctggtgtgcttagcattactccatttctgatactgttagaaggcaacttctaactttgtcagctccaaccaatcccaagctggccaagcacctattgggtctcttttgctcctggaggcaacatagtctccatttacaaataccactcaggcctatttattcacccatccacaaaacagcccacttttggaggcctttacaacagaaggccctagagtcagttcagatgaccatataacagacatttcctttagtgcctcctggagattccttcatggtggactacccactagactctcttcttagactctggaccacacatctggccataagctgcccatgggcttctggtgcaaaaaactgcctgttttgtcctcatgtaacatgcaattagagcaacaactgccagctacatactgggacctcttagaaacagaagctctcacaggacctgaaccatggcacactccacccagttacacattattacctgggtcatgaaagcaacacctacaagctcagcctgatcaccaaggccttgatacaggatggagccaaacctgggccccctggtgtatctcacttggaaaaagaggtggccttctctgtcctcagtctcttgccagatgccatggtgaaggaagtctcctctctcctgggcccttggcagccctggaatcaagtaagtaaacaacaaggggagaacacatactttgttgacagtaatgccaccactacatgagctggagctctctggaggtctgctgcttttcttctaaacaagacacactgctgaaggatgggaactgcaggcagtcattttagcgctggaggctaccttggccaagaaattacctcaattacacttctagtcatttggtgcaaccaatggcaacaatttctcgttcaagatcatactcttggggtaaacaacttcaggaatttcttgcctctcagatatcaaagatataaattaagatcatgtatgtctccgcccacaccaaggctcagactgctgaagcctaacttaattcccaagctggtagattacaacaattttcaaaaactaggaccaaaactttgttggatgaccttccaggcccattcctttatttttggcccaataggcccatgaaacaacagtcatagaggaacctctatgaggaacccaatcttgaagactggggctaaacacaaagtgtttccccacccctctaccatggccaacatgatgacgggtcagtgcactctgtgggaatacctgtcattggcaagacaactgaggtgtgctattctggatcccacttttagtcatgtggcaggtagattttaccaggccactgcctctgtctaccagtgccacttgttatgctttgactgtggttgatgcctaccgccgacatcttactttaccccactagacatggcactgctgaagctactatacagcaccacaaaacgctcctattccctttggagttcccgacaacagcggtgaacaaagctctcattttagacaaagcatttgagagaacttgcgacattccaatcagtcccaggctgctggttttatagaatgccacaatggcttacttaaaacttagtagaaattatgaaatagcatatggtcttatagatgggtctttttcctgccattagaccttattatactaaattcccagctctattccctgccaaaatgcactgaaaacatctccattagatttcattgccctctgtggtgacacttcacataacagagcttacaaagatcatattgaactaggcattcctcctgttcttcctctttctgctatcacttttcagtccccatcctgactggaaagaaagacagactgagggtggattgtgagttatgatcctcatgaatgaatgcccctttggcttcctgccagagccatctggcaccctgctaacgttgagtcgcctaaggcaggagttttgccaaatattcttggttataaaggatacttaattacaaatgcccataatgatctcactcaggaaagagaaatcatggctccaagacccacaaccacaccgtgtcaataacaggccagcaaagaccaaaactgaatttgtctaacagcatcctccactaaggaacgcaggctccccctacctcattggcagttttgtacacctgtgtgtgtgtgcgccgtaggctccctttcaactgcctcaccatgtcacagcttattcagctgactgtaagccttaccatggcactctccacacactctccacacataatctatttggctggtcacacctcaaacctaaacttgttctcctggacttctcttaaaaatgccaactccagttattcaagatgacccactattatgtctgaccaaaatgttcactggcaataattcataccaaataccaagtccaagactttagcccctgagaacttattggttgtatttcccgaaatacccctcgcttctgaagttattgagtccttaatctcagacttctcttaatttgacttgcactatgtgcattttggggccaaatataaccttttgttatcctgccaaaaaaagttctgtattttgattgtgatggtgattacatgtatctccacacgtgataaaattgcatagaactggccagaagtggtggctcatgcctgtaatcccagcactttgggaggccaaggctggcagatcacgaggtcaggagtttgagaccagcctggttaacacagcgaaaccctgtctctactaaatatacaaaaattagctgggcatggccgggcccagtggctcacgcctgtaatcccagcactttgggaggctgaggcgggtggatcacgaggccagtagatcaagaccatcctggctatcacggtgaaaccccatctctactaaaaatacaaaaaattagccgggtatggtggcgggcgcctgtagtcccagctactcaggaggctgaggcaggagaatggtgtgaacccaggaggcagagcttgcagtaagctgagatcatgccactgcactccagcctgggtgacagagcgacactctgtctcaaaaaaaaaattagccaggcatggtggcgcgcacttgtagtcccagctactcaggaggctgaggcaggagaatcgcttgaacccaggaaatgcaggttgcagtgagccaagatcaccccatggcactccagcctgggtgacagagcgagactctgtctcaaaaaaaaaaaaaaaaaaagcatagaactacacacatacaacgagtgtataaaatggtgagctctgaaagaggtctgaggattgaaccaatgtcgcattcctggttttggtaatgtactaaggttatataagatgttactattggggaaagtaggtgaaaggtactctgcactattgatatggtttggatatctgtcctgcccaaacctcatgttgaaatgtaatctccaatgttggaggtggggcctggcaggaggtgattggctcatgagggtggtttcccctgaatggtttagcaccaccctttggtgctgtcctcacgatagtgagttatcatgagatctggctgtttgaaagtgtgtggcacctccaacttcgctcttgctcctgatcccacaactacatttgcaacatcctgcatatctgtacttcaaaataaattcttaaaaatttttcactgttccgtatatttccacagtgtatatagttcactgttctgtatatttctacatcagaatgtataattttcggccgggtgtggtggttcacgcctgtaatcccagcactttgggaggccgaggtgggtggatcacctgaggtcaggagttcgagaccaaactgaccagcatggtgaaaccccctctctaccaaaaatacaaaaattagctgggtgtggtggcgggcacctgtaatcccagctactcagaagggttaggttactcaccactatactaatgaggatgaagcctctttttttttttttttttgagatggagtcttgctcttgttgcccaggctggaatgcagtggtgcgatctcgactcactgcaacctctgcctcctgggttcaagcgattctcctgcctcagcctcctgagtaactgggattacaggcgcctgccaccacccctggctaatttttgtacttttagtagagacaaggttttgctatgttggccaggctggtctcgaactcctggcctcaggtgatctgcccccctcggcctcccaaagtgctgggattactagtgtgagccacgatgcccagccaaagtctcttttttataagggccttaatcatactcttaagggaggagctgtcataacaacctaatcaccttctaaaggccctatctcttaatctcataataccattgcattagaaattaagttttaacatgaatttccaccagcctcaggggctcacaccggtaatcccaccactttgagaggcagaggcgagtggatcacttaagcccagcctggccaacatggtgaaaccctgtctctactaaaaatacaaaaattagccaggcatggtggcagacacctgtaattccagctgcctatgaggctgagatgggagaatcacttgaacctgggaggtggaggttgcagtgagctaagatcacaccactgtactccagccagggggacagagtgagactccatctcaataaataaataaataaagataatgttagcccaaacggtgccatttcataaaccctggacagagtggaaaattccactaggtctttggctgtgagaaacatcctgccagacgagtcccaagcctaaccacctgactgcaggaaatccctcccttatcagcagctaaccacaacgccccaccccagtctacaacaagcccagacctctcccgcctagacctataattaccccaatctgtaagcaggggtggactccagcgctagctggtgtccccgtctacaggcctttgttcaataaacctgtgttgccatagagccatctccattccgttccttctcccttccttgctctcagttctgaaacccgggacgacgcttgggttcacttggaggaatccctttttgcaacctgggaagcagtgagcagcggcagctcatcccaggtgaattcccagatcctaattagacccttcactcccagccccgtcttcctaccactttcccttttctctccttcttccactaggaggctccagcaaggatcactccaattactggacatcatatccaacaccagtctccgatttctgggtgagttccccctttccccctctggattcctctcatatttccagaaaagcccagtgccaggtgagagaactccccagtcaccactgggtaaccctgacctgccttctcaggggatgtcctcagaatgctcactgctccaacccccaagggactgtgaaaagcttcagggatgccccagctcttctccatccctcctcatgattggaatcaggatactcaccaccccacacacctatctcaccctcctggccaccaatatggggcagggctcctaaaaaccccctcaagacacccctctcagatactcatccagaacctcaaaaccctgggcttggtgcactccattaaaaccaaatgccttattttcctttgtaatgtggcttggccccaatataagctggacaatgatagttgatggccggaaaacaggacattgaacttccaaattcaacgtgatctaaaaagctttctccaatgcaatggtaaatcgtccggggtgccctatattcaggcctttgtttatctctgtttgtggtcctctctctgtcaatcctgttcaccctttcaaatcctcctcttcaacaaaagacccacgaaaacacctcctctttcggacaagccttcctcctccgattttgacccagtcgatgaacctctgcccttgaacccctcctcaccaccatatcctcctccttctcctttggttccatctccccctctggctcctccacccccttaccatcatcctccattctcccttctttctccactgcatacacagtcctgtgcctaacaccctcccgctgaaggccatgcccacatccaaaaccctttcagagtccttcccttgtgggagacggcaggggctgaaggcatagtctgagtccatgttcccttttccctagctgacctcttccaaattgaaaagagactcagctctttttccacagaccctgcctccttctgtaagagatttttgtacatcactcaatcttatgacctaatctggcatgacctttatgtcatcctctcctcccctcttacccctgaggacaggggacatgtctggacagctgctcaggctcacactgatgctctccaccaccaagatgcagctcataacccagttggggccttcgttgtccccagaactgatcccagtgggattatcagccaacttccccagacaggtaaaggcaagatcataagataacatgcctcctggcaggcatgaataaagccactcttaaggtagtcaactatgaaaagataaaggaaattattcaaggccttgatgaaaatcctgctcttaaccagcctgatcaacatggtgaaaccctgcctctactaaaaaattagccgggcatggtggtacgcctctgtaatcccagccactcaggaggctgaggcaggagaatcacttgaacctggtaggtggaggttgcagtgagctgagatcactccactgcaatccagcctgggtgacagagcgagactccatctcaaagaaaaaaaaaaaaaaaaaggaaagaaaatcctgctctttttctttctcgcctttcagaagccatgattaaatacaccacctaaagccctcaggccaacaagggcagaatctatctccacttacatttcatttcccagtcaacccctgatattcagaaaaaaactccaaagactggaagatggccctcaaaatctccagagacttaatcaaagtggccttcaaagtctttaacaatagggaggaagaaccgaaaacccaaaagttcaaaaggtactaggctaaataccaggtgctggcagatgccatacaacagggttcccaatgcatacaaaaatcctcaacctcaggacagccctcaccaggagcctgttttaagtgcagccaacagggtcattgggcaaaagcctgccctaatcccaggctgccctcaaaaccttgccccatctgtggtatcaagggacactggaagtcagactgtgctcagcaagacgcttcatcctgcttgaccacctctaactcaaacaggtcccccattccagatcccagtctggcaagcattcttggcctggccactgaagactgacaggatcacccactaccatcaccaccttagaacgcagggtaacactgtcagtctctggtaagctcatgtctttcctgttggatactgggcaacatactcagttctaccagaatattctggacctctcctcagttcttccatcactattttaggagttgatggaataccctctaaacataaacagactggccccctattatgtaacctagtcaacacttgcttcacccactcattcctggtcatccctcaatgtcccacccctattttgggactgaatatattaatcaattccagttttccatagaatttaccccctgtcattctaccccttttattttactctgtcaactggacacttccctctcctctccctcatcttccttatccaatttgctagcctctgtcaaccccaaggtttgcgatgtttccaagccaacaatagcagcataccacaccccagacaaaataacctttcaaaacccttctacattcctttgtcagcccagtacctccttagcccagctggcctcagagacctcaaactcattcgttggaaattcctgcaagcccaaattctcaagcctgttaaatctctccacaacacccctatcctggccatctggaaagctgatgggtccaactacctggattttttatttattaaccaggcagtggtgcccatccatctggtggcccccaatccctacactttactttcccatatccccccacctccaccactcatttatctgtattggacttgaaggacaccttttttcaccatccccttggatccagcctcccaaagcctttttgctttcacctggacagatcctgatactcacacatccgcacagctaacatggactatattcccacaggggggctggaatagcccctgcttatttggacaggccctcaccagggacctggctaaacttccccttgctcctagcaccctcctccaatacatcaataacacccttctctgtagcccctcccttaacctatctatccatccaacacatcattcagcttctaaactttctccattcttggggatattaggtctcactcacaaaggctcaagtaacccaaccccaggttacctaccttggacttatcctaatccctaatattcaggccataccaacccaatggaagaagctaatccgggatatgcccctttctcatacaaagaacctcctttccttcttgagccttgtgggatacttctggctatggattcccaacttgctgaccaagctgctgtacaccacatcacgtgggcccatcctagaacacctggatccagtctgtaccattgactcccagttcaaaaaactgaaaaatgccctttcaatgtcgccagcactgggactacccaaccccaacaagccctttactctgtatgttcattctaaccaaggccttgttcttgggctactctgtcaaacattcagcggtaccccacaagccattgtatatctctcaaaacaactgaactcagtcatctaaggttggccaccctgtttaaggatcttatgtgtgtctatgctgctggcctcagaagctcaaaaactcaccctctatcaatacattaccattgcaccttctcataacctacaggaactcatgagtcattgctcccttctttccctcctgctatcttacttacaacaaacacacacctcctacataaacaaccttctaatcacctaccaaagatgtaaagttctcaacccagccaccctcttccctataaggacctttgactctgaactctgtcactcctgcttggactttttagattccctttccttccctttccgacacatatcagagacccccttacaggggacacctacatggttcattgatgggagctcctttaaagagccatgtcttgcagcaggctacaccatcgttgccaaacacaagctcctagagtccaatactgtcgcatcccctaccacctcctaacaggcagaattagtcgacctaactagggccctcaccctagcaataggaaaaagggtcaatatttacactaactgtaagtatgcataccacattctacactcccaagccttaatctcacaggaaagagcttttcttagtaccaaagggacctgcatagtaaatggcaaactgatacacaggttgctggaggtagctaaactaccattagaggccaccattatccattgcaatggacaccagagagctacagatgccataaccaagggaaacattatggcagactcagcagcctggcaggtggcccacaacatcccatcactgttgtccattttcccagcagacatccctcatacacccaggaggaacaagtcaaactaacactggggctacccaaagggaaggctgatgttatcttgacacaaactcatcctgcccaaatctcaagaactctctattccctcccacatccacaaccacttccatgctggttattaccacataccccagtttttaaaaacttacacacactccaccaccatgacaaccaaccttgaatgtttaaccagtctgcccagtttgtggtcagacttcccctgaaggggctcttaaaccacctcctttctccactcatcaggcatgaggccatttcccagaacaggactggcaagttgacttcacccatataccccctgtaaaaaaaggaaagggccaactacagcctgggaaaaatatttgtgaaacctctatctaataaatgatgagtattcagaatacgtaaaacatccctacaaatagcataaacaacacaatttaaaaataggcaaaagttcaagaccagcctgggcaacatggcaaaacactgtttctacaaaaattagctaataagctgggcatggtggtgtgtgcctgtggccccagctacttgggaggctgagatggaaggatcactgattccagggaggtcgaagcttcagtgagctatgatcaaatcactgcactccagcctgggcaacagggtgagatatcatagctgtaattccaacgctttggggggctgaggaaggcggatcacttgaggacaggagttcaacatcagcctggccaacatggtgaaacctcgtctctagtaaaaatacaaaaattatccgggagtgtccaggagtggtggcaggcacctgtaatcccagctactcaagaggctgaggcaggagaattgcttgaacccgggaggcagaggttgcagtcagctgagatcgcgccactgtactccagcctgggcaacaagagtgaaactccgtctgccctccgtctgtctgcaacagagctagactccatgtcaaaaaaaaaaaaaaggcaaaatatttgaacacatttttcactaaagatgatatatgaatggtatataaatgcatgaaaataagttcagaattattactatttaaggaactacaaatgaaaaccacaatgagataccactacatactcattttgatgagtaacattaaccgaatgatcacacctagctgttgaaggtatgaaataaactggagctctcatacattgctggtggaaatgcaaaataaataaatttggaaaacactgtagccgttattaaagttagttgtccacttatcatttgataaattaatctcattcctaagtataacctcaagagatggaaacgtgtccatagaaatacttgtataatcattcctcagtatccatgggggactgattccaggacccccaaggataccaaaacctgaagatgttctagtctcttatataatatgatgtggtatttgcatataacctgtgtatatcctcccacataatttaaattataatttaaattacttataatacctaatacaatgcaaatgctgtttaaatagttgctatacattgtcacctaatacagtgtaaatgctgtttaaatagctgctacacaatagttgtattgtttagggagtaatgacccaaaaaaggtctgtgcatgttcagtacagatgcaatttttcttccaaatattcaatttgcagtgggttgaatctatagatgcagaacccatggatatagaaagccaactgattttgcgtgttatcaacaattttcttcaaagctaaagactggaaaacaaaaacaaatgtctatgcacatctgaatgggtaactgtgttacatttataaatagaatattcctcataaatgtcaaggagggaaaaaaacattaatctgaatctcaaaagcacaagtgaaggaaccaaactcagaggtctatacagagtaaaatttctttcagataaaaatctagaaatggtaaaactcaagtggcaaaatgcaaatgagtgatcctcagatctgggcctaggaggaaggggcggactgcaaagggcagaagagtacatagggtgaggagaaccttctctatcaggattgtggtagtggttacatgctgtttatatttgtcagcactcatcaaattatacactggaaattggggatcatcctatttgtattatactgcactaaatttgtttaaggaaaataataatacacaccaaaaatattcacggctcaagaagtaatatacttcctgccgggtgcagtggctcaggcctgtaatcccagcactttgggaggccgaggcaggtagatcacctgagatcaggagttcaagactagcttggccaacatggcgaaaccccgtccctactaaaaaggcaaaaattagctaggcatggtggcacgtgcctgtaatcccagctacttgggaggctgaggcaggagaatcacttgaacccagaagacagaagttgcagtgtaccaatatcatgccattgcactccagcctgggcagcagagtgagactgtgtctcaaaaaaaaaaaaaaaaaaaagaagtaatatattcccaaattgctctcaaaaatactcttccttaatcttataaagaacatctgcaaaatcctagagtaaatacaataactcatggtccattattaaaatattttcgggaccagaaaccaaaggaggatggtcactgtctgcacatatagtcaattatattgaaagtcctgtctcatgcaattaggtgagacaagaaatatataatctgtaaagaagaaagaaagctaagttcctcgcccccttaaaatatatcttaaatgtcattttcactgtaagtcctactatgaacacctgatttactgtttcaccccatccttaccaactttacttctcagctgtatcctgctctataggacccatcattttctaatacactatcagccgaataacatgggtgctttgcttactgcttactgtctgtttctatcaactaagtctaagttccatgtaggcaattttctttttaattttgtgtgttgatataccccatataatgaaaaaatgacctgacccacaaaaaatatgcaataattttttttgaggggcagagccttgctatgttgtccaggctggagttcagtggcatgatcacagctaacagcagcctcgaactctcaaaactcttgggttcaaaggatcctcctgcttctgcctcccaaagtgctggtattgcaagtgggagccgctgcacctggtctcaataaatagtttttgaaacactgaagaaatatgacataccaatttcctattcatttttacctctccagaaattctgtctaattcattcactgtctctaccttcaagttacctttgttctatgggatgactaaaaaactcacacacagctctatattctgctaccaaaaccttcaaagcggccaggaatccagcagagccatattctcaccttcattctctttctccttagatcttgctgtcctctgcttacctaccctacagatcaattttatttttactttttcattttttcctacatagggtgctcctcagctacttctgtcattcctattagatatctttatgattcaccattaatagtttcagtaatatacacaatactcaaatgttcttcgcaaataacctccattctccttacagatggtcgctgcaattacaggtgaagtgataaccacttcccagcaaaaaggtgagatcagggagttccaaatctttatctcaggttcagatgtcctttccacacctgtacagatgccgtcactccatcattctgacaccagatgccaagtgagtaactcatgcttttcaagtaagtttcaggtccttagatggaaactatctcagaaaattcagtattaattgttctctgtaaaacatttctgggtttggaacacgaaagagtttatatagcaggaaggtcatttgctgagaaaactagacacacatagcatcctgtctatatgccacagataaagacttgatgctacagacatgttaagaacagttagatgacaatggtaagctcttggtactgtgcagatacctggtgtctgtgagagaggtgctgatatgtgcatttcttctgtgaaacagcaggttgtgcaaactggaatctgtaatgtctccacattctgtcatcagcagaagactctgaacatttttctaccgtttaaatgagtctcaattatccaatttataataatgcaaattttacttacagataaatatgggggagtagaggagggttgtgagtttcagccatgaaaaattcatggagcttaaaaattcctaagtatctcaccctgcaaacagataattatatttctaaaagtgtcttgacattctcattctcatgtactcacagtactcttctctatcctcaaagtttctgaattgcttctctgttcctgtctcctctgttattctgcctccctcctcccttccttgcctagtttaagtggatttttagcaaacaaaagtgttgactagaggctgtgagtgaagggcatttttacctcccctggcccccagtgtagattcctcttctgtctacacagaatccttcagatcaggataaaattgagccttccttactagttactacgatttttgaagaattggtgtgattgataaccacagcaacagtgtttggactttagagaaactttattcatgcccacactatgtctactgacctacattttgttacttaaattcattttaagatttctcttccaaaagttttccagttattctcctcttttgattcattgatcccctatatttttattttaccagtaatttcataacttctcttaatattaaaatattttaatgaatatttggaataaacgtatgtgtctatggtgaatactcactgggacacactatacccctccttcttccacaacctcaacctaaggaaggaacactgtctacaagtggtgaggatccttccagatagatttccattaatttacataaattttgcaagatctcccttaactcacctctgcttgacttactgctgagtaaattctttctccatattcccttcatgtaacgtgctaatcagtgaccataaatcacacatgattgttactggtagaatcaatgctttcaactccaacacgtctgtctccacaggttgatgtatatatttatcaacagggagttttctcctcccaaaagtaatgccatttgctctatttattcaatggcataagtggtttactgtaataaaaactactaaactataatcacaaaaaggaaaactttttatttttataaagcctaaataaaatgtgccagaaacaaaaattagagattctttaaaaatgctattgaggtaaaagtgagtgataaaagtagacctgtataaatacaagtctgtgaatattctgtactcagaattttgacatctttaagtgttttagcttactttaaagaactaccatgctgggcgcggtggctcacgcctgtaaccccagcactttgggaggctgaggtgggcagaaaatctgaggtcaggagttcaagaccagcctggccaacatgataaaacccgtctctactaaaaataaaaaaattagctggatgtggtggtgcacgcctgtagtcccagctactcaggaggctgaggcaggggaatcacttgaacctggaaggcagaggctgcagtgagctgagattgcaccactacactccagcctggccaacagagcgagactctgtctcaaaaaaaaaaaaaggaaaagaaaaaaagaactgccaattgtaaatttgtaaatcatgtttaattatagtttatgatagaaaataaaagaaacataaaatttcttacagaagaatttaacccataacaaagtttgagcaaagtaatacaagctacaattaaaataagtcatttcaatttcatttgaatgtgagccaaacattttatgtttttatttttttctcaggattatatctttttatatgttgtatttttttcttttatctggctattaacaatagtaaagtgattgataactttctcttttacattctatgtatttaaatatcttatttagattattttaatttgcaattatttttcattaatatttcattttattaaaaattgccttttttcagtgtttacatattaatggcttacttatccaagattgtaaaaatatacaaatatttttaccgctgagagatttggttttttgtttgtctgtttttgttttttgagagggagtctcactctattgcccagactggagtgcagtggcacaatgtcagctcactgcagcctcctcctcctggttcaagtgattctcctgcctcagcctcccatgaaactgggactacaggcttgagccaccacgcccagctaattttcgtatttttaatagagatgggtttcaccatgttggccaggctggtcttgaactactgacctcaagtgatccacctgccttggcctcccaaagtgttgagattacaggcgtgagtcactacacccagcctaagactattctttactttgggttttttgttgttgttgttgtttaacaggctgtcatttgtcacccaggctggagtagagtggcacgatctcagctcactgcagcctcaacctcctgggttcaagagatcctcctgcctcagccccttttctgcccctcaccccccacccccaatagctggaactacggacgtaccaccacttccagctaatttttgtactttttgtagagactggatttcatcatgtttcccaggctgtctccaactcctgaaatcaagtgatccgcccgcctcggcctcccacagtgctgggattacaggtgtgagccaccgcacccgggattgttattcttcactttgaatcccacatgttatttaaagctaagacctgaggcaaaaaaaaatcacttctatatttcaactaatactattttattactaggtaataagtcccaatatttacatttatgtacacatacacacacatttcctttctataccattaagataatggtagacctttatgtcaggaaaatgctataggctgggggcgagtggctcacgcctgtaatcccagcactttgggaggccgaggcgggaggatcacttgagcctaggagttcgaggccagtctgcacaacgtggtaaaaccatgtctctaaaaaaaaaaaaaaaaaaaaaaaaaaattagctgggcgtggtatcatgagcctgtaatcccagctactttcagctactcgggaggctgaggtgggaggatttcttgagcctgggaggcaaaggttgcagtgagcccagatcccaccactgtactgcagcctgggtgacaagagtgacaacctgtctcaaaaaaaaaaaaaaaaaaaagctattggtaattgaatttatctttattgaacaaatcctcttcattgcatgctttaaattttgatttgtttaaattttattgaattgtaataaaacgattttgaaattactagagaagcccaggcgctgtggctcacgcctgtaatcccaccactgtgggaggccaaggcaggcggatcacctgatgtcaagagttcgagaccagcctgaccaacatggtgaaaccccgtctctactaaaaacaccaaaaaacaattagccgggctagctgaaggcacctgtagtcccagctactcaggaggctgaggcaggagaatggcttgaacccgggaggcggaggttgcagtaagcagagatcgtgccattgcagtacagcctgggcgacagagagagtctccgtcaaaaaagaaaaagaagagaaaagaaaaagagaaaggaaggaagggaggaagggaggaagggaggacgagaggaagggaggaagggagggagggaaaagaaattcctgggcagatgaaagtgaggggtcgggggtcggggtcgggcgcggcgatgccgcagctgcggggctcggtggactcggcgagcaagagccccaggacgctgctggcggcgggcgaggagctggggcgcggcgcggggcggctctaggcgctgtggccgctcagcgtctgggacccagcgccgcccaggtcagggaatccttggtgttcccgccccgcagcacccggggcgggggaggagtcggcgcggtcgtgcggccgtggaggacagcgagacccggggctgcggctgcaggccgaggggcccctgggacagtgagaagcagcggcgggagctagtcacggggcagggagcgctcagcggtaaagacggcttcatctgactccagggctggcaggcggcccggatggcatgccgtctcctgcggagaattccaatttccccctaaatcgctcaacaagcgagaaggttttgggattcgaattcagtggggcaagcgaagtcgcctttccttcttaaacagatggaatccctggtccacaaacgtaccctgtgccaatttcatacaacacgctatggctgctgcggatgagaacacagcaactctgccagatgaaaagcttcaaggctctgtgaatccaaggtcaaaaacgccaaaaaggaaagtccttttccaggacaagcgcacgcgtgctggtcgtggagcgccccctcctcatggagaccggcctgggattgatgtccttcattaacaatgaggctaaactgggctattccatgactgaccaggggcaaaataggcttttagccagcggcattctgggagctctccccactaagaaggccaagggatgtggggtctgagagcctggcagtcctcatgcaaagccgctgctggctggaagcataggggtcttttaccttttgggatc

SEQ ID NO: 818 - DNA, 2654 bp, Homo sapiens
agcagcgccgcagccggacgagaaagcggaagatggcggcggcggccgggaggccgtgaggagagcggcggctgcgagggcggccgatggcggccgggaggcgccctcggacacttgcgggtcgttagggcgcgacgctgggaggcatgtcggagcacgtggagcccgcagctccggggcccgggcccaacggcggcggcggcggcccggcccccgcgcgcgggcctcgcacccccaatctcaaccccaaccccctcatcaacgtgcgcgaccggctcttccacgcgctgttcttcaagatggctgtcacctattcgcggctcttcccgcccgccttccgccgtctcttcgagttcttcgtgctgctcaaggccctgtttgtgctcttcgtcctggcctacatccacatcgtcttctcccgctcgcccatcaactgcctggagcatgtgcgtgacaagtggccgcgtgagggcatcctgcgtgtggaagtgcggcacaactcgagccgcgcgcccgtcttcctacagttctgtgacagcggcggccgcgggagcttcccgggcctggccgtggaaccaggcagcaacctggacatggaagatgaggaggaggaagagctgaccatggagatgtttgggaacagctccatcaagtttgagctggacatcgagcccaaggtgttcaagccgccgagtagcacagaggccctgaatgacagccaggagttccccttccccgagacgcccaccaaagtgtggccgcaggacgagtacatcgtggagtactcactagagtatggcttccttcgcctgtcgcaggccacccgccagcgcctgagcatccccgtcatggtggtcaccctggaccccacgcgggaccagtgcttcggggaccgcttcagccgcctgctgctggatgagttcctgggctacgatgacatcctcatgtccagcgtgaagggcctggccgagaacgaggagaacaagggcttcctgcggaatgtggtgtcgggcgagcactaccgctttgtgagcatgtggatggcgcggacgtcctacctggccgccttcgccatcatggtcatcttcacgctgagcgtgtccatgctgctgcggtactcacaccaccagatcttcgtcttcatcgtggacctgctgcagatgctggagatgaacatggccatcgccttccccgcagcgcccctgctgaccgtcatcctggccctcgtcgggatggaggccatcatgtcggagttcttcaacgacaccaccaccgccttctacatcatcctcatcgtgtggctcgcggaccagtatgacgccatctgctgccacaccagcaccagcaagcggcattggctgcgcattccatgatctacttcttccaccactacgagctgcctgccatcctgcagcaggtccgcatccaggagatgctgcttcaggcgccgccactgggccccgggacccccacggcgctgcccgatgacatgaacaacaactcgggcgccccggctacagcccctgactctgccggccagccccccgccctgggccccgtctcgcctggggccagcgggagtcccgggcctgtggcagcggcgcccagctccctggtggccgcggcagcctcagtggcagcagctgccggtggtgacctgggttggatggcagagaccgctgccatcatcacagacgcctccttcctgtccggcctgagcgcctccctcctggagcggcgtccagccagcccgctgggccctgctgggggcctcccccacgccccccaggacagtgtccccccgagtgactccgcagcttctgacacaactcccctgggggctgcggtaggcgggcctagcccggcctccatggccccaacggaggcgccctcggaggtggggtcctgagccgcacagctgagccgcctctgacccctgctggctgggcctgaccttcccgagcccgtgggggtgggggaggccagccacctccttcctctgggactgcccagcctgtgtcgggggctttcagggtttcgtggggtttgcccggaaggcggctttcctccccctggtgtgaggtcgcgcccgaggcttgtacccgctagtgaggtgtttgagctggtcagcaaggagagggggtggggttccgcggaaggttctggaggggtcttggtaggtctgcagtgaaccgtcctgaggatggagtggggtcccatggtgcaggtctctgagcaaggcggaggtgtggaggagaggccggcttggggtggggcctcgcgccctagtgccggccggcctcagcccggctctgcctggtgctccctgcagtgccttctccatggccccgccctccccgcgtgtgcgccaggcttggggtccccgggagagcagagcttgcgcctcgggcatagggacgtggggtgcaggcgccaacatcagtggcagcagccagggccgtggtccagtcccactcggggatggagtgggccggcggccaaaccagtcactcggggaggaatgcggaggagcgctcattccattctatttaattgcagtgtacaaaattgtgtttgtatatagaataaactgtctgttgacagcggcaaaaaaaaaaaaaaaaaaaaaaaaaaaaaaaaaaaaaaaaaaaaaa

SEQ ID NO: 819 - DNA, 3120 bp, Homo sapiens
ccaagccggagcccgagctggaggaagcccccaggtgccaggatctgcccggatccgcgcccgctccggccggcaccatggacagcgaggcattccagagcgcgcgggactttctggacatgaacttccagtcgctggccatgaaacacatggatctgaagcagatggagctggacacggcggcggccaaggtggatgaactgaccaagcagctggagtcgctgtggtcagactctcccgcgcctcctggcccgcaggccggacccccttctaggccgccccggtacagctccagctcgatccctgagcccttcggcagccgagggtccccccggaaggcggccaccgacggcgcagacaccccgttcggacgatcagagagtgccccaaccctacacccctacagcccgctgtcccccaagggacggccgtcgtcgccgcgcaccccgctctacctgcagccggacgcctacggcagcctggaccgcgcgacctcgccccggccccgcgccttcgatggcgcaggcagctccctcggccgtgcgccctccccgcggcccgggccaggcccgctccgccagcagggtccccccacgcctttcgacttcctgggccgcgcaggctccccccgcggcagccccctggcggaggggccccaggccttcttccccgagcgtgggccgtcaccgcgcccccctgccacagcctacgacgcgccagcgtccgccttcgggagctccctgctaggctccggcggcagcgcattcgccccgcctctgcgcgcgcaagacgacctgacgctgcgccggcggcctccgaaagcctggaacgagtctgacctggacgtggcgtacgagaagaagccttcgcagacagcgagctatgaacgcctggacgtcttcgcaaggcctgcctcgccgagcctgcagctgttgccttggagggagagcagcctggatggactggggggcaccggcaaggacaacctcactagcgccaccctgccgcgcaattacaaggtctctcctctggccagcgaccggcgttcagacgcgggcagctaccggcgctcgctgggctccgcggggccgtcgggcactttgcctcgcagctggcagcccgtcagccgcatccccatgcccccctccagcccccagccccgcggggccccgcgccagcgtcccatccccctcagcatgatcttcaagctgcagaacgccttctgggagcacggggccagccgcgccatgctccctgggtcccccctcttcacccgagcacccccgcctaagctgcagccccaaccacaaccacagccccagccacaatcacaaccacagccccagctgcccccacagccccagacccaaccccaaacccctaccccagccccccagcatccccaacagacatggccccctgtgaacgaaggaccccccaaaccccccaccgagctggagcctgagccggagatagaggggctgctgacaccagtgctggaggctggcgatgtggatgaaggccctgtagcaaggcctctcagccccacgaggctgcagccagcactgccaccggaggcacagtcggtgcccgagctggaggaggtggcacgggtgttggcggaaattccccggcccctcaaacgcaggggctccatggagcaggcccctgctgtggccctgccccctacccacaagaaacagtaccagcagatcatcagccgcctcttccatcgtcatggggggccagggcccggggggccggagccagagctgtcccccatcactgagggatctgaggccagggcagggccccctgctcctgccccaccagctcccattccacccccggccccgtcccagagcagcccaccagagcagccgcagagcatggagatgcgctctgtgctgcggaaggcgggctccccgcgcaaggcccgccgcgcgcgcctcaaccctctggtgctcctcctggacgcggcgctgaccggggagctggaggtggtgcagcaggcggtgaaggagatgaacgacccgagccagcccaacgaggagggcatcactgccttgcacaacgccatctgcggcgccaactactctatcgtggatttcctcatcaccgcgggtgccaatgtcaactcccccgacagccacggctggacacccttgcactgcgcggcgtcgtgcaacgacacagtcatctgcatggcgctggtgcagcacggcgctgcaatcttcgccaccacgctcagcgacggcgccaccgccttcgagaagtgcgacccttaccgcgagggttatgctgactgcgccacctacctggcagacgtcgagcagagtatggggctgatgaacagcggggcagtgtacgctctctgggactacagcgccgagttcggggacgagctgtccttccgcgagggcgagtcggtcaccgtgctgcggagggacgggccggaggagaccgactggtggtgggccgcgctgcacggccaggagggctacgtgccgcggaactacttcgggctgttccccagggtgaagcctcaaaggagtaaagtctagcaggatagaaggaggtttctgaggctgacagaaacaagcattcctgccttccctccagacctctccctctgttttttgctgcctttatctgcacccctcaccctgctggtggtggtccttgccaccggttctctgttctcctggaagtccagggaagaaggagggccccagccttaaatttagtaatctgccttagccttgggaggtctgggaagggctggaaatcactggggacaggaaaccacttccttttgccaaatcagatcccgtccaaagtgcctcccatgcctaccaccatcatcacatcccccagcaagccagccacctgcccagccgggcctgggatgggccaccacaccactggatattcctgggagtcactgctgacaccatctctcccagcagtcttggggtctgggtgggaaacattggtctctaccaggatccctgccccacctctccccaattaagtgccttcacacagcactggtttaatgtttataaacaaaatagagaaactttccttataaataaaagtagtttgcacagaaattga

SEQ ID NO: 820 - DNA, 2520 bp, Homo sapiens
gccgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagcctgtgaccactgccttagggcactagagaaggcagaggagaatgcccagaggctgaccgggaaaccaggccaggttctgcctcacccagagctgtgcactgtgcgcaaagacctccaccagaactgtccccattgccaagtgatgtactgcagtgcagaatgtcggttggcagccactgagcaataccaccaggtcctgtgcccaggcccctcccaggatgaccccttgcatcctctcaataagcttcaggaggcatggaggagtattcactacccacctgagactgcaagcatcatgttgatggctaggatggtggccacagtgaagcaggcgaaggacaaggaccgttggatcagactcttttcccagttttgtaacaaaacagccaatgaagaggaggaaattgtccataaacttctgggagacaaattcaagggccaactggaacttctgcggagactcttcacagaggccctctatgaggaagcagtcagccagtggttcactccagatggattccggtctctctttgctcttgttgggaccaatggccaaggaatcgggaccagctccctaagccagtgggtccatgcctgtgacactctggagttgaagcctcaggaccgtgagcacgttgacgccttcattgaccagctatacaaggacatcgaggcagcaactggagagtttcttaactgtgaaggatctggcctctttgtgcttcagagctgctgcaaccacagttgtgtgcccaatgcagagacctcctttccagaaaacaacttccttttgcatgtcactgctctggaggatattaagccaggagaggaaatttgtatcagctacttggactgctgtcagcgggagcgcagccgccacagccgccacaagatcctcagggagaactatctatttgtctgttcctgtcccaaatgcctggcagaggctgatgaacccaatgtgacctcagaagaggaagaggaagaggaggaggaggaggaaggagagccagaagatgcagagctgggggatgagatgactgatgtgtgatgttgccctgcccagaaagggccctgccctagaccctgccagaaaagggggctcttcccccagagaagtggcttggagggaacttcccactcccattgcctgctttccccattccagccctctctgctagagggtaggagagagcctggatctctggccccaacccccaccagacctcatgccctggacactgctgctgagttggctcagactctgcactggcactgagcctttcacaactggcctccccttgaggttcctccactctagggtttgaggggctggaatcagggccagggcctaacagtgtttcttcccctcggccccacggcccatactcaccccttcacctgaggcttctcccctctcaacttgctgttgatttcttttgaggggtaaaagaaagaccgagttcattgaagcagagatgggaggtggtgaggcgtcctcacctccccccaccacagctgtggctggtaaggcaactgcttgaccactggcccagcaagcagaggcgggcaggaggatctgggcatcctgagccccttccctgaggctgtctcctgggaatgctggaccagggggattacttcccccacccacacccccatttggacatctggggaagtggagattaaccctcccccagactcgtgccttgcctctcaggacctggcacagtggctggccttatggagtatggaaaaggcctctgccttcctcaggagggacacatagtgggtcatcaccctttctcacacctgcttcccaatgagcactcagcagcatggctgagacctggggcttgacaggcctgcgctccttagattaggatgctctggtattcctggggccagttaaaatgggtcagtgaggggctctcctggcctcaatctccatctttagggtctccacagactaacattgaagtcttccagaaacctcgaggagctgggctagatacttcgagagtagccctgtcttgtcccctcctacccccagattagcaccacccctctcactcttgggttggatgctatgggaattacaacccatcactcccaatgcctccctttcctggaggagcctgctgcattctcctgctgagggatcccagagagggcaggtgcccaccccacaggccctttcctggaccatggagccaggtgaaacctgtctggccccttacccattgggttcttactccttcacaacggtcagcactcctctcccagcccccctgcccactgttctcaataaaatgtgagtggtgaaaaaaaa

SEQ ID NO: 821 - DNA, 3260 bp, Homo sapiens
cagaagcaggggggaatcctgaatcgagctgagagggcttccccggttctcctgggaaccccatcggccccctgccagcacacacctgagcagcatcacaggacatggccccctcagccacctagctggggcccatctaggagtggcatcttttttggtgccctgaaggccagctctggaccttcccaggaaaagtgccagctcacagaactgcttgaccaaaggaccggctcttgagacatcccccaacccacctggcccccagctagggtgggggctccaggagactgagattagcctgccctctttggacagcagctccaggacagggcgggtgggctgaccacccaaaccccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattct

SEQ ID NO: 822 - DNA, 3142 bp, Homo sapiens
tgcgagctgtttgaggactgggatgccgagaacgcgagcgatccgagcagggtttgtctgggcaccgtcggggtaggatccggaacgcattcggaaggctttttgcaagcatttacttggaaggagaacttgggatctttctgggaaccccccgccccggctggattggccgagcaagcctggaaaatggtaaatgatcatttggatcaattacaggcttttagctggcttgtctgtcataattcatgattcggggctgggaaaaagaccaacagcctacgtgccaaaaaaggggcagagtttgatggagttgggtggacttttctatgccatttgcctccacacctagaggataagcacttttgcagacattcagtgcaagggagatcatgtttgactgtatggatgttctgtcagtgagtcctgggcaaatcctggatttctacactgcgagtccgtcttcctgcatgctccaggagaaagctctcaaagcatgcttcagtggattgacccaaaccgaatggcagcatcggcacactgctcaatcaattgaaacacagagcaccagctctgaggaactcgtcccaagccccccatctccacttcctccccctcgagtgtacaaaccctgcttcgtctgccaggacaaatcatcagggtaccactatggggtcagcgcctgtgagggatgtaagggctttttccgcagaagtattcagaagaatatgatttacacttgtcaccgagataagaactgtgttattaataaagtcaccaggaatcgatgccaatactgtcgactccagaagtgctttgaagtgggaatgtccaaagaatctgtcaggaatgacaggaacaagaaaaagaaggagacttcgaagcaagaatgcacagagagctatgaaatgacagctgagttggacgatctcacagagaagatccgaaaagctcaccaggaaactttcccttcactctgccagctgggtaaatacaccacgaattccagtgctgaccatcgagtccgactggacctgggcctctgggacaaattcagtgaactggccaccaagtgcattattaagatcgtggagtttgctaaacgtctgcctggtttcactggcttgaccatcgcagaccaaattaccctgctgaaggccgcctgcctggacatcctgattcttagaatttgcaccaggtataccccagaacaagacaccatgactttctcagacggccttaccctaaatcgaactcagatgcacaatgctggatttggtcctctgactgaccttgtgttcacctttgccaaccagctcctgcctttggaaatggatgacacagaaacaggccttctcagtgccatctgcttaatctgtggagaccgccaggaccttgaggaaccgacaaaagtagataagctacaagaaccattgctggaagcactaaaaatttatatcagaaaaagacgacccagcaagcctcacatgtttccaaagatcttaatgaaaatcacagatctccgtagcatcagtgctaaaggtgcagagcgtgtaattaccttgaaaatggaaattcctggatcaatgccacctctcattcaagaaatgctggagaattctgaaggacatgaacccttgaccccaagttcaagtgggaacacagcagagcacagtcctagcatctcacccagctcagtggaaaacagtggggtcagtcagtcaccactcgtgcaataagacattttctagctacttcaaacattccccagtaccttcagttccaggatttaaaatgcaagaaaaaacatttttactgctgcttagtttttggactgaaaagatattaaaactcaagaaggaccaagaagttttcatatgtatcaatatatatactcctcactgtgtaacttacctagaaatacaaacttttccaattttaaaaaatcagccatttcatgcaaccagaaactagttaaaagcttctattttcctctttgaacactcaagattgcatggcaaagacccagtcaaaatgatttacccctggttaagtttctgaagactttgtacatacagaagtatggctctgttctttctatactgtatgtttggtgctttccttttgtcttgcatactcaaaataaccatgacaccaaggttatgaaatagactactgtacacgtctacctaggttcaaaaagataactgtcttgctttcatggaatagtcaagacatcaaggtaaggaaacaggactattgacaggactattgtacagtatgacaagataaggctgaagatattctactttagttagtatggaagcttgtctttgctctttctgatgctctcaaactgcatcttttatttcatgttgcccagtaaaagtatacaaattccctgcactagcagaagagaattctgtatcagtgtaactgccagttcagttaatcaaatgtcatttgttcaattgttaatgtcactttaaattaaaagtggtttattacttgtttaatgacataactacacagttagttaaaaaaaatttttttacagtaatgatagcctccaaggcagaaacacttttcagtgttaagtttttgtttacttgttcacaagccattagggaaatttcatgggataattagcaggctggtctaccacctggaccatgtaactctagtgtccttcctgattcatgcctgatattgggatttttttttccagccttcttgatgccaaggggctaattaatattaacaactcccaaagaaacaggcatagaatctgcctcctttgaccttgttcaatcactatgaagcagagtgaaagctgtggtagagtggttaacagatacaagtgtcagtttcttagttctcatttaagcactagtggaattttttttttttgatatattagcaagtctgtgatgtactttcactggctctgtttgtacattgagattgtttgtttaacaatgctttctatgttcatatactgtttacctttttccatggagtctcctggcaaagaataaaatatatttattttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 823 - DNA, 2992 bp, Homo sapiens
tggggggggggtggggagggagaaaaagaaagaaaatattttccgtgtccccgcctgcagagtcagtgtgcggtttgggagaaaatgtgtcggatattttggggcggtcacgtgggcgggcgggctccgagaggccccgggacagtcccagcctagagccgtgcccccccaggagccccccagtacggcgagccccggacattgcgacgctccatccaagagactgcccgacgccgggacctcggggctccgccgcctcccttccccctcccactccagctacggcccagttccctcaacctgacccagtatgtagaagccagtctctgcaggcggccagcgggacttttggaggcccagtgggcaggccaggcagggcgggtacggagcctcccaggctggggcagtgggcatgggcaggggctgtggctgaagacctcgcccgcccactgcagaccccaggggactctcacaccgcagctgccatggccaccaataaggagcgactctttgcggctggtgccctggggcctggatctggctacccaggggcaggtttccccttcgccttcccaggggcactcagggggtctccgcctttcgagatgctgagccctagcttccggggcctgggccagcctgacctccccaaggagatggcctctctgtcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactcaaaaaaaaaaaaaaaaaaaaaaaaaaaaaaaaaaaa

SEQ ID NO: 824 - DNA, 3197 bp, Homo sapiens
ctgggactaaggcggcagcgggctgagcgctcggccacccccagcgtgcgcagcccgggcgggcttcgcccgcggagcttgacctagggtcgggacccgtcgggttgcaccgccgcactcgggaagacccggcttcgagcctctcctctccgtctccaaagcgccctcccgcctcccggcgctccccatgcacctgccgggctgcgcgccagccatggccgacgggagcttctcgcttgccggccacctgctccgcagcccgggcgggagcacctcgcgacttcacagcatcgaggccatcctggggtttaccaaggacgacgggatcctcggcaccttcccggcggagcggggcgcccggggcgcgaaggagcgggataggaggctgggcgcgcggcccgcctgccccaaggcgcccgaggaaggctccgagccctccccgccgccagccccggcgcccgcccccgagtacgaagcccctcgaccctactgccccaaggagcccggggaggcacggccgagcccagggctgcccgtcgggccagccaccggcgaagcgaaactgtcagaggaggaacagcccaagaaaaagcatcggcggaaccgcacgactttcaccacgtaccagctgcatgagctggagcgcgcgttcgagaagtcccactacccggacgtgtacagccgcgaggagctggccggcaaggtcaacctaccagaggtccgggtccaggtgtggttccagaaccgacgggctaagtggcggcggcaggagaagctggaagtgtcctccatgaagctgcaggactcgcccctcctctccttcagccgctccccgccctccgcgacgctgtcgcccctcggggcgggcccgggcagcggtggcgggccggctgggggcgcgctgccgctggagtcctggctcgggccgccgctgccgggcgggggcgccacggcgctgcagagcctgccgggcttcgggccgccggcgcagagcctgcctgccagctacacgccaccgccgccgcctccgcccttcctgaactccccgccgttgggccccggcctgcaacctctcgcgccgccgccgccctcctacccgtgcgggcccggcttcggggacaagttcccgctggacgaggcggacccgcgcaacagcagcatcgcggcgctgcgtctgaaagccaaggagcacatccaggccatcgggaagccgtggcaggccctctaggggcactggggaacgtcttgggatccgaccccgggccgaccgcaccgtacccgcatcctctctcccagggacaacccccctccccagctcggcccctctttccctgtcgcctgcagccacccgccaagcatagttcagggccacgcgcctgctcccgatgcacggggagaagggcgactttcaggcctgaggagaggccctctggccgcctcaacgcacttcgcggacctcagccctgcagctggagggcaacaggctgccgggccccgctggccacgccgctcccatcaccgcaggcgctggagcctccaggcccaaacaggctgaagctcctaaacttggccattcccaggaggcttggagacccccagataaccataacagggaagcaggggaggcggaaaaatagagtttgagaaacttttgtataagtagtttcaaactatttgagaggagaattaaagacatgcttgttttgtttcgactctgtttaagcacgctcaggacttggggagaggagtgaatattggggtacgggaggagggtgcgttgacggacagggtgggtcagggaaagaggaggactgagaagaagctcagggtttccttgtgaaaattctagggacacttcgctgcagcagagaatcgtccccattccgaacgcttcggcggcctagaccagaggcgcccttccctggagccggcgtgcgcgcttggggtccggagtggatggggctaaggctcagatgctagcgcgctcccagttcccccgctagccccatagtccagcggcagctgatattttcaagtttgacttcaatagaaagcgtcaagaccaccttccctagggcgagagcgaagtgtcccccggcccctggcgtccccgctctcctaaggactcctctcagttcaccaagcagatctccggttcggtgccagtccctaacacccaaggttgatcaccagcggtacaagaactgaggcaaagagatgcttttccttttcggagccgcgagactctctaacctccccaactcgctccacactcgccaacccagagttcggtaaaaggcgcgtctggtgaggtgccgcgctcggagagtgtcctggagcgccctacgccaccgccccgagagctagttcttgcgggcgtgccctggacagtatctgcagttctttggcgccggctctagggcgaggaaggaatctcgaaatctcagcccgcttcacaatctcctgagactctctgaagaaggagagtcccggactcccgcctgagcgtgctcgatatccaccgttgacactggaagctgggcgaccgccagcagaacctggatgcccgccaacaggtcctggcacggggggggggggggcgtccaccccacaacccccgtccctaagcgtgctttcaggatgatgcccccagagccttaattagcatcaactggctactgtctgtcggtcctgagcaaattagtgaagctcccagtcccctttcctcgtctaaataaactctgtctctctggaaggtgggaaagatggaataagatcacctgtaaaggctttgtggaaagtaccaagaccctggcatgacgcaatatggattgtaatcatcgtccccatttccccgaaattccctggctgttctccggttcctgaaaccgacttgggaaaaggatgaccacgctggagctgggaatatgggaagcctcatcatagtttccagtcctttctctgcgggtctaagaggctattgcataaccagggctgtgtacccctagacctccagatggtgccttgcacacagtaggctgatcagtaaaaatgtactgaataaattattcccccccaagaggtagggagtaatatctgcacttttcctcacaaggatgtctccttgggggaggaggatggagcagcccgtgtgttatcaccttttagcaagaaaacaaaacaaaacaaaaccagaa

SEQ ID NO: 825 - DNA, 4772 bp, Homo sapiens
gctcagttgccgggcgggggagggcgcgtccggtttttctcaggggacgttgaaattatttttgtaacgggagtcgggagaggacggggcgtgccccgacgtgcgcgcgcgtcgtcctccccggcgctcctccacagctcgctggctcccgccgcggaaaggcgtcatgccgcccaaaaccccccgaaaaacggccgccaccgccgccgctgccgccgcggaacccccggcaccgccgccgccgccccctcctgaggaggacccagagcaggacagcggcccggaggacctgcctctcgtcaggcttgagtttgaagaaacagaagaacctgattttactgcattatgtcagaaattaaagataccagatcatgtcagagagagagcttggttaacttgggagaaagtttcatctgtggatggagtattgggaggttatattcaaaagaaaaaggaactgtggggaatctgtatctttattgcagcagttgacctagatgagatgtcgttcacttttactgagctacagaaaaacatagaaatcagtgtccataaattctttaacttactaaaagaaattgataccagtaccaaagttgataatgctatgtcaagactgttgaagaagtatgatgtattgtttgcactcttcagcaaattggaaaggacatgtgaacttatatatttgacacaacccagcagttcgatatctactgaaataaattctgcattggtgctaaaagtttcttggatcacatttttattagctaaaggggaagtattacaaatggaagatgatctggtgatttcatttcagttaatgctatgtgtccttgactattttattaaactctcacctcccatgttgctcaaagaaccatataaaacagctgttatacccattaatggttcacctcgaacacccaggcgaggtcagaacaggagtgcacggatagcaaaacaactagaaaatgatacaagaattattgaagttctctgtaaagaacatgaatgtaatatagatgaggtgaaaaatgtttatttcaaaaattttataccttttatgaattctcttggacttgtaacatctaatggacttccagaggttgaaaatctttctaaacgatacgaagaaatttatcttaaaaataaagatctagatgcaagattatttttggatcatgataaaactcttcagactgattctatagacagttttgaaacacagagaacaccacgaaaaagtaaccttgatgaagaggtgaatgtaattcctccacacactccagttaggactgttatgaacactatccaacaattaatgatgattttaaattcagcaagtgatcaaccttcagaaaatctgatttcctattttaacaactgcacagtgaatccaaaagaaagtatactgaaaagagtgaaggatataggatacatctttaaagagaaatttgctaaagctgtgggacagggttgtgtcgaaattggatcacagcgatacaaacttggagttcgcttgtattaccgagtaatggaatccatgcttaaatcagaagaagaacgattatccattcaaaattttagcaaacttctgaatgacaacatttttcatatgtctttattggcgtgcgctcttgaggttgtaatggccacatatagcagaagtacatctcagaatcttgattctggaacagatttgtctttcccatggattctgaatgtgcttaatttaaaagcctttgatttttacaaagtgatcgaaagttttatcaaagcagaaggcaacttgacaagagaaatgataaaacatttagaacgatgtgaacatcgaatcatggaatcccttgcatggctctcagattcacctttatttgatcttattaaacaatcaaaggaccgagaaggaccaactgatcaccttgaatctgcttgtcctcttaatcttcctctccagaataatcacactgcagcagatatgtatctttctcctgtaagatctccaaagaaaaaaggttcaactacgcgtgtaaattctactgcaaatgcagagacacaagcaacctcagccttccagacccagaagccattgaaatctacctctctttcactgttttataaaaaagtgtatcggctagcctatctccggctaaatacactttgtgaacgccttctgtctgagcacccagaattagaacatatcatctggacccttttccagcacaccctgcagaatgagtatgaactcatgagagacaggcatttggaccaaattatgatgtgttccatgtatggcatatgcaaagtgaagaatatagaccttaaattcaaaatcattgtaacagcatacaaggatcttcctcatgctgttcaggagacattcaaacgtgttttgatcaaagaagaggagtatgattctattatagtattctataactcggtcttcatgcagagactgaaaacaaatattttgcagtatgcttccaccaggccccctaccttgtcaccaatacctcacattcctcgaagcccttacaagtttcctagttcacccttacggattcctggagggaacatctatatttcacccctgaagagtccatataaaatttcagaaggtctgccaacaccaacaaaaatgactccaagatcaagaatcttagtatcaattggtgaatcattcgggacttctgagaagttccagaaaataaatcagatggtatgtaacagcgaccgtgtgctcaaaagaagtgctgaaggaagcaaccctcctaaaccactgaaaaaactacgctttgatattgaaggatcagatgaagcagatggaagtaaacatctcccaggagagtccaaatttcagcagaaactggcagaaatgacttctactcgaacacgaatgcaaaagcagaaaatgaatgatagcatggatacctcaaacaaggaagagaaatgaggatctcaggaccttggtggacactgtgtacacctctggattcattgtctctcacagatgtgactgtataactttcccaggttctgtttatggccacatttaatatcttcagctctttttgtggatataaaatgtgcagatgcaattgtttgggtgattcctaagccacttgaaatgttagtcattgttatttatacaagattgaaaatcttgtgtaaatcctgccatttaaaaagttgtagcagattgtttcctcttccaaagtaaaattgctgtgctttatggatagtaagaatggccctagagtgggagtcctgataacccaggcctgtctgactactttgccttcttttgtagcatataggtgatgtttgctcttgtttttattaatttatatgtatatttttttaatttaacatgaacacccttagaaaatgtgtcctatctatcttccaaatgcaatttgattgactgcccattcaccaaaattatcctgaactcttctgcaaaaatggatattattagaaattagaaaaaaattactaattttacacattagattttattttactattggaatctgatatactgtgtgcttgttttataaaattttgcttttaattaaataaaagctggaagcaaagtataaccatatgatactatcatactactgaaacagatttcatacctcagaatgtaaaagaacttactgattattttcttcatccaacttatgtttttaaatgaggattattgatagtactcttggtttttataccattcagatcactgaatttataaagtacccatctagtacttgaaaaagtaaagtgttctgccagatcttaggtatagaggaccctaacacagtatatcccaagtgcactttctaatgtttctgggtcctgaagaattaagatacaaattaattttactccataaacagactgttaattataggagccttaatttttttttcatagagatttgtctaattgcatctcaaaattattctgccctccttaatttgggaaggtttgtgttttctctggaatggtacatgtcttccatgtatcttttgaactggcaattgtctatttatcttttatttttttaagtcagtatggtctaacactggcatgttcaaagccacattatttctagtccaaaattacaagtaatcaagggtcattatgggttaggcattaatgtttctatctgattttgtgcaaaagcttcaaattaaaacagctgcattagaaaaagaggcgcttctcccctcccctacacctaaaggtgtatttaaactatcttgtgtgattaacttatttagagatgctgtaacttaaaataggggatatttaaggtagcttcagctagcttttaggaaaatcactttgtctaactcagaattatttttaaaaagaaatctggtcttgttagaaaacaaaattttattttgtgctcatttaagtttcaaacttactattttgacagttattttgataacaatgacactagaaaacttgactccatttcatcattgtttctgcatgaatatcatacaaatcagttagtttttaggtcaagggcttactatttctgggtcttttgctactaagttcacattagaattagtgccagaattttaggaacttcagagatcgtgtattgagatttcttaaataatgcttcagatattattgctttattgcttttttgtattggttaaaactgtacatttaaaattgctatgttactattttctacaattaatagtttgtctattttaaaataaattagttgttaagagtcttaa

SEQ ID NO: 826 - DNA, 7150 bp, Homo sapiens
cgagcacagtgtatctggccggagcagtgcttatggcgatgctacagctgaggggcatccggctggaccaggaagtgtcagctcaagcactggagccatcagcaccaccactgggcaccaggagggagatggctccgagggagaaggagaaggagaaactgaaggagatgtccacactagcaacaggctgcacatggtccgtctaatgctgttggagagattactgcagaccctgcctcaattacgaaacgttggcggtgtccgggccatcccatacatgcaggtcattctaatgctcactacagatctggatggagaagatgagaaagacaagggggccctagacaacctgctctcccagcttattgctgagttgggtatggataaaaaggatgtctccaagaagaatgagcgcagcgccctgaatgaagtccatctggtagtaatgagactcctgagtgtcttcatgtcccgcaccaaatctggatccaagtcttccatatgtgagtcatcttccctcatctccagtgccacagcagcagctctactgagctctggggctgtggactactgcctgcacgtgctcaaatcactgctggaatattggaagagccaacagaatgacgaggagcctgtggctaccagccagttgctgaaaccacatactacctcctccccacctgacatgagcccattctttctccgccagtatgtgaagggtcatgctgctgatgtgtttgaggcctatactcagcttctaacagaaatggtactgaggcttccttaccaaatcaaaaagattactgacaccaattctcgaatcccacctcctgtctttgaccactcgtggttttactttctctccgagtacctcatgatccagcagactccatttgtgcgccgtcaagtccgcaaacttctgctcttcatctgtggatccaaagagaagtaccgccagctccgggatttgcacaccctggactctcacgtgcgtgggatcaagaagctgctagaagagcaggggatattcctccgggcaagtgtggttacagccagctcaggctccgccttgcaatatgacacactcatcagcctgatggagcacctgaaagcctgtgcagagattgccgcccagcgaaccatcaactggcagaaattctgcatcaaagatgactccgtcctgtacttcctcctccaagtcagtttccttgtggatgagggcgtgtccccagtgctgctgcaactgctctcctgtgctctgtgcggcagcaaggtgctcgctgcactggcagcctcttcgggatcctccagtgcttcttcctcctcagcccctgtggctgccagttctggacaagccacaacacagtccaagtcttccactaaaaagagcaagaaagaagaaaaagaaaaggagaaagatggtgagacctctggcagccaggaggaccagctgtgcacagctctggtgaaccagctgaacaaatttgccgataaggaaaccctgatccagttcctgcgttgtttcctgttagagtccaattcttcctcggtgcgctggcaggcccactgtctgacactgcacatctacagaaattccagcaaatctcaacaggagctcctgctagatctgatgtggtccatctggccagaactcccagcctatggtcgtaaggctgcccagtttgtggacctactaggatatttctccctgaaaactccacaaacagagaagaagttgaaggagtattcacagaaggctgtggagattctgcggactcaaaaccatattcttaccaaccaccccaactcgaacatttataacactttgtctggcttagtggagtttgatggctattacctggagagcgatccctgcctggtgtgtaataacccggaagtaccgttctgttatatcaagctgtcttccattaaagtggacacgcggtacaccaccacccagcaggttgtgaagctcattggcagtcacaccatcagcaaagtgacagtgaaaatcggggatctgaaacggaccaagatggtgcggaccatcaacctgtattataacaaccgaaccgtgcaggccatcgtggagttgaaaaacaagccagctcgctggcacaaagccaagaaggttcagctgacccctggacagacagaggtgaagattgacctgccgttgcccattgtggcctccaatctgatgattgagtttgcagacttctatgaaaactaccaggcctccacagagaccctgcagtgccctcgctgtagtgcctcggtccctgccaacccaggagtctgtggcaactgtggagagaatgtgtaccagtgtcacaaatgcagatccatcaactacgatgaaaaggatcccttcctctgcaatgcctgtggcttctgtaaatatgcccgcttcgacttcatgctctatgccaagccttgctgtgcagtggatcccattgagaatgaagaagaccggaagaaggctgtatccaacatcaatacacttttggacaaagctgatcgagtgtatcatcagctgatgggacaccggccacagctggagaacctgctctgcaaagtgaatgaggcagctccagaaaagccacaggatgactcaggaacagcagggggcatcagctccacttctgccagtgtgaatcgttacatcctgcagttggctcaggagtattgtggagactgcaagaactcttttgatgaactctccaaaatcatccagaaagtctttgcttcgcgcaaagagttgttggaatatgacctacagcagagggaagcagccactaaatcatcccggacctccgtgcagcccacattcactgccagccagtaccgtgccttatccgtcctgggctgtggccacacatcctccaccaagtgctatggctgcgcctcggctgtcacagaacattgtatcacactacttcgggccctggccaccaacccagccttgaggcacatccttgtctcccagggccttatccgggagctctttgattataatcttcgccgaggggctgcggccatgcgggaggaggtccgccagctcatgtgcctcctaactcgagacaacccagaagccacccaacagatgaatgacctgattattggcaaggtctccacagccctgaagggccactgggccaaccccgatctggcaagtagcctgcagtatgaaatgctgctgctgacggattctatctccaaggaggacagctgctgggagctccggttacgctgtgctctcagccttttcctcatggctgtgaacattaagactcctgtggtggttgaaaacattaccctcatgtgcctgaggatcttgcagaagctgataaaaccacctgctcccactagcaagaagaacaaggatgtccccgttgaggccctcaccacggtgaagccatactgcaatgagatccatgcccaggctcaactgtggctcaagagagaccccaaggcatcctatgatgcctggaagaagtgtcttcctatcagagggatagatggcaatgggaaagcccccagcaaatcagagctccgccatctctatttgactgagaagtatgtgtggaggtggaaacagttcctgagtcgtcgggggaagaggacctcccccttggatctcaaactggggcataacaactggctgcgacaagtgcttttcactccagcaacgcaggccgcacggcaggcagcctgtaccattgtggaagctctagccaccattcccagccgcaagcagcaggtcctggacctgcttaccagttacctggatgagctgagcatagctggggagtgtgcagctgagtacctggctctctaccagaagctcatcacttctgcgcactggaaagtctacttggcagctcggggagtcctaccctatgtgggcaacctcatcaccaaggaaatagctcgtctgctggccctggaggaggctaccctgagtaccgatctgcagcagggttatgcccttaaaagtctcacaggccttctctcctcctttgttgaggtggaatccatcaaaagacattttaaaagtcgcttggtgggtactgtgctgaatggatacctgtgcttgcggaagctggtggtgcagaggaccaagctgatcgatgagacgcaggacatgctgctggagatgctggaggacatgaccacaggtacagaatcagaaaccaaggccttcatggctgtgtgcattgagacagccaagcgctacaatctggatgactaccggaccccggtgttcatcttcgagaggctctgcagcatcatttatcctgaggagaatgaagtcactgagttctttgtgaccctggagaaggatccccaacaagaagacttcttacagggcaggatgcctgggaacccgtatagcagcaatgagccaggcatcgggccgctgatgagggatataaagaacaagatttgccaggactgtgacttagtggccctcctggaagatgacagtggcatggagcttctagtgaacaataaaatcattagtttggaccttcctgtggctgaagtttacaagaaagtctggtgtaccacgaatgagggagagcccatgaggattgtttatcgtatgcgggggctgctgggcgatgccacagaggagttcattgagtccctggactctactacagatgaagaagaagatgaagaagaagtgtataaaatggctggtgtgatggcccagtgtgggggcctggaatgcatgcttaacagactcgcagggatcagagatttcaagcagggacgccaccttctaacagtgctactgaaattgttcagttactgcgtgaaggtgaaagtcaaccggcagcaactggtcaaactggaaatgaacaccttgaacgtcatgctggggaccctaaacctggcccttgtagctgaacaagaaagcaaggacagtgggggtgcagctgtggctgagcaggtgcttagcatcatggagatcattctagatgagtccaatgctgagcccctgagtgaggacaagggcaacctcctcctgacaggtgacaaggatcaactggtgatgctcttggaccagatcaacagcacctttgttcgctccaaccccagtgtgctccagggcctgcttcgcatcatcccgtacctttcctttggagaggtggagaaaatgcagatcttggtggagcgattcaaaccatactgcaactttgataaatatgatgaagatcacagtggtgatgataaagtcttcctggactgcttctgtaaaatagctgctggcatcaagaacaacagcaatgggcaccagctgaaggatctgattctccagaaggggatcacccagaatgcacttgactacatgaaaaagcacatccctagcgccaagaatttggatgccgacatctggaaaaagtttttgtctcgcccagccttgccatttatcctaaggctgcttcggggcctggccatccagcaccctggcacccaggttctgattggaactgattccatcccgaacctgcataagctggagcaggtgtccagtgatgagggcattgggaccttggcagagaacctgctggaagccctgcgggaacaccctgacgtaaacaagaagattgacgcagcccgcagggagacccgggcagagaagaagcgcatggccatggcaatgaggcagaaggccctgggcaccctgggcatgacgacaaatgaaaagggccaggtcgtgaccaagacagcactcctgaagcagatggaagagctgatcgaggagcctggcctcacgtgctgcatctgcagggagggatacaagttccagcccacaaaggtcctgggcatttataccttcacgaagcgggtagccttggaggagatggagaataagccccggaaacagcagggctacagcaccgtgtcccacttcaacattgtgcactacgactgccatctggctgccgtcaggttggctcgaggccgggaagagtgggagagtgccgccctgcagaatgccaacaccaagtgcaacgggctccttccggtctggggacctcatgtccctgaatcagcttttgccacttgcttggcaagacacaacacttacctccaggaatgtacaggccagcgggagcccacgtatcagctcaacatccatgacatcaaactgctcttcctgcgcttcgccatggagcagtcgttcagcgcagacactggcgggggcggccgggagagcaacatccacctgatcccgtacatcattcacactgtgctttacgtcctgaacacaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggctgacagataaggcagtgaaggactattccgcttaccgttcttcccttctcttttgggccctcgtcgatctcatttacaacatgtttaagaaggtgcctaccagtaacacagagggaggctggtcctgctctctcgctgagtacatccgccacaacgacatgcccatctacgaagctgccgacaaagccctgaaaaccttccaggaggagttcatgccagtggagaccttctcagagttcctcgatgtggccggtcttttatcagaaatcaccgatccagagagcttcctgaaggacctgttgaactcagtcccctgaccaccacacagcagctgcggcggcgaagacgaagctggcttgccttccaccctctgttctccctccttgtgcattaagttccctccgcgggatgctgcattgttaccccgccctcccctctctcatttttcttggtgtggcttggggtttttaggcttcctgttttatctcgtgtgtgtggtgcaccagctatgaggttgtctgtaacccaagccatcaaagggcctgtacatacctaggagccatgagttgtcccggccagcttcatacttgagtgtgcacatcttgagaaataaacaagtgacttaacacacattg

SEQ ID NO: 827 - DNA, 6551 bp, Homo sapiens
ccagtggacgagaatcgcggagcctgcggggctggaggttgagcgcccgggccagcacctaggcgggcgcgggggtgtgcaggccagggttcgcgcgggccgggtggaggcttgagcggggacccccgagcttgagccccggagccggcggcgctggggccagaggggccggacgggaggtggcggaggtggcggcggaggcgaaggggcggcgggacgcgggcctggcccgtgtgtgtcctggcggcctggcccaggctgccgctgtacggtgagcccgagggaggcggatctgggtcccgggaaggacacccgcctggatttgccccttaggcccggcccgggcccctcgggagcagaacaaccttagtgaggtggacaggaggggacctcgcgagcagacgcgcgccagcgacagcagccccgccccggcctctcgggagccgtggggcagaggctgcggagccccagaagggtctaccagccacagtctctgcacgtttccaagagcagcagaaaatgaacacattgcaggggccagtgtcattcaaagatgtggctgtggatttcacccaggaggagtggcagcagctggaccctgatgagaagataacttacagggatgtgatgttggagaactatagccatctagtttctgtgggatatgataccaccaagccaaacgtcatcattaagttggagcagggagaggagccgtggataatgggaggtgaatttccatgtcaacatagtccagaagcctggagagttgatgacctgatagagagaatccaagaaaacgaagacaaacattcaaggcaagctgcttgtatcaatagcaaaaccctgactgaagagaaagagaatacatttagtcaaatttacatggaaacaagccttgttccttcaagcataatagctcataattgtgtctcatgtggaaagaatttagaatctatttcgcaattaattagtagtgatggaagctatgctaggacaaaacctgatgagtgtaatgaatgtgggaaaacatatcatggagagaaaatgtgtgaatttaatcaaaatggggatacctattctcacaatgaagaaaatattcttcagaaaattagtattttggagaaaccctttgaatataatgaatgcatggaagccttagacaatgaggctgtttttattgctcataagagagcttacataggggagaagccctatgagtggaatgattctggaccagacttcatacagatgtcaaattttaatgcatatcagagatcacaaatggaaatgaagccctttgaatgcagtgaatgtggaaaatccttctgtaaaaagtcaaaattcatcatccaccagagggctcacacaggagagaaaccttatgaatgtaatgtatgtgggaaatccttcagccaaaagggaaccctcactgtacatcggagatcacacttagaggagaagccctataaatgtaatgaatgtgggaaaaccttttgtcagaagttacacctcactcaacacctaagaactcattcaggagagaaaccctacgaatgtagcgaatgtgggaaaaccttctgccaaaagacacatctcaccctgcaccagaggaatcattcaggagagaggccctatccatgtaacgaatgtgggaaatccttctcccgcaagtctgctctcagtgaccatcagagaactcacacgggagagaagctttataaatgtaatgaatgtgggaaatcctactaccgaaagtctactctgattacacatcagagaacacacacgggagagaagccctatcagtgtagcgagtgtgggaaattcttttctcgggtgtcatacctcactatacattatagaagtcatttagaagagaaaccctatgaatgtaatgaatgtggcaaaaccttcaatttaaattcagccttcattagacatcggaaagtacacacagaagagaaatcccatgaatgtagtgaatgtggaaagttctctcagttgtatctcaccgaccatcatacagctcatttagaagagaaaccctatgaatgtaatgaatgtgggaaaaccttccttgtaaattcagccttcgatgggcaccagccacttccaaaaggggagaaatcctatgaatgtaatgtatgtggaaagttattcaatgagttgtcatactatactgaacattatagaagtcattcagaagagaaaccttatggatgtagcgaatgtgggaaaaccttttcccataattcatccctcttcagacatcaaagagtacacacaggcgagaaaccctatgaatgttacgaatgtggaaaattcttctctcagaaatcatatctcactatacatcatcgaattcattcaggagagaaaccctatgaatgtagtaaatgtggaaaagtcttctctcggatgtcaaacctcactgtccactacagaagccattcaggagagaaaccctatgaatgtaatgaatgtgggaaagtcttttctcagaagtcatacctcactgtacactatagaactcattcaggagagaaaccctatgaatgtaacgagtgtgggaaaaaattccaccacagatcagccttcaatagccatcagagaattcatagaagaggaaatatgaacgtacttgatgtggaaaatctctgaagtcagatctcaatttttagaaaactctctgaatataatgaatatggggaatccaataggaagtcaaagcgtttatctgagagttcgtgttcctgaacggtgagaagcatttaggcattagagtcattttaatccaaattttcacagagaagaatcccgaagaatgtaacaagaagcaaagccttcagcaagatcatacgactcatcggacactaatttatataggagtgaagttttataaatatttaatatttattttggattcaaattgtatttacatatcagggaatcatacaaaggcaaaatctgtcaatatggtgaatgtggaaaatatattgtcttggaaatttgttgtaaaagccatatttctaatggaaaatcaggtgtttacaggaaagatctcagaggctatgagctctgaataaatcttcattgtataaaatgaagtttttaaattgtcaggagttgatcatgaggacagtagcattaaataagtatatggccgttttttatcatgtcttaaaaatgcaatctaatggtaattctatgcaagtttggaattggatgacttgtgaagaggcagttttcttatttgagtattaggatggcaaaatgtattaagacaggacatattgttggtgagataatatttaataggtataaaatggtaaaatacctagttttctatttagaggaatttacaaatgggtttttaacaaatgcctcattagtacaggaggcagtcgttttgtaaagttttcaactgcatctgagtaagataagattttctaaaagactattttgataaactatacatacataatttggaattgtttaagtctatttcagtgaaagagaacaagcatactgcccatactctaaaatatccccagctctcacaccacccttgttttttaacccataggtttgagtgtgcctagtgccaatattttgtaatttagaaattttattcacaaacttctgtttggtacaaatacagtgtcattgttttgtgcattctcctttttcccagtatttcagaacaaattgattcaagtttctagcagatattttttgatcaattaacttaatgtcctcgctccatttcttgctggaacagtttaggtacctaccacttcttcacatgacacaggggaatcctgattagtcaaaataataatgatttcattctctttgccagtaacttgttttatagtggtcatatgacctgatactgggtaaacaaaacaaagatggacttgttctgggaaaaggtaaaatggtaatcaaatagattgtgttccaggaatgcaaaggtggcttaatattcacaagtcagttgctattatacaccacctgtagaaaagtaatctggcatgcagaacattcttgtggtacaattaatgttcgtttatgatcttagcaaatgatggattgaaagggacttacttaactgcataaagagacttaaactacaacaaacaatatgcttaatgatgaaatagtgaacatttctcctaagattataaaaataagacaaggatatctgctgtcaatgattttattcggcattgttcagaaggacctaaccagaaaactaatgcaaggaagagaaacaaaaggcatagagattagaaaagaagtaaaactttaaaaacgaaaaagaatataaatctctatttgcagatgccatgagtaaatttggtaagttccctgcataaaagttatgcaaaaagcattttatgatataccagcaaaaaacatggaaaatgaaattttgaaaagcaatgccacttcaaagatccctcaagtgcctagagggagaaaatgagttaatatgctttgaagaactgtatccagaaaataaaattacaaaggaggagagggataggattccaggacaatctcaaaactattgctttttcctaaattcattgcaaccttaaaatcctagcaagttctttaatgtaaattaacaagctaattctagaattcatatgcatattcaaaagtcgaataattgtcaaggctatcctgtagaatggacagagaggattgaaatttctaaatatcaagacctgttataaagccatagaaataatgaaggtgttaatttggcacaaggatgaaaaaactgactagtggaacagcatacagattcaaaagtagacccacgtgtataccatcacctgagttttgagaaaggtgacattgaagtgtagtgggggaaagggtgttctttccagtaaatgtactttgccaataaaattttgtaatttgataaaaagttatttggaggtggattgcagatctgaatatgaaatgtgaaagctttacaaagaaatcttaggacagtttgtaatcttggagtaagcaaaggtttattgagacccaaaaagcattaacccataaaattagaacttaatattaaatttgagaacttctatttatcagaaagaccaccagtaagaaaatgaacaggaaatcatggggaggagaagatatttgcagttcatgtatgtgacaacagcaccgagtatagcagaagtgttggcaaactttataaagcaaggcaccagatggtgaaaattttcagctttgtcacaactgctcatctttgctattgtgtgaaagcatccatacaccatgcattaaaaaaaaaatgagcatggctgcttcccagtaaaaccattcacaatcccaggtggcagtctggatttggtctgcactcatagttttctggtccctgatctcgaatatgtaaagagcacctacaaatcaacaagggggaaactggaaaaggcaaaagactttagaggatatccactcactttagaggatatccagacggccaataagcatgaaaagatgtgttagctttattagtaatcagggaaatgcaaacttaaaacatgtagcactgctacccatccatggaaatggttaaaatgaaaagcatgaaaaagcatcacgttttggcaaggatgtaagcaagaggaactgtacactactggtggaattgctcatcgataaaaccattttgaaagctggcactaaaagccaagcatatgtatactgttttacccaaacccagcaaaaatgcatgtgtctgtccaccaaaggacatgcactagaatatttatagcctaaaactgcacaaaacagaactatcttaaggcacatgtgcaatggaatgaataaagaagtggcatatgtccatggaatactgtaaaacagtgagcatgaatgaactagaagtccgtgtaataacgcagctgaatttaacaaaccttgctgaatgaaagactccagacacaaaagccaacatgctgtatgattccttctatataaattataaagacgggcaaaacttgtatacgtggtttaaaattagggtagcagttagccttggccaaggctgaaagggggcatttatctggtgctgggaataatctgtttctaaacctaggtgctaagtatttgagtgtgttttgagctgtgcacttaagatatgtgtatttttctgcatgtgtgttaaactttccataaaagttttctaaaatcacaaatggctaacatttgtgtcgctcatcactctaatcatatttttctagatgtgtatgaatatgctgcacaacaggaattaaatggcagattttgcataattctgtgcaggaaatacatatttatagtaattttgatggcaactactaagatttcctacgctgtccttaaagcttagcataatgtatattttaagtgaaatatttgagaaggttaaagaatcattacatactttgtcatcctatacttttgcatatataaataggtctgagctgcctcttcaataaagaagctaatgtgtaacatttcatatttccctaaac

SEQ ID NO: 828 - DNA, 3683 bp, Homo sapiens
aaggccgaaagtcttcggagcttgcgccagtctcttcgcggcgtccaccacttagacgcaagttgctgaagccggccggggagaaggtgttgttgccggagctgagaccgggcggccacagtccgcagggatgaacctcgagttgctggagtcctttgggcagaactatccagaggaagctgatggaactttggattgtatcagcatggctttgacttgcacctttaacaggtggggcacactgcttgcagttggctgtaatgatggccgaattgtcatctgggatttcttgacaagaggcattgctaaaataattagtgcacacatccatccagtgtgttctttatgctggagccgagatggtcataaactcgtgagtgcttccactgataacatagtgtcacagtgggatgttctttcaggcgactgtgaccagaggtttcgattcccttcacccatcttaaaagtccaatatcatccacgagatcagaacaaggttctcgtgtgtcccatgaaatctgctcctgtcatgttgaccctttcagattccaaacatgttgttctgccggtggacgatgactccgatttgaacgttgtggcatcttttgataggcgaggggaatatatttatacgggaaacgcaaaaggcaagattttggtcctaaaaacagattctcaggatcttgttgcttccttcagagtgacaactggaacaagcaataccacagccattaagtcaattgagtttgcccggaaggggagttgctttttaattaacacggcagatcgaataatcagagtttatgatggcagagaaatcttaacatgtggaagagatggagagcctgaacctatgcagaaattgcaggatttggtgaataggaccccatggaagaaatgttgtttctctggggatggggaatacatcgtggcaggttctgcccggcagcatgccctgtacatctgggagaagagcattggcaacctggtgaagattctccatgggacgagaggagaactcctcttggatgtagcttggcatcctgttcgacccatcatagcatccatttccagtggagtggtatctatctgggcacagaatcaagtagaaaactggagtgcatttgcaccagacttcaaagaattggatgaaaatgtagaatacgaagaaagggaatcagagtttgatattgaagatgaagataagagtgagcctgagcagacaggggctgatgctgcagaagatgaggaagtggatgtcaccagcgtggaccctattgctgccttctgtagcagtgatgaagagctggaagattcaaaggctctattgtatttacccattgcccctgaggtagaagacccagaagaaaatccttacggccccccaccggatgcagtccaaacctccttgatggatgaaggggctagttcagagaagaagaggcagtcctcagcagatgggtcccagccacctaagaagaaacccaaaacaaccaatatagaacttcaaggagtaccaaatgatgaagtccatccactactgggtgtgaagggggatggcaaatccaagaagaagcaagcaggccggcctaaaggatcaaaaggtaaagagaaagattctccatttaaaccgaaactctacaaaggggacagaggtttacctctggaaggatcagcgaagggtaaagtgcaggcggaactcagccagcccttgacagcaggaggagcaatctcagaactgttatgaagaccttcgaagttcttcattctttctcactttgccatcatgtggcctctggacactgtggtcagtcatttgaaaattgactttaatttaaaacaaaggcctgtgcctcccacccaggaggtgggagggtgaattttatgtttaaatgaagaagtgaattatggaagaagagtatacgaccttcccttccctttcaagcataagtccaaatagactctcaggaatgaagatttgtgaagacatcagataggaattttgactcatttaaactttgatgcttagttatgttgctggagaaaagatacttatgttttgctcatctaacttcattgtacccagcgtcattttgacatgtcatttcctatctcccatttgccttcggtcctcaatgcatgtctttgagtgacttcttatctgaaattttgctactggtatcctaggaaagcttttgttggatactctcattttaaacttctcctctccccagatacctcctatatttccatattgtgtgcaaaggatgggcagaaaagaaagtgcttgaaagatttcaaattttcagaaagggaacaacgaaggccctctcttcctctcataccacgttttgctcaagaagctgggctgtaacaattcagggttttcccttgttttcctctcattgcatgtttccctccaatattggttcattgtcatcaatcatggtttttgaagatagctagttttatccatctccagcaaagaatcatcaatagtttatattgctttacctgtgctggcttccagagatggaaacaaacccaggtgtctctcaacaagctacttttttactggggtgggggaatctatgcaaggagtaaagtaaaaccatccagaatcaaagcagcaaccacatagttcaaatcaaagatcaaggtgaattttttgtatcactgcctgtggaaatctatcctcatcagtcattgcatttttccctgcctatacctgtgctcctttttcttactgtgttttcagtcacttcctttctgtgaaaggttgcttagctttttttttgacatttgttgttctttataaaaataacagattggatagatgtgtacatttggtgtttgaaattctctgaaaatcccattaggaaaccaggtgtgaaaagggctcagtagcttctctgagtggcgtttttagctgactggaagtgcttaatctggatcgtcttttttttttttttttttttttcaatattttaaaaggagaatttaaatactgtgcttactgtgaaatatatcagttggtgagccgggcgtggtgggtcacgcctgtaatcccagcactttgggaggccaaggcgggttgatcacccgaggtcaggagttcaagaccagcctggccaacgtggtgaaagcctgtatctattaaaagacaaaaattagctgggcgtggtagtacatgcctgtaatcccagctacactggaggctgagtcaggagaatcacttgaacgtgggaggcagaggttgcagtgagtggagatcgcaccactgccctccagcctaggtgacagaatgagactctatctcaaaaaaaaaaaaaaaatgatatcagttggtggatgctcctataggtagccaaacacattgattacctgttagattttaggatagaaatcaaagtagagcacgtcagcaagagcctctttgtctcactccatcatttaaaaccagtatattcagtagttgaagaaagagctctccctgagtcagttgcaaaacgtctatatttttagatgccactacttttttcttaaatattcattttgagactgtcatgagttagaccagtggttgagattagtagatggctcactagacatgtttttgttttgcagacattatatccattccagtcctctgcactgtacactgcagcagtgtgcaaactatg

SEQ ID NO: 829 - DNA, 3871 bp, Homo sapiens
cgcaggctccctgcgggagcaggctgggctcagctccgctggacccgcgctggggaactctggcctcgctgcactcatggcttctcctagcaaggcagtgattgttcccgggaacggaggcggggatgtgaccacccacggctggtatggctgggtgaaaaaggagctggagaagatacctggtttccagtgtttggctaaaaacatgcccgacccaattacagcacgagagagcatctggctgcccttcatggagacagagctgcactgtgatgagaagactatcatcattggccacagttctggggccatcgcggccatgaggtatgcagaaacacatcgagtatatgctattgtattagtgtctgcgtacacatcagacttgggggatgaaaatgagcgtgcaagtggatacttcacccgcccctggcagtgggagaagatcaaggccaactgcccttacattgtgcagtttggctctactgacgacccgttccttccctggaaggaacaacaagaagtggccgataggttggaaaccaaattgcacaaattcactgactgtggccactttcagaacacagagtttcatgaactgattactgttgtaaagtctttgctgaaagtaccagcatagactgtatgatttctgctattttgcatcccaatataggagtagaataatatctactatcagctgattactagacacatagaacatccagttaagttccgtaagtgcctgaaaaacaaacacaagtttcaacattcaatctaagttacaaatagcacttccattttccatagactctaaaactccccaaattgctatgaactaccacagtattttcctcatttgataagaaacataaggacagcttaactacccttctctatccgaagtgagtcagaaacagaacccaggtttcttgattcccactcctgagtaaaattaaataggttttatgtatgttgcaggtattgcacacttttcctctttgaaatcaaacttttctatttcactggggaaagaaaacatgactgaaagtccagagtgttagcttagagctcaaaatactagctgctgtttcaagctggccccagacattaaactcagactagggccttcacctctgacacttgcccctaagtccttcagacatgttgagagagactgagacaggagtcttccggagtcaggcaggaaggagaagcacagcaatatacattcataatatacgtacaactgactagatttgtttgagacaagagtggtgggatcagagccatgtggagagctcatggcctgtctaaattgttgccatgtggaaatggggcagagtgttgccaattttctgattttttgtgtggaaaaaaatctccaaattgtagtttttaaatttggggaatgcaaatatatatatatatacacacacacacacacacatacacatacaatccatatacatatggagtatgtaagttggcaataacagtatacatcaaaaaatttacaaacactgcaagacaaataaaatccaagccatccatttgtgaccacagtcataagcattcacttagccaggggcttttagataattgtctgtgaagtctgagaaaagactaagataaccaagatgaacataatgtcaaaggacgaaatcatggggacaatttggattttgttccaaaagacaagtgtttttaaaaagaacctttccatacttcgtgttctgttctatagagttaaaccttttaacttccatggccctttagatctctttcaagcacattccattttcttctgatcatacttcctcagaaaacctttttttggctgggtgtggtggctcatgcctgtaatcccagcactgtgggaggctgaggtggttgtattgcttgaggccaggtgtttgaggccagccagggcaacacagcaagaccccatctctacaaaatattaaaacattagctaggcatggtggtgcacacctgtagtcctagcttcttgggaggctgaggcaggattgcttgagcccaggagtttgagccttcagtgagctatgatcgcgccactgtactccatcctgggtgatggagcgaagaacctgtctcttaaaaaaaaaaatttttttttaattaaaaaaacccaccctttttcatttcccaacattttttggctattatgatcgctatgtgttccttcaaataatttccagtgaatccacacttgatgttgcaaagcctaagtttgctgcagaaatacaatttcctacacttcatacctaaaggagattcagagctatcgctcaaaaccaaaagtcttggtttttaaatgtgcttagacaaaaaaaatcaggaaaggtaccctaatcgttcaacagcaatcatctttggggaatgggcattttggtaggtaaagtgtggtggacgtccttattattatttttgagacagtgtcttgctctgtctcccaggctggaggtcagtggcacaaatctcagctcactctaacctgcacctcccgggttcaagtgattctcatctcagcctcccaagtagtgtgaactaaaggcatgtgccaccacgcctggctaatttttgtatttttagtagagacagggtttcaccatgttggccaggctggtctcgaactcctggcctcaagtgatccacccacctcagccgcccaaagtgttgggattacaggcatgagccaccatgcccggccccttattttactttatcctcctgattatttgaatttgttacactaagcatgtattttataatcaaaaataattaagatttaaaacaatgtatttgactactaaaaagcaaattatataaatcagttgaataataatgttgttaaagaggctgtttagcactaatttgaccaaatctatagtcaaagtttgattctacttgaattttttggaaatttgctgttgtattacttattctttgccttgttctctgtgaagtcctttcctaaaaaagaaacttatacaatttagttcacaaaactttgttgacctctttctctgtagaaatgaaaactaaatatatataattgagaaataattctgatactcttcattcctataaaagtaattaagatagacctataggattgttgaactttgctgccaaatatagtaaccagtaaccacagctagctgtaaaattgaaaattcagttcagtcaaactagccatatttcaagtgctcaacagccactggtggctattggttaccttactgaccagccaatataggctatttccgtcattatagaaagctctattggacaacattggtctaggacatatattttgtattttcccctcacccaccatccaataatgagtaatagcacaaagtaaaagtgacttaatttgaaattacttctgtttggctagtttgcttagctgatcaccaccaacatcataggtctataaatcacccaactaagatcaggggtgtttcatgggaaaatctacacaaactattcattaaaaaccatagagccatggactgtcatttctgatttctgtttgattctttgtggtcatcattgaatatacaggggcctctatacactctggggagtatctattctcaggtgagcaaaataccgaatactgaatggaaatcaactgtaagtattaggacttcatatgcaacttgaatttttggtgctgtccggagtctagagccccacaatctgttttggttacagtttatccctgtaggataaatgatccatttaactattcatcagaggtgctgtaattttaaattgtctcttgtctccttcagttaattttcagaattaaaaacataccatgggaaaaaaaaaaaaaaaa

SEQ ID NO: 830 - DNA, 4270 bp, Homo sapiens
gcaggtggttgtgggtagcgcgcctgggagggagaaagaagtcgggggccgtggcgcgcagcccgcggggcctgaagggatgttcgaggacaagccccacgctgagggggcggcggtggtcgccgcagccggggaggcgctacaggccctgtgccaggagctgaacctggacgaggggagcgcggccgaagccctggacgactttactgccatccgaggcaactacagcctagagggagaagttacacactggttggcatgttcattatatgttgcatgccgcaaaagcattattcccacggttggaaagggtatcatggaaggcaactgtgtttcacttaccagaatactacgttcagctaaattaagtttaatacaattttttagtaaaatgaagaaatggatggacatgtcaaatctaccacaagaatttcgtgaacgtatagaaaggctagagagaaattttgaggtgtctactgtaatattcaaaaaatatgagccaatttttttagatatatttcaaaatccatatgaagaaccaccaaagttaccacgaagccggaagcagaggaggattccttgcagtgttaaggatctgtttaatttctgttggacactttttgtttatactaagggtaattttcggatgattggggatgacttagtaaactcttatcatttacttctatgctgcttggatctgatttttgccaatgcgattatgtgcccaaatagacaagacttgctaaatccatcatttaaaggtttaccatctgattttcatactgctgactttacggcttctgaagagccaccctgcatcattgctgtactgtgtgaactgcatgatggacttctcgtagaagcaaaaggaataaaggagcactactttaagccatatatttcaaaactctttgacaggaagatattaaaaggagaatgcctcctggacctttcaagttttactgataatagcaaagcagtgaataaggagtatgaagagtatgttctaactgttggtgattttgatgagaggatctttttgggagcagacgcagaagaggaaattggaacacctcgaaagttcactcgtgacaccccattagggaaactgacagcacaggctaatgtggagtataaccttcaacagcactttgaaaaaaaaaggtcatttgcaccttctaccccactgaccggacggagatatttacgagaaaaagaagcagtcattactcctgttgcatcagccacccaaagtgtgagccggttacagagtattgtggctggtctgaaaaatgcaccaagtgaccaacttataaatatttttgaatcttgtgtgcgtaatcctgtggaaaacattatgaaaatactaaaaggaataggagagactttctgtcaacactatactcaatcaacagatgaacagccaggatctcacatagactttgctgtaaacagactaaagctggcagaaattttgtattataaaatactagagactgtaatggttcaggaaacacgaagacttcatggaatggacatgtcagttcttttagagcaagatatatttcatcgttccttgatggcttgttgtttggaaattgtgctctttgcctatagctcacctcgtacttttccttggattattgaagttctcaacttgcaaccattttacttttataaggttattgaggtggtgatccgctcagaagaggggctctcaagggacatggtgaaacacctaaacagcattgaagaacagattttggagagtttagcatggagtcacgattctgcactgtgggaggctctccaggtttctgcaaacaaagttcctacctgtgaagaagttatattcccaaataactttgaaacaggaaatggaggaaatgtgcagggacatcttcccctgatgccaatgtctcctctaatgcacccaagagtcaaggaagttcgaactgacagtgggagtcttcgaagagatatgcaaccattgtctccaatttctgtccatgaacgctacagttctcctaccgcagggagtgctaagagaagactctttggagaggaccccccaaaggaaatgcttatggacaagatcataacagaaggaacaaaattgaaaatcgctccttcttcaagcattactgctgaaaatgtatcaattttacctggtcaaactcttctaacaatggccacagccccagtaacaggaacaacaggacataaagttacaattccattacatggtgtcgcaaatgatgctggagagatcacactgatacctctttccatgaatacaaatcaggagtccaaagtcaagagtcctgtatcacttactgctcattcattaattggtgcttctccaaaacagaccaatctgactaaagcacaagaggtacattcaactggaataaacaggccaaagagaactgggtccttagcactattttacagaaaggtctatcatttggcaagtgtacgcttacgtgatctatgtctaaaactggatgtttcaaatgagttacgaaggaagatatggacgtgttttgaattcactttagttcactgtcctgatctaatgaaagacaggcatttggatcagctcctcctttgtgccttttatatcatggcaaaggtaacaaaagaagaaagaacttttcaagaaattatgaaaagttataggaatcagccccaagctaatagtcacgtatatagaagtgttctgctgaaaagtattccaagagaagttgtggcatataataaaaatataaatgatgactttgaaatgatagattgtgacttagaagatgctacaaaaacacctgactgttccagtggaccagtgaaagaggaaagaggtgatcttataaaattttacaatacaatatatgtaggaagagtgaagtcatttgcactgaaatacgacttggcgaatcaggaccatatgatggatgctccaccactctctccttttccacatattaaacaacagccaggctcaccacgccgcatttcccagcagcactccatttatatttccccgcacaagaatgggtcaggccttacaccaagaagcgctctgctgtacaagttcaatggcagcccttctaagagtttgaaagatatcaacaacatgataaggcaaggtgagcagagaaccaagaagcgagtaatagccatcgatagtgatgcagaatcccctgccaaacgcgtctgtcaagaaaatgatgacgttttactgaaacgactacaggatgttgtcagtgaaagagcaaatcattaatgttgttcttgtttctatgataaaagcactttcagattgttctgcagaaagttggagctctgtccttcaaaccttttagccctatagatgataaatatcactgggttataagaaaaaattgcacaaaaattatgtgctttttaaaatatttatccaaaatgtagttgacagagatgtattttgagttggattggaaaggaatattttaagtgccttttaaaaatactaatagtccggccaggcgctgtggctcacgcctgtaatcccaggactttgggaggccaaggcgggcagatcaccggaggtcaggagttcgagaccagcctgaccaacatggagaaaccccatctctactaaaaatacaaaattagccgggtgtggtggcgcatgcctgtaatcccagctacttgggaggctgaggcagaattgcttgaacccaggaagcggaggttgtggtgagccaaggttgcgccactgcactccagcctgggcaacaagagtaaaactccatctcaaaaaatatatatatatatataaatagggaattttttttaatgtttgctccttgagttttcaagatgaaataaggagaaaccccataactttttagctctcttttaaaaataaatgtctccttctgtgttctgtaatatgaggataaataatctacttttgatagcatgctttgagatatttgtattcttaatttaatattgaaggaaggggttggttcccatagtacctggccagagggttatataccatcctgtctctggcccactgtggtaattccacatccaggtaccaccgccattcagagttgtctcaccccttctcgtgccttttctctccttgagctttataaacagatttgtacctgagccccagtgctacactcatccttgctttccagccctaagccatctcagcctgatgtcacaacccaataaatggggcactttcttcttttgtaaactattatca

SEQ ID NO: 831 - DNA, 4903 bp, Homo sapiens
gtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggagggaaatgatcttcattggttagcatgtgccttatatgtggcttgcagaaaatctgttccaactgtaagcaaagggacagtggaaggaaactatgtatctttaactagaatcctgaaatgttcagagcagagcttaatcgaattttttaataagatgaagaagtgggaagacatggcaaatctacccccacatttcagagaacgtactgagagattagaaagaaacttcactgtttctgctgtaatttttaagaaatatgaacccatttttcaggacatctttaaataccctcaagaggagcaacctcgtcagcagcgaggaaggaaacagcggcgacagccctgtactgtgtctgaaattttccatttttgttgggtgctttttatatatgcaaaaggtaatttccccatgattagtgatgatttggtcaattcttatcacctgctgctgtgtgctttggacttagtttatggaaatgcacttcagtgttctaatcgtaaagaacttgtgaaccctaattttaaaggcttatctgaagattttcatgctaaagattctaaaccttcctctgaccccccttgtatcattgagaaactgtgttccttacatgatggcctagttttggaagcaaaggggataaaggaacatttctggaaaccctatattaggaaactttatgaaaaaaagctccttaagggaaaagaagaaaatctcactgggtttctagaacctgggaactttggagagagttttaaagccatcaataaggcctatgaggagtatgttttatctgttgggaatttagatgagcggatatttcttggagaggatgctgaggaggaaattgggactctctcaaggtgtctgaacgctggttcaggaacagagactgctgaaagggtgcagatgaaaaacatcttacagcagcattttgacaagtccaaagcacttagaatctccacaccactaactggtgttaggtacattaaggagaatagcccttgtgtgactccagtttctacagctacgcatagcttgagtcgtcttcacaccatgctgacaggcctcaggaatgcaccaagtgagaaactggaacagattctcaggacatgttccagagatccaacccaggctattgctaacagactgaaagaaatgtttgaaatatattctcagcatttccagccagacgaggatttcagtaattgtgctaaagaaattgccagcaaacattttcgttttgcggagatgctttactataaagtattagaatctgttattgagcaggaacaaaaaagactaggagacatggatttatctggtattctggaacaagatgcgttccacagatctctcttggcctgctgccttgaggtcgtcactttttcttataagcctcctgggaattttccatttattactgaaatatttgatgtgcctctttatcatttttataaggtgatagaagtattcattagagcagaagatggcctttgtagagaggtggtaaaacaccttaatcagattgaagaacagatcttagatcatttggcatggaaaccagagtctccactctgggaaaaaattagagacaatgaaaacagagttcctacatgtgaagaggtcatgccacctcagaacctggaaagggcagatgaaatttgcattgctggctcccctttgactcccagaagggtgactgaagttcgtgctgatactggaggacttggaaggagcataacatctccaaccacattatacgataggtacagctccccaccagccagcactaccagaaggcggctatttgttgagaatgatagcccctctgatggagggacgcctgggcgcatgcccccacagcccctagtcaatgctgtccctgtgcagaatgtatctggggagactgtttctgtcacaccagttcctggacagactttggtcaccatggcaaccgccactgtcacagccaacaatgggcaaacggtaaccattcctgtgcaaggtattgccaatgaaaatggagggataacattcttccctgtccaagtcaatgttggggggcaggcacaagctgtgacaggctccatccagcccctcagtgctcaggccctggctggaagtctgagctctcaacaggtgacaggaacaactttgcaagtccctggtcaagtggccattcaacagatttccccaggtggccaacagcagaagcaaggccagtctgtaaccagcagtagtaatagacccaggaagaccagctctttatcgcttttctttagaaaggtataccatttagcagctgtccgccttcgggatctctgtgccaaactagatatttcagatgaattgaggaaaaaaatctggacctgctttgaattctccataattcagtgtcctgaacttatgatggacagacatctggaccagttattaatgtgtgccatttatgtgatggcaaaggtcacaaaagaagataagtccttccagaacattatgcgttgttataggactcagccgcaggcccggagccaggtgtatagaagtgttttgataaaagggaaaagaaaaagaagaaattctggcagcagtgatagcagaagccatcagaattctccaacagaactaaacaaagatagaaccagtagagactccagtccagttatgaggtcaagcagcaccttgccagttccacagcccagcagtgctcctcccacacctactcgcctcacaggtgccaacagtgacatggaagaagaggagaggggagacctcattcagttctacaacaacatctacatcaaacagattaagacatttgccatgaagtactcacaggcaaatatggatgctcctccactctctccctatccatttgtaagaacaggctcccctcgccgaatacagttgtctcaaaatcatcctgtctacatttccccacataaaaatgaaacaatgctttctcctcgagaaaagattttctattacttcagcaacagtccttcaaagagactgagagaaattaatagtatgatacgcacaggagaaactcctactaaaaagagaggaattcttttggaagatggaagtgaatcacctgcaaaaagaatttgcccagaaaatcattctgccttattacgccgtctccaagatgtagctaatgaccgtggttcccactgaggttagtctcttgtattaaactcttcacaaaatctgtttagcagcagcctttaatgcatctagattatggagcttttttccttaatccagctgatgagttacagcctgttagtaacatgaggggacattttggtgagaaatgggacttaactccttccagtgtccttagaacattttaattcatcccaactgtctttttttccctaccattcagtgattactgtcaaggctgcttagaatccaaacttggatttttgactctggcaaagcttttagaaatactgcaagaaaatgatgtgtacccaaacgtgagcataggaggcttctgttgacgtactccaacagaagaactgtgtttcaagttcaatcctacctgttttgtggtcagctgtagtcctcataaaaagcaaaacaaaaattaggtattttgtcctaaaacacctggtaggagtgtgtgattttttgcattcctgacaaaggagagcacacccaggtttggaggtcctaggtcattagccctcgtctcccgttccctttgtgcacatcttccctctccccattcggtgtggtgcagtgtgaaaagtccttgattgttcgggtgtgcaatgtctgagtgaacctgtataagtggaggcactttagggctgtaaaatgcatgattttgtaacccagattttgctgtatatttgtgatagcactttctacaatgtgaactttattaaatacaaaacttccaggctaaacatccaatattttctttaatgcttttatatttttttaaaatgttaaaacccctatagccaccttttgggaatgttttaaattctccagttttttgttatatagggatcaaccagctaagaaaagattttaatcaagttgaattgaggggattaatatgaaaacttatgacctcttcctttaggagggagttatctaaaagaaatgtctattaaggtgatatatttaaaaatatttttgggtgttcctggcagtttaaaaaaattggttggagaatttaggtttttattagtaccatagtaccatttatacaaattagaaaatgttatttaacagctgaattatctatacatatctttattaatcactattgttccagcagttttcaagtcaaattaataatcttattagggagaaaattcaattgtaaattgaatcagtataaacaaagttactaggtaacttcatattgctgagagaaatatggaacttacattgttcaattagaatagtgttctgcaaaaatatttataaaacttctcaagatactgctactgtaattttatatgaagataagtgtatttttcaataaagcatttataaattaaaaaaaaaaaaaaaaaa

SEQ ID NO: 832 - DNA, 1655 bp, Homo sapiens; identical to SEQ ID NO: 499

SEQ ID NO: 833 - DNA, 2630 bp, Homo sapiens
ggttccagcgacagcagcactggactcgtccagagggcggcgggtgagcggctggggccccgtggagccaccatggaccccgcaggggcagcagacccctcagtgcctcccaatcctttgactcacctgagcctgcaggacagatcagagatgcagctgcagagcgaagccgacaggcggagcctcccgggcacttggaccaggtcatccccagagcacaccaccattctgaggggaggcgtgcgcaggtgcctgcagcaacagtgtgaacagactgtgcggatcctgcatgccaaggtggcccagaaatcatacggaaatgagaagcggttcttctgccccccgccctgtgtctacctctcggggcctggctggagggtgaagccagggcaggatcaagctcaccaggcgggggaaacggggcccacggtctgcggttacatgggactggacagcgcgtccggcagcgccactgagacgcagaagctgaatttcgagcagcagccggactccagggaattcggctgcgccaagaccctgtacatctcagatgcagacaagaggaagcactttcggctggtgctgcggctggtgctgcgcgggggccgggagctgggtaccttccacagccgccttatcaaggtcatctcgaagccctcgcagaagaagcagtcgctgaaaaacaccgatctgtgcatatcctccggctcaaaggtctccctcttcaaccgcctgcgctctcagacggtctccacacgctacctctctgtggaggatggggcctttgtggccagtgcacgacagtgggctgccttcacgctccacctggctgatgggcactctgcccaaggagacttcccaccgcgagagggctacgttcgctatggctccctggtgcagctcgtctgcacggtcaccggcatcacactacctcccatgatcatccgtaaagtagcaaaacagtgtgcgctccttgatgtggatgagcccatctcccagctgcacaagtgtgcattccagtttccaggcagtcccccaggagggggtggcacctacttatgccttgccacagagaaggtggtgcaatttcaggcctctccctgccccaaggaggcgaacagggctctgcttaacgacagctcttgctggaccatcatcggcaccgagtcggtggaattttccttcagcaccagcctggcgtgtaccctggagccggtcactccggtgcctctcatcagcaccctagagctgagcggcgggggcgacgtggccacgctggagctccacggagagaacttccacgcggggctcaaggtgtggtttggggacgtggaggcagaaaccatgtacaggagcccgcggtccctggtgtgcgtggtgccggacgtggcggccttctgcagcgactggcgctggctgcgcgctcccatcacaatccccatgagcctggtgcgcgccgacgggctcttctaccctagtgccttctccttcacctacaccccggaatacagcgtgcggccgggtcaccccggcgtccccgagcccgccaccgacgccgacgcgctcctggagagcatccatcaggagttcacgcgcaccaacttccacctcttcatccagacttaggcgcgcccggtagccccggctgcccaccctggagggctgcgcccgcgccaggcgcggggacgtgtttctgggttctaggccctgcttccttgcccctttgctgcagaagggcagctgaaggctcaccctagaaaccgggcctggtgggtcttacccggctcactccctcccttgtccttacacatacaggaagacaagacctgagtggtgctgtctttgtgtccgtcgtgtatggctctccctgtcttcatttcttctcactctgtctctaaacctctctctctctcccttccccctcagtacttagtctacagacctatgtgcgtgtccctatccttctgtccttttctctcttcagctctccctgcctctcacacacaattttacatgccccgaggagccaagtttgggacatttaccctccaggcatctgtgtcccctcttgaagagaaaacacacagcttcacacatccaggcatagggggcaagctcttggggcatcaggaccctggagcaccaggtccttcctggaatattagatccacctggagcaccgggtctctctaagtctcacctggggaattcggtcccacctggggcaccagttcccacctagagcactgtgtcctgccctagagcacaaagacctgctcctcccgagactctctctgactgcagccaggcatagtacctttgcctgtgtttgctccctggtccacagatttggtggctgggcaggtgcctggacagtgatgaggtcttgccgccttaactgtcccccccagtcacttctcccacaggcccagcaggacgcagtcctgaggatcagggattctacagctgcattaaaatcaatcctatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 834 - DNA, 5537 bp, Homo sapiens
atggtggagaagggccccgaggtctcagggaagcggagagggaggaacaacgcggccgcctccgcctccgccgccgccgcctccgccgccgcctcggccgcctgcgcctcgccagccgccactgccgcctcgggcgccgccgcctcctcagcctcggccgccgccgcctcagccgccgccgcccccaataatggccagaataaaagtttggcggcggcggcgcccaatggcaacagcagcagcaactcctgggaggaaggcagctcgggctcgtccagcgacgaggagcacggtggcggtggcatgagggtcggaccccagtaccaggcggtggtgcccgacttcgaccccgccaaactggcaagacgcagtcaagaacgggacaatcttggcatgttggtctggtcacccaatcaaaatctgtcagaagcaaagttggatgaatacattgccattgccaaagaaaagcatgggtacaacatggaacaggctcttgggatgctcttctggcataaacataatatcgaaaagtcattggctgatttgcccaactttacccctttcccagatgagtggactgtggaagataaagtcttatttgagcaagcctttagttttcatgggaaaacttttcatagaatccaacaaatgcttccagataaatctatagcaagtctggtgaaattttactattcttggaagaagacgaggactaaaactagtgtgatggatcgccatgcccggaaacaaaaacgggagcgggaggagagcgaggatgaactggaagaggcaaatggaaacaatcccattgacattgaggttgatcaaaacaaggaaagcaaaaaggaggttccccctactgagacagttcctcaggtcaaaaaagaaaaacatagcacacaagctaaaaatagagcaaaaaggaaacctccaaaaggaatgtttctttctcaagaagatgtggaggctgtttctgccaatgccactgctgctaccacggtgctgagacaactagacatggaattggtttcagtcaaacgacagatccagaatattaaacagacaaacagtgctctcaaagaaaaacttgatggtggaatagaaccatatcgacttccagaggtcattcagaaatgtaatgcacgttggactacagaagagcagcttctcgccgtacaagccatcaggaaatatggccgagattttcaggcaatctcagacgtgattgggaacaaatcagtggtacaagtgaaaaacttttttgtaaattatcgacgccgcttcaacatagatgaagttttacaagaatgggaggcagaacatggtaaagaagagaccaatgggcccagtaaccagaagcctgtgaagtccccagataattccattaagatgcccgaagaggaagacgaggctcctgttctggatgtcagatatgcatctgcctcctgagaaactggtggctttgaacacttggtgtggactactgtgttatccgggatatcaggtattatgagacatcacctagccatctgcatcacatctctctggacaagcagctattaccaaaaaaggcatatacttccagtcctgtgctccatctgccttaattctttgctcgttcctccatgttggcgccacttcccagagagctccactgcatctcacactctgcccacgtgctggggaagtctcacggcctgcacatctcttgtgactctgggaaccgcctctcccgccggagcccccgagccccaccaatggcagctcttcccagtcagcagcttcagagcaggcagtctccttggaaggcccgactctgttcctgcatggcctgcagtttctactttgtgcatagagtcattttcagagtcaccgcgaccctgttggccttctagaaagtttcttttgttcttttctgagacaaccacctaagtgataatacgcttttttggaaactaatatatattgccagactgcatcataacctttatcatgccaagcatcctgatgcaactcacatttccctaaacatggggtacagttatgatttataaattgagttggcttaaatctccctcttctcccttcccaagtgttacaaagatcatttactgcaactgtcgttggacactgtagcttaaagggaacgtggacctcaatgctttctgccttcaacttttcagcattgtgaccccagggtggttgccaccccatcttttcctgaccccccccacccccccacctccaagaggttcggcccacatcactgtacctggtgcttgtaaatttggaattggtgccttctccttttggcaaccatggttatcaatcctttttctgttttagtgtcttatttcttctttcaagttatttgctagccaaagatgacatcactgagattaggagacaggggagagcttgctgcagattctgacagtgcagattttaaatgtcaggatattagaatagctggcgctggtttatgaaagctgcgcgttgttccgcgttctctcggtgtgcctggccttttatgtggcactctgtatgtcagtttgtgtccttcatgtgctgatgtgattacacaaacaccatgcactctcttttcatatcagagtacaggacagagaagtgatcaatgtattggtctagtgagactgagatgaaaagaaataacctacagagtggtctgtaatgccttttggttggactgggaacaagtaaaaatttctaataaacattttgagacttccagaatcacttttgttatcttatcagaccatgggcctgctgagggttgagcagacagcctgcattctaacataccctgttcccaccccacggccattcagactgcactcaatacgctgaagtcgcttttgttgttgttgttgttgtttgcatcatttggatttttttcctgctttcaataccaaaaaaatgcagatgctttaaggcctaaacagaattctgaagaatttaaaatatgcaattaaagtttgatatgttttgtctcccaagcaccttgttttttgttgttgttgttgttgttgaagtcagctgattttctctttagaaagagggtcagctagaaacctaggttttttggaattgtaaatttttttttagtatagtctggagagaaaggtcattcaaaaggaaagtacaatgggacttgctgcccttcatcatctcgttcccgtgccaggtgtgtgttggtcacgtaaaagcctgggaagcatcagaggagtcccggattgctgctgctacctggagacagggttagcaaaataacactagtgatgagggagaggcttcttttcaccataagcctgctgtgtacaccgagggcggcaggagaagcatgggaaggagtcagcctaagtttgcacattgcataaagggtacactaaggtatgagctgaagctttaggttctccgtgcttccctcaagacctccttcttgctaacagaagcagtaggcaattgctgcagtgcgtttctcaccctgccaataggtctgtctgtatctctgttaaggaaaatagcctggtccctcctggcagtgcttggaagcttgatgctaatttttatatagcgtggcaaactgaccagcagtgccaggccttgatctgtattctgcactatccctttacttggttcctggcactgaatggtctccagccctgaagaatcacgtgtgatcacagcagctgacctgggctttctccccgagaggaaggggcatgtcatttttatttgacagagggaaaatgggagctgtccttgactgcctttgttgtgctttcccgcgtaagatagcactgtgttttaaactgttgcattacactgtctttgcaatgatgtaaatgtaagaaatcacttagctttaaaagcgcagtggtttgatcttatttatatgaagactttttaacatatcaagaattaggtgcattggcaggtagggtttggggtgtgataactgcttcagatggaatgttcacttaagctttgtcttcttaaaaattatcaatgtgaatgtcataattatatatatttttgtggaaaattttctcctaagtataagttattgtgcaaaatatagtgtcattgatgcaaataatagtttaacttttagtttagaactcctaaaagatataaattgtattgcatatgcattaaaagtttgttttatttaattttatgtagatgtgtgaagtgttaggtaaaatttttttcacttatccatttaaacaccttgttacttgaatattgtgttgactggtctgcaacagtgatccattctgtaatatagctcttttaactgggaaggaaccacaccccagttgtgccgattacattagtgttggcacacagtcgggtgctagtgtaacacaaatgccgcgttgtctgggtgtacagtgtttgtggagacgccacttcctcaaaatggtttttgattgtttttaacctataagacgttctgatgctcacaaacctctattcaacacacaaaacaaacatgaaaaggtagttagttgggttgtaacagcttactggggtggactcataaaacagtggctttctgttcatctaaagtttcctcagataccacagaccactgttaagtgtgctcattgtcactttaaatttcaacgataccctatttttgtcattctaaatatcagatgtactattggtataattgcacaccaaaaataagccaaacagtgcattacgctaactggatccctgcttttatgtgagctaaggaaagatggagccaactccaacgagggcctctttttctctcttgtctagcctgtttctaaaccgaatgatccaggattcaagcttctattgtcaagtgaaactttcctcagatggactccaggtagccaggtcacctaaacctagtggtcctgtgcgatgctctttctgccagtccctgaatctctgcagcttctcttacctgtcttacctgtagtaaagcacaattgcagtggcgtcgcattcagaagaagggaaggtcagcagaggctatgcatgttgtgtgatgatgagtgtttacagccaccttctcctaaaacgaaatttataccggggtggatagtattccattaggtagacttatcgactttgctaagtgctttttagacagcttaaaaaattttcaagattttaaaagatgtataaggttaagtttgcaaatataatggaaatgctgtatatcttttgaagtgatgaaatccacgttggaattttaaagaaaatatgttgtaataatgctgttgtaagtaatattttaatgtctctttgcctgttttctatttcagcacattcattgtggtgaatgttcatagcattataactgcttagccattgaatgataacatttgttagtggaaattggaaaatttatttgtgaaattctgcagaattcatttttctatttccaatatttgctgaggttaaataaaaattttcaagccattgatgtaataaaatatgaaatgaaagcaaaaaaaaaaaaaaaaaaa

SEQ ID NO: 835 - DNA, 1217 bp, Homo sapiens
gccctccacaaagctcctgggcccctcctcccttcaaggattgcgaagaactggtcgcaaatcctcctaagccaccagcatctcggtcttcagctcacaccagccttgagcccagcctgcggccaggggaccacgcacgtcccacccacccagcgactccccagccgctgcccactcttcctcactcatggggaacagcaaaagtggggccctgtccaaggagatcctggaggagctgcagctgaacaccaagttctcggaggaggagctgtgctcctggtaccagtccttcctgaaggactgtcccaccggccgcatcacccagcagcagttccagagcatctacgccaagttcttccccgacaccgaccccaaggcctacgcccagcatgtgttccgcagcttcgattccaacctcgacggcaccctggacttcaaggagtacgtcatcgccctgcacatgaccaccgcgggcaagaccaaccagaagctggagtgggccttctccctctacgacgtggacggtaacgggaccatcagcaagaatgaagtgctggagatcgtcatggctattttcaaaatgatcactcccgaggacgtgaagctccttccagacgatgaaaacacgccggaaaagcgagccgagaagatctggaagtactttggaaagaatgatgatgataaacttacagagaaagaattcattgaggggacactggccaataaggaaattctgcgactgatccagtttgagcctcaaaaagtgaaggaaaagatgaagaacgcctgatgccaactgttcagctgtcctccctccacctaccactcacatgacacccgtgagcgcctgtgcacacacacacacatgcacacacacgcgcgcgcacacacacacacacacatccaccccagggccaagagaaaggcctgcacacaagcccacagcacagctccctgccaaactgaagcatctgtagtgacccactggttccttcttcctgggtcttcagcattccctcccatcatgcccggtcccacccctccctctgtccaccagcccatggccctgtgctaatcccaggattaggccataggagtcctaagtgtcaccccgctgtaagctcctttgtggagtgctgggtaagcagtttccaataaacgcaagctgagctgggaaaaaaaaaaaaaaaaaaaaaaaaaaaaaaaaaaaaaaaaaa

SEQ ID NO: 836 - DNA, 2592 bp, Homo sapiens
ggtggacggcgacgctgggtgacccggggtgcaagaattcaggggttgggaaggtgtgagccgcaaacccagcggagggcgggaagaaggaggaggcctctagggtggtcgggggactgggggccccgccggcagaggtccctcggcctcctgactgactgactgcggccgcctccggccaggacgctgggagctgcctgcgggaaggtgcggggagcggagccatggcctccggtgcgtataacccgtatatagagataattgaacaacccaggcagaggggaatgcgttttagatacaaatgtgaagggcgatcagcaggcagcattccaggggagcacagcacagacaacaaccgaacatacccttctatccagattatgaactattatggaaaaggaaaagtgagaattacattagtaacaaagaatgacccatataaacctcatcctcatgatttagttggaaaagactgcagagacggctactatgaagcagaatttggacaagaacgcagacctttgtttttccaaaatttgggtattcgatgtgtgaagaaaaaagaagtaaaagaagctattattacaagaataaaggcaggaatcaatccattcaatgtccctgaaaaacagctgaatgatattgaagattgtgacctcaatgtggtgagactgtgttttcaagtttttctccctgatgaacatggtaatttgacgactgctcttcctcctgttgtctcgaacccaatttatgacaaccgtgctccaaatactgcagaattaaggatttgtcgtgtaaacaagaattgtggaagtgtcagaggaggagatgaaatatttctactttgtgacaaagttcagaaagatgacatagaagttcgttttgtgttgaacgattgggaagcaaaaggcatcttttcacaagctgatgtacaccgtcaagtagccattgttttcaaaactccaccatattgcaaagctatcacagaacccgtaacagtaaaaatgcagttgcggagaccttctgaccaggaagttagtgaatctatggattttagatatctgccagatgaaaaagatacttacggcaataaagcaaagaaacaaaagacaactctgcttttccagaaactgtgccaggatcacgtagaaacagggtttcgccatgttgaccaggatggtcttgaactcctgacatcaggtgatccacccaccttggcctcccaaagtgctgggattacagttaattttcctgagagaccaagacctggtctcctcggttcaattggagaaggaagatacttcaaaaaagaaccaaacttgttttctcatgatgcagttgtgagagaaatgcctacaggggtttcaagtcaagcagaatcctactatccctcacctgggcccatctcaagtggattgtcacatcatgcctcaatggcacctctgccttcttcaagctggtcatcagtggcccaccccaccccacgctcaggcaatacaaacccactgagtagtttttcaacaaggacacttccttctaattcgcaaggtatcccaccattcctgagaatacctgttgggaatgatttaaatgcttctaatgcttgcatttacaacaatgccgatgacatagtcggaatggaagcgtcatccatgccatcagcagatttatatggtatttctgatcccaacatgctgtctaattgttctgtgaatatgatgacaaccagcagtgacagcatgggagagactgataatccaagacttctgagcatgaatcttgaaaacccctcatgtaattcagtgttagacccaagagacttgagacagctccatcagatgtcctcttccagtatgtcagcaggcgccaattccaatactactgtttttgtttcacaatcagatgcatttgagggatctgacttcagttgtgcagataacagcatgataaatgagtcgggaccatcaaacagtactaatccaaacagtcatggttttgttcaagatagtcagtattcaggtattggcagtatgcaaaatgagcaattgagtgactcctttccatatgaattttttcaagtataacttgcaagatttaaatccttttaaatcttgataccacctatatagatgcagcattttgtatttgtctaactggggatataatactatatttatactgtatatataatactgactgagaatataatactgtatttgagaatataaaaaacttttttcagggaagaagcatacaactttggacatagcgaatacaaaattggaagctgtcataaaaagacaactcagaggccaggcgcaggggctcacacctgtaatcctagcactttgggaggccaaggcgggtggatcacttgagaccaggaattcgagaccagcctggccaacatggtgaaaccccgtctctactaaaaatacaaaaattagctgagcatggtggtacgtgcctgtactgtcagctacttgggaggctgaggcacaataattgtttgaacccaggaagcagaggttgcagtgagctgagatcacaccaccgcactccagcctgggtgacagagtgagactctgtctc

SEQ ID NO: 837 - DNA, 2411 bp, Homo sapiens
ggaacagggaagatggcggctgtggtggagaatgtagtgaagctccttggggagcagtactacaaagatgccatggagcagtgccacaattacaatgctcgcctctgtgctgagcgcagcgtgcgcctgcctttcttggactcacagaccggagtagcccagagcaattgttacatctggatggaaaagcgacaccggggtccaggattggcctccggacagctgtactcctaccctgcccggcgctggcggaaaaagcggcgagcccatccccctgaggatccacgactttccttcccatctattaagccagacacagaccagaccctgaagaaggaggggctgatctctcaggatggcagtagtttagaggctctgttgcgcactgaccccctggagaagcgaggtgccccggatccccgagttgatgatgacagcctgggcgagtttcctgtgaccaacagtcgagcgcgaaagcggatcctagaaccagatgacttcctggatgacctcgatgatgaagactatgaagaagatactcccaagcgtcggggaaaggggaaatccaagggtaagggtgtgggcagtgcccgtaagaagctggatgcttccatcctggaggaccgggataagccctatgcctgtgacatttgtggaaaacgttacaagaaccgaccaggcctcagttaccactatgcccactcccacttggctgaggaggagggcgaggacaaggaagactctcaaccacccactcctgtttcccagaggtctgaggagcagaaatccaaaaagggtcctgatggattggccttgcccaacaactactgtgacttctgcctgggggactcaaagattaacaagaagacgggacaacccgaggagctggtgtcctgttctgactgtggccgctcagggcatccatcttgcctccaatttacccccgtgatgatggcggcagtgaagacataccgctggcagtgcatcgagtgcaaatgttgcaatatctgcggcacctccgagaatgacgaccagttgctcttctgtgatgactgcgatcgtggctaccacatgtactgtctcaccccgtccatgtctgagccccctgaaggaagttggagctgccacctgtgtctggacctgttgaaagagaaagcttccatctaccagaaccagaactcctcttgatgtggccacccacctgctccccgacatatctaaggctgtttctctcctccacttcatatttcatacccatctttcccttcttcctcctctccttcacaaatccagagaaccttggggtggttgtgccagcctgcctttggcagctgcaagctgaggtggcagctctgaccacctctggccccaggccctcagggagaaaggagcaacacactgcccctaggcgtgcgtgtggcccagtttctctctgctctccattaagtgcattcactctgcttgccttgggcccagcccctggtgatcacagggttcaaacagtgtcctcctagaaagagtgggagagcagctcacttctctgtgttctgcctcccctctggtctccagagttttcctgtcctctagaggcaagccaggccagggagctgggagcgagcaagctgaggccacgtccacaaggagcttttcatgcccctgtgccgcatagcctcacctctttcctccagagtggctctctgcggccctgtgttcctgctacagagtgttcttttctggagtcaggatgttctcggtcaccctcctggttctgccctgtcccattccaccccaccccagggggaacagtagcttcaccttgttattcccattgctctcctggctcactcttacggtcggtctccagtgactgaagcattccccacccttggaatttctcatcttctgcctcccttcctactccttttggttttgtggggagaggggaaggatcagggggccaggccagcagctcgggggccacaaggagatggataatgtgcctgttttttaacacaacaaaaaagcctacctccaaaatcccctttttgttcttcctggacctgggcattcagcctcctgctcttaactgaattgggagcctctgccacctgccccgtgtatcctggctctcagctcatggggaagccacatagacatccctttcttcccttgcacgctcgctagcagctggtaaggtcttcacaccctgattcctcaagttttctgcttagtggcactgacattaagtagtggggggacagtccatgccaggacaccctggagtagccttcccccttggccgtgggcaggccctaactcactgtcgctttggagttgaggtgtcttttctttttctttctttagttcctgtattctaaacattagtaaaaataaatgtttttacacagaaa

SEQ ID NO: 838 - DNA, 8207 bp, Homo sapiens
agacgctcgcgagcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaagatctgcccgaccgaggaggagggagcctaggttcaagtcgcaggaaaggtcacggcagggaagccccctcagcccctccgcgtcgcctccccgcgggccgcccctctcggccctgcgccccgcggccccgcagcctccgcgcggcctcccgccccatccccgccactttccccggagctgggccgcgaacacctcactattgatggtgtagcgctttaggggaaggaggtgattgtctaggagtaactgtatgtgcgctcagcaccgggtcacaaccaccgtgggatccacttacagagaagatttgtggagagcttcagcctgtttatggtgttactgagaaaggaattgtggccatttgatataattctggatggaagacctcttatttgtattacattgaattagagcatttttgaaacgttggggttgttggagtggttggattttccctggaattgagtgagaaattcagaagactgaagcccaggcttactgtctacctttcacggaggcctagccgtgagaggacagaagaaggcacgtggcgaatcatgacagcggacaaagacaaagacaaagacaaagagaaggaccgggaccgagaccgggaccgagagagagagaaaagagacaaagcaagagagagtgagaattcaaggccacgccggagctgtaccttggaaggaggagccaaaaattatgctgagagtgatcacagtgaagacgaggacaatgacaacaatagtgccaccgcagaggagtccacgaagaagaataagaagaaaccaccgaaaaaaaagtctcgttatgaaaggacagataccggtgagataacatcctacatcactgaagatgatgtggtctacagaccaggagactgtgtgtatatcgagagtcggaggccaaacacaccgtatttcatctgtagcattcaagacttcaaactggtccacaactcccaggcctgttgcagatctccaactcctgctttgtgtgaccccccagcatgctctctgccggtggcatcacagccaccacagcatctttctgaagccgggagagggcctgtagggagtaagagggaccatctcctcatgaacgtcaaatggtactaccgtcaatctgaggttccagattctgtgtatcagcatttggttcaggatcgacataatgaaaatgactctggaagagaacttgtcattacagacccagttatcaagaaccgagagctcttcatttctgattacgttgacacttaccatgctgctgcccttagagggaagtgtaacatctcccatttttctgacatatttgctgctagagagtttaaagcccgagtggattcatttttctacatattaggatataaccctgagacaaggaggctgaacagtacccagggggagattcgtgtcggtcctagtcatcaggccaaacttccagatctgcaaccatttccttctccagatggtgatacagtgacccaacatgaggaactggtctggatgcctggagttaacgactgtgacctccttatgtacttgagggcagcaaggagcatggcggcatttgcaggaatgtgtgatggaggctctacagaggacggctgtgtcgcagcctctcgggatgacaccactctgaatgcactgaacacactgcatgaaagcggttacgatgctggcaaagccctgcagcgcctggtgaagaagcctgtgcccaagctcatcgagaagtgctggaccgaggacgaagtgaaacgcttcgttaagggactcaggcagtacgggaagaacttcttcagaattagaaaggagctgcttcccaataaggaaacaggggagctgatcaccttctattactattggaagaagacccccgaagcagccagctcccgagcccatcgtaggcaccgcaggcaggccgtgttcaggaggattaagactcgcaccgcgtccacacccgtcaacacaccctccagacccccgtccagtgaattcttggacctaagttcagccagtgaagatgacttcgacagtgaggacagtgagcaggagctgaaggggtacgcctgccgccactgcttcaccaccacctccaaagattggcaccacggaggccgggagaacatcctgctttgcaccgactgtcgcatccacttcaagaaatacggtgagctcccgcccattgagaagcccgtggacccgccaccgtttatgttcaaacccgtcaaggaagaggatgatgggctcagtgggaagcatagcatgaggacacggcggagtcggggctcgatgtcgacactacgcagtggtcggaagaagcagccagccagccctgatggtcgcacctcacccatcaatgaagacatccgctccagcggccggaactcccccagcgctgccagtacctccagcaatgacagtaaagcagagacagtgaagaagtcggccaagaaggtgaaggaggaagcctcttcccctcttaagagtaacaaacgccagcgggagaaggtggcctctgatacggaggaggctgacaggaccagctccaagaagacaaaaacgcaggagatcagcaggcccaactcgccatctgaaggtgagggagagagttcagacagtcgcagcgtcaacgatgagggtagcagtgaccccaaagacatcgaccaggacaatcgcagcacgtccccgagcatccccagcccccaggacaatgagagtgactcggactcgtcagcccagcagcagatgctgcaggcccagcccccagccttgcaggctcccactggggtcaccccagctccctcctcagctcctccagggacccctcagctgcccacgccagggcccacgccctctgccactgcagttcccccacagggctcccccacggcctcccaggcccctaaccagccacaggctcccacagcgcctgttccccacacccacatccaacaggcaccggccttgcacccccagcggccgccctcaccgcatcccccgccgcatccctcgccacatcccccgctgcagcctctgactgggtcggcgggccagccttctgcaccctctcatgcccagcccccactgcacggtcagggcccacccggccctcacagcctgcaggctgggcccctgctgcagcacccaggccccccacagccctttggcctccctccccaggcctcccaaggccaggcccctctggggacctccccagcagcagcgtaccctcacacctccctgcagctgccagcctctcagtcagcgctgcagtcccaacagcctccacgggagcagcccctgccaccagcgcccttggccatgccccacatcaagcccccgcctaccactcccatcccccagctgccggcgccacaggcccacaagcaccctccccacctctcggggccctcacccttctccatgaatgccaacctgcctccccctccagccctgaagcccctgagctccctgtccacacatcaccccccgtcggctcaccccccacccctgcaactcatgcctcagagccagccattgccctcctcgcccgcccagccccccgggctgacccagagccagaacctgcccccgccccctgcctcccacccccctacaggcctccaccaggtggccccccaacccccgtttgctcagcacccctttgtccctggaggccctcctcccatcacccctccgacctgcccctccacctctaccccaccggcgggacctggcacctcggcccagccaccctgctctggtgcggcggcttcaggaggcagcatagcgggggggtcgtcctgcccactccccaccgtccagatcaaggaggaggctctggacgacgctgaggagcctgagagcccccctcccccaccaaggagcccgtccccggagcccactgtggtggacacccccagtcacgccagccagtcagctaggttctacaaacacctggaccggggctacaactcgtgtgcccggacagacctgtacttcatgcctctggccgggtccaagctggccaagaagagggaggaggccattgagaaggccaagcgcgaggctgagcagaaagcccgagaggagcgagagcgggagaaggagaaggagaaggagcgggagcgggagcgagagcgggagcgcgaggcagagcgggcggctaaggcgtccagctcagcgcatgaaggtcgcctcagtgacccacagctcagtggtcctggccacatgcggccatccttcgagccaccaccaaccaccattgctgctgtgcccccctacatcgggcccgacacacctgcccttcggactctgagcgagtacgcccggccccacgtcatgtcgcccaccaaccgcaaccaccccttctacatgccccttaaccccacggaccccctgctggcctaccacatgcctggcctctacaacgtcgaccccaccatccgcgagcgggagctccgggagcgggagatccgagagcgggagatccgagagcgggagctgcgggagaggatgaagccgggcttcgaggtgaagcccccagagctggaccccctgcacccagccgccaaccccatggagcactttgcccggcacagcgccctcaccatccccccgaccgccgggccccacccttttgcttctttccacccgggcctgaaccccttggagagggagagactggccctggcgggcccccagctgcggcccgagatgagctaccctgacagactggcagccgagcgtatccacgcagagcgcatggcatcgctgaccagcgatcccctggcccgactgcagatgttcaacgtgactccgcaccatcaccagcactctcacattcactcccacctccacctccaccagcaggaccccctccaccaaggttcagcaggccccgttcacccgctggtcgaccccctgactgccggtccccacctggctcgcttcccctacccgcctggcactctccccaaccctctgcttggacagcccccacacgagcacgagatgcttcgccacccagttttcggcaccccctacccccgtgacctgcctggggccatcccaccccccatgtcagcagcccaccagctgcaggccatgcatgcccagtcggccgagctgcagagactggccatggagcagcagtggctgcatggacacccccacatgcatggtggccacctaccaagtcaggaagattattacagtcgactgaagaaagaaggtgacaagcagttataagttatttatttgttaacgctggctgtggaaaccccagttcttggggggagaaacaggactttttacataaaataggagctgcaaaagcaaaaagaatatcttctaaagatttctttatatatttaaaaacccacaactaaaaatgtatccacatagtagtgttcgtttgtcgagaggatttcctgagactggtttggatctccctgcatgacagtcccccagaaacttagtgagtcctggactggactgaacatccagaaagcttccctgcaatcttggggtttggctttagttttcttttccttgatttctcagtaggtgctagaatccagttcacacccttcactgtgcgtgcagacacactgacacactccgccacgagtgctccagagcccacgaggcttgcagatcgggggcataggaatttggaatccaagagctataatttttaaaaaaaaaaatcttttattttaatacattgtaggaaatcttcataattggagaaagttctgcagcatggctttttacgtctgtaaataaataattttagaacagcctttttttcttccataaactactattgtgatctattttttccagccatgtcactaattgtgaattcctaccaactattgacagaatacagagttgattttttaataaaaagttatatataattatccctttaattaaagggagcaaaggggcgttccacatggacagaggcttggaccgaggcctggtcacagcagcgagcatccagggtttgcagggacgatgttacagactctgttttctgcctggcgtttcacttgtgtctgctcctagcctgtgctctgccagcagcacagacatctgctccatcagacctcttccattttgcacagggagtgcaggaggtgaatgttcactttctgttctccagtgtcactgttctgtttccacgggatggaaagcgcatgggcctgtgtccattgtagatttccttctagatttctgtgtacacacacttgattgttctggatgaatgtcttttttaatactccgaaaatttcatcatctaagaaaatgattccatacaaataactcagcacacaagtgacccaggacatatgcctgccaaagggatgtgttagaaggctgccttctcatgcgcattgtcacttggatcttgtggtgaggacggccccatctttcttgccacagattgaggccacttttgagcaagggagatcctggagttaagacaggtgttgggggcagcctgtattttaccctaggggcaggtctgcatggtgaccccacattgcactggtaaaccatttgagtcccactcttcatcctggaagtgggaactggagtcccacccacagtgcattcagaaagcatgctgtgtgggggctgcttctcaggaggccaggcccttctgagcggaaccgtcctggagagagcctgccctcgtttccaggctgcagccgtaacgcactttctcccaggctgagggcgggtgttctggggtgtctgccctctgtcggccctgcttcctgccaggacgtggcctcttccgatccttttctctcagacactggaggtctcttctgccattgtgctggtcccatcccaagaattgtaggacagagaccacactgggtcggcggacacaaagtccatccaggacccaggccgcagagggagcaggaagagatgctgatagtttgatctagaaaccagcagctactggctcaaattcaggttctggcgtcaaatagcgacatttccagtttctcttaaaaaccgtgtttggtttcagttgggataggcttgttttgtctgttgaaaatgtttctagttttttttctttcatttttctctcattccatttctgccttaactttagtttgttcacagggaggcaaagctgacatgaaccttttgtcgtgggacttcaggccacattggcttgaaggcattcgtttccttctggggtggggacaggccctcatggcaggcttgttcccgtggctctgagcgaggcctcttcctgctgggctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactacaaaaaaaaaaaaaaa

SEQ ID NO: 839 - DNA, 3663 bp, Homo sapiens
ggcggcggcggcggcgcggactgggtgcgcggcgcagcgtcctgtgttggaatgtgcggctgccgcgagctcgcggcgcagcagcggagcgagcgccgccgaggcccggggccccagaccctggcggcggctgcggcagccgagacggcagggcgaggcccggaggcctgagcaccctctgcagccccactcctgggccttcttggtccacgacggccccagcacccaactttaccaccctcccccacctctcccccgaaactccagcaacaaagaaaagtagtcggagaaggagcggcgactcagggtcgcccgcccctcctcaccgaggaaggccgaatacagttatggccacccaggtaatggggcagtcttctggaggaggagggctgtttaccagcagtggcaacattggaatggccctgcctaacgacatgtatgacttgcatgacctttccaaagctgaactggccgcacctcagcttattatgctggcaaatgtggccttaactggggaagtaaatggcagctgctgtgattacctggtcggtgaagaaagacagatggcagaactgatgccggttggggataacaacttttcagatagtgaagaaggagaaggacttgaagagtctgctgatataaaaggtgaacctcatggactggaaaacatggaactgagaagtttggaactcagcgtcgtagaacctcagcctgtatttgaggcatcaggtgctccagatatttacagttcaaataaagatcttccccctgaaacacctggagcggaggacaaaggcaagagctcgaagaccaaaccctttcgctgtaagccatgccaatatgaagcagaatctgaagaacagtttgtgcatcacatcagagttcacagtgctaagaaattttttgtggaagagagtgcagagaagcaggcaaaagccagggaatctggctcttccactgcagaagagggagatttctccaagggccccattcgctgtgaccgctgcggctacaatactaatcgatatgatcactatacagcacacctgaaacaccacaccagagctggggataatgagcgagtctacaagtgtatcatttgcacatacacaacagtgagcgagtatcactggaggaaacatttaagaaaccattttccaaggaaagtatacacatgtggaaaatgcaactatttttcagacagaaaaaacaattatgttcagcatgttagaactcatacaggagaacgcccatataaatgtgaactttgtccttactcaagttctcagaagactcatctaactagacatatgcgtactcattcaggtgagaagccatttaaatgtgatcagtgcagttatgtggcctctaatcaacatgaagtaacccgccatgcaagacaggttcacaatgggcctaaacctcttaattgcccacactgtgattacaaaacagcagatagaagcaacttcaaaaaacatgtagagctacatgtgaacccacggcagttcaattgccctgtatgtgactatgcagcttccaagaagtgtaatctacagtatcacttcaaatctaagcatcctacttgtcctaataaaacaatggatgtctcaaaagtgaaactaaagaaaaccaaaaaacgagaggctgacttgcctgataatattaccaatgaaaaaacagaaatagaacaaacaaaaataaaaggggatgtggctggaaagaaaaatgaaaagtccgtcaaagcagagaaaagagatgtctcaaaagagaaaaagccttctaataatgtgtcagtgatccaggtgactaccagaactcgaaaatcagtaacagaggtgaaagagatggatgtgcatacaggaagcaattcagaaaaattcagtaaaactaagaaaagcaaaaggaagctggaagttgacagccattctttacatggtcctgtgaatgatgaggaatcttcaacaaaaaagaaaaagaaggtagaaagcaaatccaaaaataatagtcaggaagtgccaaagggtgacagcaaagtggaggagaataaaaagcaaaatacttgcatgaaaaaaagtacaaagaagaaaactctgaaaaataaatcaagtaagaaaagcagtaagcctcctcagaaggaacctgttgagaagggatctgctcagatggaccctcctcagatggggcctgctcccacagaggcggttcagaaggggcccgttcaggtggagctgccacctcccatggagcatgctcagatggagggtgcccagatacggcctgctcctgacgagcctgttcagatggaggtggttcaggaggggcctgctcagaaggagctgctgcctcccgtggagcctgctcagatggtgggtgcccaaattgtacttgctcacatggagctgcctcctcccatggagactgctcagacggaggttgcccaaatggggcctgctcccatggaacctgctcagatggaggttgcccaggtagaatctgctcccatgcaggtggtccagaaggagcctgttcagatggagctgtctcctcccatggaggtggtccagaaggagcctgttcagatagagctgtctcctcccatggaggtggtccagaaggaacctgttaagatagagctgtctcctcccatagaggtggtccagaaggagcctgttcagatggagttgtctcctcccatgggggtggttcagaaggagcctgctcagagggagccacctcctcccagagagcctccccttcacatggagccaatttccaaaaagcctcctctccgaaaagataaaaaggaaaagtctaacatgcagagtgaaagggcacggaaggagcaagtccttattgaagttggcttagtgcctgttaaagatagctggcttctaaaggaaagtgtaagcacagaggatctctcaccaccatcaccaccactgccaaaggaaaatttaagagaagaggcatcaggagaccaaaaattactcaacacaggtgaaggaaataaagaagcccctcttcagaaagtaggagcagaagaggcagatgagagcctacctggtcttgctgctaatatcaacgaatctacccatatttcatcctctggacaaaacttgaatacgccagagggtgaaactttaaatggtaaacatcagactgacagtatagtttgtgaaatgaaaatggacactgatcagaacacaagagagaatctcactggtataaattcaacagttgaagaaccagtttcaccaatgcttcccccttcagcagtagaagaacgtgaagcagtgtccaaaactgcactggcatcacctcctgctacaatggcagcaaatgagtctcaggaaattgatgaagatgaaggcatccacagccatgaaggaagtgacctaagtgacaacatgtcagagggtagtgatgattctggattgcatggggctcggccagttccacaagaatctagcagaaaaaatgcaaaggaagccttggcagtcaaagcggctaagggagattttgtttgtatcttctgtgatcgttctttcagaaagggaaaagattacagcaaacacctcaatcgccatttggttaatgtgtactatcttgaagaagcagctcaagggcaggagtaatgaaactttgaacaaggtttca

SEQ ID NO: 840 - DNA, 2969 bp, Homo sapiens
gggtttacgctgccgccggcatccgctcggacgcggccacgttgtcttgcgcgctttgcccgcctggccctgggactctgaccctcggctaccctttcctgccccactagcgtggccgcgagcctcggtgagccggccgtattcccgctctcgcttagggggcacaggcgcaggcatcggcccggccactccaagccttcggtgcgcgggcgcgtctgggatacgggcccgggaggcgccgccctccgtccgcccggtgcctctcaggaacagcgaaccggagagagcgccggagagttgggctcagtgcagagctcggcgccggggcccatgcccgtgcgcccccgcaggccggcgccatggcctccgggagtgtggccgagtgcctgcagcaggagaccacctgccccgtgtgcctgcagtacttcgcagagcccatgatgctcgactgcggccataacatctgttgcgcgtgcctcgcccgctgctggggcacggcagagactaacgtgtcgtgcccgcagtgccgggagaccttcccgcagaggcacatgcggcccaaccggcacctggccaacgtgacccaactggtaaagcagctgcgcaccgagcggccgtcggggcccggcggcgagatgggcgtgtgcgagaagcaccgcgagcccctgaagctgtactgcgaggaggaccagatgcccatctgcgtggtgtgcgaccgctcccgcgagcaccgcggccacagcgtgctgccgctcgaggaggcggtggagggcttcaaggagcaaatccagaaccagctcgaccatttaaaaagagtgaaagatttaaagaagagacgtcgggcccagggggaacaggcacgagctgaactcttgagcctaacccagatggagagggagaagattgtttgggagtttgagcagctgtatcactccttaaaggagcatgagtatcgcctcctggcccgccttgaggagctagacttggccatctacaatagcatcaatggtgccatcacccagttctcttgcaacatctcccacctcagcagcctgatcgctcagctagaagagaagcagcagcagcccaccagggagctcctgcaggacattggggacacattgagcagggctgaaagaatcaggattcctgaaccttggatcacacctccagatttgcaagagaaaatccacatttttgcccaaaaatgtctattcttgacggagagtctaaagcagttcacagaaaaaatgcagtcagatatggagaaaatccaagaattaagagaggctcagttatactcagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtctgagttactcgggagggaaaagtgcagctcctctgatcatctgccccatgagtgggatagatgggttttctggccatgttgggaatcatggtcattccatggagacctccccttgaggaggtgaattcaggccaaaagggctgttggctgtaatcctacgccaggcacaaggcatcttgttgccttgccacgtcctgtcacagctgggtatccttaccatgttccacgcccttgcagtgggagacaggatgtccatgttctctaccatccttttccttcccatgcagattgtgaaatgtaatgagatgtatcaagatatcctagaaataaaaaccagatgtccacctccagtgtttcatactttctggttttacacatcgctggagggataaagagtatggataatctttggatttggagagccgttcaagatacttccagcttcttggctcagcctggcttcctctggttcagccccacataatgattatggctatttgctgtcatttctgggctagggctcctttctaacaacctagactggaataaggccctgtcagcatggctccctttatcccagttttccgtctgggaacagtacctctgcccctgattcccaatgtgccatagttttattaactccattaaagaagcctgtatgtgttttggttagttacagttattttacaataatggtgggtaatggccccacctctgttatgagataatgttctaatcaatgtctctgcctttgtatcttttctgagggctttgtctgttctcttcattctaatgaaaggtgtattctagtgctgggtgcatatcatccaggataatattctgcccaactccatcctctgttactagatcccttaccagtcacatttgtggactggtggccagtcgtataccatccctggaaggattctgggacaatattccagggattcattgacttcttggctccttttctccatttcctttgggggaagggggaattgaccatgcttaagtgcatcctatcaaggggcagctccgtccccatggccattggatcatgagacactctgaagtcagaaggctggggcagatcacttcaagcaagcccccatgatggttctcagtcctgcttctctgtgggtacgtgcccctctgtttaaaaataaactgaatatggatgttta

SEQ ID NO: 841 - DNA, 6776 bp, Homo sapiens
gggagagggaagggggcggagctagccggagccgcgagtccattttggggctgtgcttggcgcgtaccgtgcggtccctgtagttggaggacgggcggtcgcgcggcctttcccactagccggagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaaaaaaaaaaaaaatatatatatatatatacacacacacacacacatatgtacacatacatatatatacatatatatgtatatatagaacacatggcaagagcaggaaatgggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaaaaaaaaaatatatatatatatatatatatatatatatatatatatatatatatatatatatatagttttactaggttttcatggataagtttttaaatgtaagacaggaaagggatctatttgatgtctatcttcagatatattggcagttttccttaagctatttagttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgaaaaaaaaaaaaaaaaaaaaa

SEQ ID NO: 842 - DNA, 1214 bp, Homo sapiens
cggcagcagcgagtggacatggctgcactcttccaagaagcaagcagctgtcccgtctgctcagactatctggaaaaaccaatgtccctggagtgtggatgcaccgtctgcctcaagtgcatcaattcgctgcagaaggagccccatggggaggatctgctttgctgttgctgttccatggtctctcagaggaacaaaatcaggcccaatcggcagctagagaggctggtttcccacatcaaggaactggagcccaagctgaagaagattctacagatgaacccaaggatgcggaagttccaagtggatatgaccttggatgccgacacagccaacaacttcctcctcatttctgacgacctcaggagcgtccgaagtgggctcatcacacagaatcggcaagaccttgccgagagatttgacgtgtccgtttgcatcctgggctcccctcgctttacctgtggccgccactactgggaggtggacgtgggaacaagcacagaatgggacctgggagtctgcagagaatctgttcactgcaaagggaagatccagctgaccacagagcttggattctggactgtgagtttgagggatggaagccgcctctctgccagcacggtgccgctgactttcctcttagtagaccgcaagttacagcgagtggggatttttctggatatgggcatgcagaacgtttccttttttgatgctgaaagtggttcccatgtctatacattcaggagcgtctctgctgaggagccactgcgcccatttttggctccttcaattccacctaatggtgatcaaggtgtcttgagcatctgtcctttgatgaactcaggcactactgatgctccagtccgtcctggggaggccaaataagccgccactgcaaaaaaaaacagggtcagaaaattacttgggtgggtagacttaggaattttctacttggtaaaagcattatacagtcataggagaaagatatgggacatttctataatctatattctaatttgattcgattattgagtcgtaagtattaattattgccaccatccaactcattgagtcttatggttcacatcttgtttcctatagaaatgttctgtattctcggatcaatttccaaatgctttactttttcatttctgtaagttcaaatcaatgtttaaattatagaagttatgaggtaaataaacatttggatatca

SEQ ID NO: 843 - DNA, 4392 bp, Homo sapiens
acagttgccccggtgagggaaacggaggcgccatagccacggtagtcgtggcgaccaagcaacccggcaacgcgagtcaacaacaacaaccgcccggccgacccccacccccaccccccaggcccggcccggggaccccagcacgtcccgtccccttcccaacatcgactccgagacctccgaaaagcgtttccgcagacagaagtggggagaagcggaggaattaaaaaaaaaaaaaagccttatttattatcattttccccaccgttggcatggcaacacaggcgtatactgagctacaggcagccccgccaccatcccagccgccacaggccccgccacaagcccagccccagccgccaccgccaccacccccagcggcaccccagcccccgcagccacccaccgctgctgccacccctcagccccaatatgtcaccgagctgcagagcccccagccccaggcacagccaccgggtggccagaagcagtacgtgacggagctcccggctgtacccgcaccctcgcagccaaccggtgcacccaccccttcgcctgcaccccagcagtacatcgtggtcactgtctctgaaggtgccatgcgggccagcgagacagtgtcggaggccagccccggctccaccgccagccagaccggcgttcctactcaggtggttcagcaggtgcagggcacccagcagcggctgctggtccagacgagcgtgcaggccaagccaggccacgtgtcgcccctccagctgaccaacatccaagtgccccagcaggctcttcccacgcagcgtctggtggtgcagagcgcagccccaggcagcaaaggtggccaggtctccctgacggtccatggtacccagcaggtgcactcgcccccagagcagtcgccggtgcaggccaacagctcttccagcaagacagccggggcccccacgggcacagtgccacagcagctgcaggtccacggcgtccagcagagtgtccccgtcacccaagagagatctgtggtccaggccactccacaagcgcccaaacccggcccggtgcagccgctgaccgtgcagggcctccagccagtccacgtggctcaagaggtgcagcagctccagcaggtgcccgtcccacacgtgtactccagccaggtgcagtatgtggagggcggcgatgccagctacacggccagtgccatccgttccagcacctactcctatcccgagacgccgctgtacacgcagacggcaagcaccagctactacgaggccgcaggcacggccacccaggtcagcacccccgccacctcccaggcggtggccagcagtggctccatgcccatgtacgtgtccggcagccaggtcgtcgccagctccaccagcactggggctggggccagcaacagcagcggaggtggtggcagtggtggtggcggcggcggcgggggaggcggtggcgggggtggcagtggcagcaccggaggcggcggcagcggagcaggcacctacgtgatccaaggcggctacatgctgggcagtgccagccagtcttactctcacaccacccgtgcctcgccagccacggtccagtggctcctggacaactatgagacggctgagggcgtgagtctgccacggagcaccctctactgccactacttactgcactgccaggagcagaagctggagcccgtcaacgccgcctccttcggcaagctcatccgctccgtcttcatgggcctgcgaacccgccgtctgggcaccaggggcaactccaagtaccactactatggcctgcgcatcaaggccagctcacccctgctgcggctgatggaggaccagcagcacatggccatgcggggccagcccttctcgcagaagcagaggctcaagcccatccagaagatggaaggcatgaccaacggcgtggcggtggggcagcagccgagcacggggctgtcggacatcagcgcccaggtgcagcagtaccagcaatttttggatgcctctcggagcctccctgacttcacagagctcgacctccagggcaaggtgctgcctgagggcgtcgggcccggggacatcaaagccttccaggtcctgtaccgggaacactgtgaggccattgtcgacgtcatggtgaacctgcagttcaccctggtggagacgctgtggaagaccttctggaggtacaacctcagccagcccagtgaggcgccaccgctggctgtacatgacgaggccgagaagcgactgcccaaagccatcctggtgctcctctccaagttcgagcccgtgctccaatggaccaagcactgtgacaacgtgctgtaccagggcctggtggaaatcctcattcccgacgtgctgcggcccatccccagtgccttgacccaagcgatccggaactttgccaagagcctggagagctggctcacccacgccatggtcaacatccccgaggagatgctgcgggtgaaggtggccgcggctggcgccttcgcgcagacactgcggcgctacacgtcgctcaaccacctggcgcaggcggcgcgcgctgtgctgcagaacaccgcacagatcaaccagatgctgagcgacctcaaccgcgtggacttcgccaacgtgcaggagcaggcctcgtgggtgtgccgctgcgaggaccgcgtggtgcagcggctggagcaggacttcaaggtgacgctgcagcagcagaactcgctggagcagtgggcggcctggctggacggcgtggtgagccaggtgctcaagccctaccagggcagcgccggcttccccaaggccgccaagctcttcctcctcaagtggtccttctacagctccatggtgatccgggacctgaccctgcgcagcgccgccagcttcggttccttccacctcatccggctgctctacgacgagtacatgtactacctgatcgagcaccgcgtagcccaggccaagggcgagacccccatcgccgtcatgggcgagttcgccaatctggccacctccctgaaccccctggaccccgacaaagacgaggaggaagaagaggaggaggagagcgaggacgagctgccgcaggacatctcactggcggctggcggcgagtcacccgcgctgggcccggagaccctggagccgccggccaagctggcgcggactgacgcgcgcggcctcttcgtgcaggcgctgccctccagctaagcccttggcctccccgccccacccgcccccgccacccctccacgccagggtccctcaaagcttctgtggcttcgtggtcactgctccagcctcagccagggcagggagggggactccgagacagggaagaccggggccctcctcccttatggggccggcacaatcagtgggctgggcggagccgcagctgcaaactctgacacaaaagacgtgccttaaggaacccgccgcgtgcccaggtgccccgcggggcatccagctcggccccttggccgcccccctcccaggccccagcgtcttctccccagccccgtcctcccaccaccccagggggcaggcaggcaggccccctcccgtgcgaaactgttaacttattcagctcgctggctttgcacagcctgtcctgggcccagccctgagccccgggccggcgcaggtgggcgtcacctggggactccccactgtcagcagcagccccgggacaccctacccccagcaaccccactgcttccccttcttggtattaagtgcaattaaagccgtgggtgtcgcatcttctccagcgctgggccctcccttgcccccaagctcaagaagggggcactgcccggcccggctgtgaggagggcggcagggggcacggcctccagcttccaaagagcagcgagccgcggagccggggagtgcccacagaccccagcccccgcgcccccgccctccgccgctggtttgtaatggaaccttttctgtgcccctatcttcccggagaccacgcttctcctccgtgccgtgcgacccccaccccatgactattgtgcgattcgtgagcgccgcccgagcggagttggtaacttgttgggtttttttccaaccatcatggccttatctgttccagttttctcagtgttttcagcctgtgagatagatgtttatggcaagaaaaaggaaaaaaaaatggaaatctgacctattgtataaaaatcactattttgtgtgctccgcgtgctatagcttttggggcggccctgcccagtccccgtgcccacggggctccctctcccggtggtgaaagtgtccacacgtgtggtagtctagtgtgccgagctgttttctacctttttgtagtctttcttaaaacaataaattccgctgtgatatttgcctaaaaaaaaaaaaaaaa

SEQ ID NO: 844 - DNA, 4114 bp, Homo sapiens
gcgagcgtgggcgggccgttaggaaggtggggcgcggagcctggtaaccgttgccggtaacaacgccccgccccgtcgggcgggcgggctgcgcgaggctggctggcggcgggagccggaggaggagcggccgccgccgccaccgccgccgccatagagactgtagccgtggagactgttacttaccaacggggaccaacacgcagcagccgctgccgccgccgcgggagccgctgcccgaactcccggcccgaactccagacctgagcatgcagaattccgagggtggagcggattcgccagcgtccgtggctctgcgtccctcggcggcagccccgcctgtgccagcctccccgcagagggtgttggtccaggcagccagctccaatcccaaaggggcccagatgcagccgatctccctccccagagttcagcaggtaccccagcaggtgcagccggtgcagcacgtgtatcctgcccaggtgcagtacgtggaagggggagacgccgtctacaccaatggagccatacgaacagcctacacctacaaccccgagcctcagatgtacgcccccagcagcacggcttcttacttcgaggccccaggcggtgcccaggtgaccgtggcagcctcgtccccgccagcggtcccctcccacagcatggtgggcatcaccatggatgtcggggggagccccatcgtctccagcgcgggagcctatctcatccacggggggatggacagcaccagacactccctggcccacacctcccgctcatcgcccgccacgcttgaaatggcgattgaaaacctccaaaaaagcgaaggaatcacatcacacaaaagcggtttactcaacagccatctccagtggctgttggataattatgaaacagcggaaggtgtgagtctccccagaagttctctttacaaccactaccttcggcactgccaggagcacaagctagacccagtgaacgccgcctccttcgggaaactgatccgttctgtgtttatggggctgagaacgcggcggctgggcaccaggggcaactcgaagtaccattactatgggattcgtctgaagccggactcaccactgaaccggctgcaggaggacacgcagtacatggccatgcggcagcagcccatgcaccagaagcccaggtaccggccagcccagaagacggacagcctcggggacagcggctcccacagcggcctgcacagcactccggaacagaccatggccgtgcagagccagcaccaccagcagtacatagatgtctcccacgtcttccccgagttcccagcgcccgacctgggcagcttcctgctgcaggacggcgtcacactgcacgacgtcaaggccctgcagctggtgtacagacggcactgcgaggcaactgtagatgtggtgatgaacctccagttccactacatcgagaagctgtggctctccttctggaactctaaggcctcctccagcgacggccccacctctcttcctgccagtgacgaagaccccgagggcgccgtcctgcccaaggacaagcttatctccctgtgtcagtgcgaccccatcctcaggtggatgaggagctgcgaccacatcctctaccaggcgctggtggagattctcatccccgacgtgctgaggccggtccccagtaccttgacacaggccatccgtaactttgccaagagcttggaaggctggttgacaaatgccatgagtgacttcccacaacaggtcatccagaccaaggtgggcgtcgtcagtgccttcgcccagacgctgcggcgctacacgtccctcaaccacctggcgcaggcggcccgggcggtgctgcagaacacgtcccagatcaaccagatgctcagcgacctcaaccgcgtggactttgccaacgtgcaggagcaggcctcgtgggtgtgccagtgcgaggagagtgtggtgcagcggctggagcaggatttcaagctgaccctgcagcagcagagctccctggaccagtgggccagctggctggacagtgtggtcacccaggtcctgaagcagcatgccggcagccccagcttccccaaggccgcccggcagttcttgctgaaatggtccttttacagctccatggtgatccgggacctgaccctgcgcagcgctgccagcttcggctccttccacctcatccgcctgctctacgacgagtacatgttctacctggtggagcaccgcgtcgcggaggccaccggagagacgccgatcgctgtgatgggagagttcaacgatctcgcctctctgtcgctgacgctgctcgacaaagatgacatgggcgatgagcagcgtggcagcgaggcgggcccagacgcccgcagcctgggtgagcccctggtaaagcgggagcgcagtgaccccaaccactccctgcagggcatctagcagccccggccggcgcctcctcgaggttccaaaagatgccgcctggtcactctgggaacctggatttcaccggctccaccaaattagtgcctcttagatgatgtgatgtttactttgactcaagcgggggctcccggggtcagtgttcaagaaggaaagcagttgttgaagctacagaagcccaggccagggctcccactggctgtagctgtgctctgggtccccaggtccctgcgcagccaccagggccccaccagaccatgggttccttattctggacaaaccctcctctgctggaaccctggactttggccccagtccctttaagagctgaaagggctgtgctgagagcactggcctctgcactcaactggaaccaattttcaccatgattttaaaaattaaaaaaacctggcagagcccgactagaaagggacggcctctcccctcctacctgccaccgctggggaggcacagagctcgccagcgtccctggagtcccctcaggaatggaaagtggagtgcccttgtctggtagcaccatgtgggagggacccagctgggcgcagcgccctgtggccttttagatccagacctccctgccggatgccccgaggcgggaggccggctgtgctgcaggaacccatctccagatgccaaaggacttgaggggcagctgacaatcgctgtgtcccggcagatccgcagctcgaaaaagaacaagccacagaaacgggctcgctcgtgccaggacacagcagtgtctttcaaaaaatcaaaaccagaagttttatcagcagcaggaaggatgtgggactctgtccaagttcaccgtcaccatcaagccactggctgtggaaggagtttgtccaacagggtcagtgtcacagccacaacttcagaaagcagccatcccgcgtgtcgtccaaacagcagtgcctgcgtcccgctccacggagtcttccagaacacctccctctgaactaatcccggagcaccccacccccagcgagtcccacctggacctcttcaaagtcaaaactcttctctcgggacaaacaaatattcgggactttcgaagccctgaacttgagacaccaagtttgtctccatggaaacacgtagccgctgcagttggacagctgcgtgctggagttctgtccccaaaccaactgcagagaagaaagacgagcctcggcccaggacgcgatttctaacgaaatgcaatagttttctctttttggaaaaatgtttataccaatagttttgtgcgctaattgttattagaacgtttcttatgaatgtgtacattgcagtatattcagtcccaaatgttttgttctcattcacacagaaggtactaatgtcagctcacgtggcctttaaaaacctacttccccgcccgcaggagctcagagcatcgctgggcctgcgccagagtgaggggtgcaggaagacaaagacgcgtgctcactttagaaacgaaaagctgggaataatcacactgtttgtctggtcgtatagcccaaaccttagttgaaatcagacagaaagaatgtctttaaaatatacatctcctctccttggagacactgaagctcacagttaacggattgtaatgcccggcttttcctcactcctggtaaccaatacaagctggtttctgccttaaa

SEQ ID NO: 845 - DNA, 3275 bp, Homo sapiens
cgtgcgagtgtctccctctccctctcgctctctctctctctccctctctctctctcttttgtgagttatagcaaccgttgccttgtgaatcaagcgccatagtcaccgtagtcctggcgactgttacccatcaacaacaactactcctctcctcctcctcctcctcttcctcctcctcctccccaccaccaccatctccatcacccaccaacaacaccacaataatccacagccaaggccacttggtcattctggcattttatggtagagaatacgttgagtttggctctggaaggaatatgagagaccatcatgcagacatcagagactgggtcggacacaggctcgacagtgaccttacaaacatctgtggctagtcaagcagcagtgcctacgcaggtggtacagcaagtaccagtacaacaacaggtacagcaggtacagactgtgcagcaggtacaacatgtctatcccgctcaggtgcagtatgtggaaggaagcgatactgtctataccaatggagcaatccgaacaacaacgtatccttacacagagacacagatgtacagccaaaatactggagggaattactttgatactcaagggagttccgcccaggtgactaccgtggtctcatcccacagtatggtgggcactggtgggattcagatgggcgtcacaggaggacaactcatcagcagctctggaggaacctatctgatcggcaactcaatggagaattctggtcactcagtgacacacacaactcgggcctccccagcgacaattgaaatggcgattgagacgctgcaaaagtctgacggtctgtccactcacagaagctctcttctcaacagccatctccagtggctgttggacaattatgagacagcagaaggagtgagccttcccagaagcactctgtacaaccactaccttcgacactgtcaggaacacaaactggacccagtcaatgctgcctcttttggaaaattaataagatcaatttttatggggctacgaaccaggagattgggcactagaggaaactccaaataccactactatgggattcgtgtcaagccagattcccctcttaatcgtctgcaagaagacatgcagtatatggctatgagacaacaacccatgcaacagaaacaaaggtacaagcctatgcagaaagtggatggggttgcagatggtttcacaggaagtggtcaacagacaggcacatctgttgagcaaactgtaattgcccaaagccaacatcatcaacagtttttagatgcatctcgagcacttccagagtttggagaagttgaaatctcttctctgccagatggtactacctttgaggatatcaagtcactgcagagtctttatagagagcactgtgaggcaatattggacgttgttgtgaatcttcaatttagcctgatagaaaaattgtggcaaacattctggcgctattctccctctactccaactgatggcactaccattaccgaatcgagcaatctgagtgaaatagaaagtcgacttccgaaagcaaagctgataactctgtgcaaacatgagtctatcctgaaatggatgtgtaactgtgaccatgggatgtaccaggctttggtggagattctcatccccgacgtccttagacctattcctagtgccttgacccaagccattcgaaattttgcaaaaagccttgaaggttggctttccaatgccatgaacaatattccacagagaatgatacaaaccaaggttgccgctgtaagtgcctttgcccagactctgcgaagatacacgtcgcttaatcacctggcccaggcagctcgtgcagtgcttcagaacacttcccaaatcaaccagatgcttagtgacctcaaccgtgtcgactttgccaatgtccaggagcaggcttcctgggtgtgccagtgtgatgacaacatggttcagagactagaaacagacttcaagatgactcttcagcagcagagcaccctggagcagtgggctgcgtggcttgacaatgtgatgatgcaagcactgaaaccctatgaaggaagacccagttttcctaaagccgccaggcagtttctgctaaaatggtctttctacagctcaatggttattcgggacttaaccttacgcagtgctgctagctttggctccttccacctgatccgtctactctacgacgaatatatgttttacttagtagaacatcgtgttgctcaggcaacaggagagactcctatagcagtcatgggcgaggtaagagaggctgaaagagctgtgacccactgggttattaaaaataagccagaattacacttcagtctaaatacattattgattaaaaccatggttcctaaccaagtcagcctcagagccaggagggactgtggagttattgcaagagttccttaaattcctctgttcttatgtgcttaatcaaaagattctaaaattgtggattatatcatgtgaaagttcatggaatgtgtctctatattatacaggtacctatgtaaaagaaaaacttgagaaccactggaatatgaaaaatattttaagtgggaaaaagattggtgctcctgataaagcaaagggctgggaatacaatggaaaggattaaatatgtattttgtagactctttcccggtctccaagaacaaagtaaatgattctattttagaaggataaaaatggtaatgatgataactaacattttttggacacttactatgtgcgaggcacagttctatgttttttacatgtaataaagcacttaatgcaagtctttgagatacgttctactttattctgttttacaataagcatccgaggtttatgcagaaagctaaggcacagaaaggttaaatgattactcagctaaaaaatggtagagatttttttttcaaacacagtctgattttcaaacccatatgcttctaaccactaatgatgtaagggggaaaattctcttcttcagaatttctgaatagtcatcaaaatggcttatcaaaaagcttaaactctgaatataacaagggctggttaatataatgaggaatagatgcaaatgctcagatggttcagcactggcttattttgttatattgaatgcaggaggcgggggtagtttataccttgtcgaatcataccagattattaaatgtgacaaattacccaaggcggtaaaaaagacatgttcacttttaagctatgtgtatgtgcttatataaataaaaaagagtgaaaacaga

SEQ ID NO: 846 - DNA, 2188 bp, Homo sapiens
tggagaggccacagctgctggcttcctgggcttctccaaactcctgtgtgtcgccactgccaccggcagggagccaggagagagacagaaaggggctgagacagaatgatcaaaaggagagcccaccctggtgcgggaggcgacaggaccaggcctcgacggcgccgttccactgagagctggattgaaagatgtctcaacgaaagtgaaaacaaacgttattccagccacacatctctggggaatgtttctaatgatgaaaatgaggaaaaagaaaataatagagcatccaagccccactccactcctgctactctgcaatggctggaggagaactatgagattgcagagggggtctgcatccctcgcagtgccctctatatgcattacctggatttctgcgagaagaatgatacccaacctgtcaatgctgccagctttggaaagatcataaggcagcagtttcctcagttaaccaccagaagactcgggacccgaggacagtcaaagtaccattactatggcattgcagtgaaagaaagctcccaatattatgatgtgatgtattccaagaaaggagctgcctgggtgagtgagacgggcaagaaagaagtgagcaaacagacagtggcatattcaccccggtccaaactcggaacactgctgccagaatttcccaatgtcaaagatctaaatctgccagccagcctgcctgaggagaaggtttctacctttattatgatgtacagaacacactgtcagagaatactggacactgtaataagagccaactttgatgaggttcaaagtttccttctgcacttttggcaaggaatgccgccccacatgctgcctgtgctgggctcctccacggtggtgaacattgtcggcgtgtgtgactccatcctctacaaagctatctccggggtgctgatgcccactgtgctgcaggcattacctgacagcttaactcaggtgattcgaaagtttgccaagcaactggatgagtggctaaaagtggctctccacgacctcccagaaaacttgcgaaacatcaagttcgaattgtcgagaaggttctcccaaattctgagacggcaaacatcactaaatcatctctgccaggcatctcgaacagtgatccacagtgcagacatcacgttccaaatgctggaagactggaggaacgtggacctgaacagcatcaccaagcaaaccctttacaccatggaagactctcgcgatgagcaccggaaactcatcacccaattatatcaggagtttgaccatctcttggaggagcagtctcccatcgagtcctacattgagtggctggataccatggttgaccgctgtgttgtgaaggtggctgccaagagacaagggtccttgaagaaagtggcccagcagttcctcttgatgtggtcctgtttcggcacaagggtgatccgggacatgaccttgcacagcgcccccagcttcgggtcttttcacctaattcacttaatgtttgatgactacgtgctctacctgttagaatctctgcactgtcaggagcgggccaatgagctcatgcgagccatgaagggagaaggaagcactgcagaagtccgagaagagatcatcttgacagaggctgccgcaccaaccccttcaccagtgccatcgttttctccagcaaaatctgccacatctgtggaagtgccacctccctcttcccctgttagcaatccttcccctgagtacactggcctcagcactacaggtaatggaaagtccttcaaaaactttgggtagttaatgtttgaagaaagggctttctgccagcctgggcaacatagtgagacttcatttccacacacacaaaaagccagacatcttggctcacacctgtagtcccagctacttgggaggctgaggtgggagaattgcttgagcccaggagctacgatcgcaccactgcattctagccttagtgatacagtgagaccttgtctcaaaaaaagaaaaacagggctttctggaaaaacattcttctcccacaatctccaaaagataatgccaaaacctgggtatcttcctggatttgtgaatgacgtacaggtattcatttattcattggtacacattctgtatgctgctgttttcaagttggcaaattaagcatatgataaaatcccaaaactaa

SEQ ID NO: 847 - DNA, 3618 bp, Homo sapiens
attcagaaaaaggaaaataaagcaacgcacgagccggctgggccaggaccttggggctgggctggagtgaaggtggctacgagttttccagatttaggagacttcagaaaggtggggcagatagaatggagatggcaaagatctctttgggcatatatgggcctggcgaagtaatggaataatttctaattttcggagaaggcaagtgccctcatgccgggatggcagaagatgagcctgatgctaagagccccaagactgggggaagggcccccccaggtggtgctgaggctggggaacctaccacccttcttcagaggctccgaggtaccatttccaaggccgtgcagaacaaagtagaggggatcctgcaagatgtacagaaattttctgacaatgacaagctgtatctctaccttcagctcccctcaggacccaccactggagacaaaagctcagagccaagtacactgagcaatgaggagtacatgtatgcctataggtggatccgcaaccacctggaagagcacactgacacctgtctgccaaagcaaagtgtttatgatgcctatcggaagtactgtgagagtcttgcctgttgccgcccactcagcacagccaactttggcaagatcatcagagagatcttccctgacatcaaagctcgaaggcttggtggccggggccagtccaaatattgctacagtggcataaggaggaagaccttggtgtctatgccacccctgcctggacttgacctaaagggttctgagagtccagaaatgggcccagaagtaaccccagcacctcgagatgaactggtggaggcagcgtgtgccctgacctgtgactgggcagagcggatcctgaaacggtccttcagttccatcgttgaggtcgcccgcttcctgctacagcagcatctcatctctgcccgatctgcacatgcccatgtgcttaaggccatggggcttgctgaagaggacgaacatgcacctcgggaacggtcatctaaaccaaagaatggtttagagaacccagagggtggagcccacaagaagccagagagactggcccagcctcctaaggatctggaagcccgaactggggccggtcctctcgcacgtggagagcggaagaagagtgtagttgagagctcggccccaggagccaataacctgcaggttaatgccctagtggctcggctgcctctgctccttccccgggcccctcgctcactaattccgccaatcccagtctctccacctattctggcccccaggctttcttcaggtgccctgaaagtggctacactgcctctgtctagtagggccggggcacccccagcagctgtgcccatcattaacatgatcttaccaactgttcctgctttgcctggacctggacctgggcctgggcgagctccacctgggggactcactcagccccggggcacagagaacagagaggtaggcataggtggtgaccaaggaccacatgacaagggtgtcaagaggacagctgaagtacctgtgagtgaggccagtgggcaggctccaccagctaaagcagcaaagcaggatatagaggatacagcaagtgatgccaaaaggaaacgggggcgccctcgaaaaaagtcaggtggaagtggggaaaggaattctacccctctcaagtcagcagctgccatggaatctgcccagtcctcaaggttaccatgggagacatggggctcaggaggggaaggcaactcagctggaggggcagagaggccagggccaatgggagaggctgaaaagggggcagtacttgcccagggtcagggagatggtactgtttccaaaggaggaaggggccccggttcccagcataccaaagaagcagaagataaaattcccttggtcccctcaaaagtgagtgtcatcaagggcagcagaagccaaaaggaggcttttcctttggcaaagggagaggtagacactgcaccacagggtaataaagacttaaaggagcatgtgcttcaaagttccttatcccaggagcataaagacccaaaagcaacacccccatgatacaggtctgtggggaagagtgtttatatccctacgttaactttgcctagtagaggcccttctttgcacttgcttctcatttggctattcttttcctaaggaagtccattctcctctgtacagacagctgagtcacccagtctacttagtacctggttgctgcctctgaccttttcagcttgataccctgggctttagtgtaaccaataaatctgtagtgaccttacctgtattccctgtgctatcctgtgggaaggtaggaatgggctaagtatgatgaatatataggttagggatcttttggttttaaatcacagaaaacctaattcaaactggcttaaaataaaaaggatttattggttcatgtaactagaaagtccataggtagtgctggctccaggtgaagacttgacccagtagttcagtatgtctctaaataccggactgacttttttctcactgttgcatcttctgtaggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgctaatttgcttattctatatcatggacaacacctttggggaaaagggtgggggtcagcctccccaaaatcacatggattccccaagtggaaactaggagcagggagttgcttgggtggccgctaacaccaggctactcttattttagcttgctaagttgagatcagctagacctgctttcttttctcctcagtcttgcatttccctcaatacaagctgtagcctctttcctcgtttctagtctcagaaggaaggagagggaagccattctcctctagggactcttcagtctcatttagatgatagtccctttttttctacctccatattagagatggagctccttccttttcctgtttcttaatttttgtcttctcattcctgcttccctctcaccctattgccagttccaccaactagagtgaaagacttcctagccatttcattaaatctattctgtatccaccaggtggcagcatcttgtcatacgtgtcaggacttaggactgcggggtttaggttagatgtcacggaaaaagctagttctgtggtcaggcggcaccaatgagaaaggaatgcagaccctccagatgtatccttgggaaaagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacattaaaacattttaaatacca

SEQ ID NO: 848 - DNA, 1438 bp, Homo sapiens
ccggacgccgcacggctcctgttccggtgtcagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccactcgggccgcaaaaactcccttctttagccctctgcccccgcccttgcttataagcctttgagaccgcagaagggaccttgttgtggaacgggacggccaagaggaagccagatcgctgagggtccggtctccagtttgcctcctgctatatccattggaagagaaaagtttgtgacttgggcccccaagttttgagagaactgggctttcggcgcggggggacagaggaggctcgtggggagctttccccatggagcttacccagcctgcagaagacctcatccagacccagcagacccctgcctcagaacttggggaccctgaagaccccggagaggaggctgcagatggctcagacactgtggtcctcagtctctttccctgcacccctgagcctgtgaatcctgaaccggatgccagtgtttcctctccacaggcaggcagctccctgaagcactccaccactctcaccaaccggcagcgagggaacgaggtgtcagctctgccggccaccctagactccctgtccatccaccagctcgcagcacagggggagctggaccagctgaaggagcatttgcggaaaggtgacaacctcgtcaacaagccagacgagcgcggcttcacccccctcatctgggcctccgcctttggagagattgagaccgttcgcttcctgctggagtggggtgccgacccccacatcctggcaaaagagcgagagagcgccctgtcgctggccagcacaggcggctacacagacattgtggggctgctgctggagcgtgacgtggacatcaacatctatgattggaatggagggacgccactgctgtacgctgtgcgcgggaaccacgtgaaatgcgttgaggccttgctggcccgaggcgctgacctcaccaccgaagccgactctggctacaccccgatggaccttgccgtggccctgggataccggaaagtgcaacaggtgatcgagaaccacatcctcaagctcttccagagcaacctggtgcccgctgaccctgagtgaaggccgcctgccggggactcagacactcagggaacaaaatggtcagccagagctggggaaacccagaactgacttcaaaggcagcttctggacaggtggtgggaggggacccttcccaagaggaaccaataaaccttctgtgcagaatga

SEQ ID NO: 849 - DNA, 1126 bp, Homo sapiens
gtggcgagggcggtgcctgggggcaggggcctcctcggagggcggcggggacagacccgtcgccccggctccgcagccccgccccggccccgcctccgctccggccgccgaaggctataagatctaggaacccgagccggtggtagggcgggcgcggaccgtgctgggagcggcgcggctggagcgcagcgccgaagggactggcagggctgaagtgtgcgggacagcaagcccccgaatagccccggctgccacctcgcaggacccaaggccacgcgcgccgggcccagctgagccgcctcatgaagccgcccgcggcgcagggcagccccgcggccgccgcggccgcagccccggccctggactcggcggccgcggaggacctgtcggacgcgctgtgcgagtttgacgcggtgctggccgacttcgcgtcgcccttccacgagcgccacttccactacgaggagcacctggagcgcatgaagcggcgcagcagcgccagtgtcagcgacagcagcggcttcagcgactcggagagtgcagattcactttataggaacagcttcagcttcagtgatgaaaaactgaattctccaacagactctaccccagctcttctctctgccactgtcactcctcagaaagctaaattaggagacacaaaagagctagaagccttcattgctgatcttgacaaaactttagcaagtatgtgaaacaagaagttctgggtcctttcatcataagggagaagcttcagaaagttccgaggacctgctaaaatcagctactagaatctgctgccagaggggacaaagacgtgcactcaaccttctaccaggccactctcaggctcaccttaaaatcagcccttgatcccatttctgggcaatttagacagtgaaactgactttgtttacctgcttgcagcatattagaacagacgatccatgctaatattgtattttctcttaaaacatagctttcctgtaatttaaagtgcttttatgaaaatatttgtaattaattatatatagttggaaatagcagtaagctttcccattataatatatttttgtatacaaataaaatttgaactgaagtctgcaaaaaaaaaaaaaaaaaa

SEQ ID NO: 850 - DNA, 3869 bp, Homo sapiens
agaagggagcgagagccccagagcgcggcggcagcggcggcctggcccttccagagggccagagccagggacatgcgggcgcccgggactccgcgttccgcgcggcccggcgcctgagcgcctccgttccccgtcccggagctgccggcggcatgatccgacacgccggggcgcccgcgcgcggggaccccacgggtccggttccagttgttggcaaaggagaggaagaggaagaggaagatggcatgcggctttgtctgccagccaacccgaaaaactgccttcctcaccgccggggcatcagcatcctggagaagctcatcaaaacatgcccggtgtggctgcagctgagtctgggccaggcagaggtggccaggatcctgcaccgggtggtggctgggatgttcctggttcgccgggacagcagctcgaagcagctggtgctctgtgtccactttccttctctgaacgaaagctcggccgaggtgctcgaatacaccattaaggaagaaaagtcgatattgtacctggaaggctcggctcttgtgtttgaggacatcttcagattgattgcgttctactgtgtcagtagagacttactgcccttcacactgcggctaccccaggccatccttgaggccagcagcttcacggaccttgagaccatcgccaacctgggtctgggtttctgggactcctcgctgaatcctccacaagaaagagggaagccagcagagcccccaagagaccgggcccccggattccccctagtctccagcctcaggcccacagcccatgacgcaaactgtgcctgtgaaatcgagctgtcggtaggaaatgaccgcctgtggtttgtgaatcctattttcatcgaggactgcagcagcgccctgcccaccgaccagccacctcttggaaattgccctgcacgccctttgccgcccacctctgatgccacctcacccacctccaggtgggccccacgccgcccaccaccccctcccccagtgctgcccctgcagccctgcagcccagcccagccccctgtgctccctgctcttgcccccgcccctgcctgtcctttgcccacctctcccccagtgcctgccccccacgtcacaccccatgccccaggtcccccagaccatccgaaccagccgcccatgatgacctgcgagagactcccatgccccactgcaggcctgggccccctcagggaggaagcgatgaagccaggggcagcctccagtcccttgcagcaggtccccgccccgccactgcctgcgaagaagaaccttcccactgcccctcccagacgccgcgtttccgagagggtgtccttagaagaccaaagtccggggatggcggcagagggggaccagctcagcctgcctccccaagggacctcagacggccctgaggacacgccccgggagagcacggagcaaggccaggacacagaggtgaaagccagcgatcctcacagcatgccagagctgcccaggacagccaaacaacccccagtcccgccccccaggaaaaaacggatctctcgacaactggcctcgaccctcccagctcccttagagaacgctgagctctgcacacaggcgatggccttggagacacccacgccgggtccacccagagagggccaaagccctgcttctcaggctgggactcagcaccctcctgcccaggccactgcccattcccagagctctccagagttcaagggctccctggcctccctctcagacagcttgggggtgtctgtcatggccaccgaccaggactcctactccaccagcagcacggaggaggagctggagcagttcagcagccccagcgtgaagaagaagccctccatgatcctgggcaaggctcggcaccggctgagctttgccagtttcagcagcatgttccacgctttcctctccaacaaccgcaagctgtacaagaaggtggtggagctggcgcaggacaagggctcgtactttggcagcctggtgcaggactacaaggtgtacagcctggagatgatggcgcgccagacctccagcacggagatgctgcaggagattcgcaccatgatgacccagctcaagagctacctgctgcagagcaccgagctcaaggccctggtggaccccgccctgcactccgaggaggagctcgaagcaattgtagagtctgccttgtacaaatgtgtcctgaagcccctgaaggaagccatcaactcatgcctgcatcagatccacagcaaggatggttcgctgcagcagctcaaggagaaccagttagtgatcctggccaccaccaccactgacctaggtgtgaccaccagcgtgccggaggtgcccatgatggagaagatcctgcagaagttcaccagcatgcacaaggcctactcacctgagaagaagatctccatcctgctcaagacctgcaaactcatctacgactccatggccctcggcaacccagggaagccctatggggcggatgacttcctgcctgtgctcatgtatgtgctggcccgcagcaacctcacggagatgcttctcaatgtggagtacatgatggagctcatggaccccgccctgcagctgggggagggttcctactatctgaccaccacctacggggccctggagcacatcaagagctacgacaagatcacggtgacccggcagctgagtgtggaggtgcaggactccatccaccgctgggagcgccggcgtactctcaacaaggcccgggcctcccgctcctccgtacaggacttcatctgcgtgtcgtacctggagcccgagcagcaggcgcggacgctggcgtcgcgggcggacacccaggcccaggcgctgtgcgcgcagtgcgcggagaagttcgcggtggagcggccgcaggcgcaccggctgttcgtgctggtggacgggcgctgcttccagctggcggacgacgcgctgccgcactgcatcaagggctacctgctgcgcagcgagcccaagcgcgacttccactttgtctaccggcccctggacggtggtggcggcggcggcggcgggagcccgccctgcctggtggtgcgggagcccaacttcctgtgaggccctcccggggcgcctcccctcacccccaggcgcacgtctggccccgcctctggctgcgcactcccgaccgcgacgtccacgcagcagagggacatgggccattccatgacgtgcccaggccaacgtcgcaggacagttgtgaaaataacatgacgctcgtccaaggccacttcctgagggcaagtcctaatagccctgagacaccgagacggcatgttcttcattagacggaaagggaaactgaggctcaggagagaggcgctccaggccgctgcagccaacaaaccggcgccctcttcacacgtagctcctcaggccattccccatgagtcccccacacccaccccatcctcggtctttgcaaagaagggcccgagcttagtttccccaggactggcctaggaaggagcaccggccacagctgctccccgtgccactcagggtggacccagcatctcaggagcacctcagggtgtcggttaagagacaggcctccacccctgcaccagagcctgctcttagctcccggtgcccccagaccccgcagctctgtgcccggcaagaagcagctagacacacgccagggcgccaagcacggccagctccgcggacccatggacaagcccagccccgcctcagggaaaacagggcctttccctacaggacacgccccagagctgtggcagattgcaggagccatcgtgtggggagaatttaataaaagcccttttgaaaaaaaaaaaaaaaaaaaaaaaa

SEQ ID NO: 851 - DNA, 1744 bp, Homo sapiens
cagcgcccgggccatggcggcggcggtggcgggagctgctgtctgagcagcggttgcggaccgagcgaacttggcccaggagcccgggcctagggagaggcgcggcggcggcgggagcgcgaacggctggagctggccttcttcgccttctcctcggctgtggagccctggtggggggtctgcgcccggtcaccatgacgacgccggcgaatgcccagaatgccagcaaaacgtgggaactgagtctgtatgagctgcaccggaccccgcaggaagccataatggatggcacagagattgctgtttcccctcggtcactgcattcagaactcatgtgccctatctgcctggacatgctgaagaatacgatgaccaccaaggagtgcctccacagattctgctctgactgcattgtcacagccctacggagcgggaacaaggagtgtcctacctgccgaaagaagctggtgtccaagcgatccctacggccagaccccaactttgatgccctgatctctaagatctatcctagccgggaggaatacgaggcccatcaagaccgagtgcttatccgcctgagccgcctgcacaaccagcaggcattgagctccagcattgaggaggggctacgcatgcaggccatgcacagggcccagcgtgtgaggcggccgataccagggtcagatcagaccacaacgatgagtgggggggaaggagagcccggggagggagaaggggatggagaagatgtgagctcagactccgcccctgactctgccccaggccctgctcccaagcgaccccgtggagggggcgcaggggggagcagtgtagggacagggggaggcggcactggtggggtgggtgggggtgccggttcggaagactctggtgaccggggagggactctgggagggggaacgctgggccccccaagccctcctggggcccccagccccccagagccaggtggagaaattgagctcgtgttccggccccaccccctgctcgtggagaagggagaatactgccagacgaggtatgtgaagacaactgggaatgccacagtggaccacctctccaagtacttggccctgcgcattgccctcgagcggaggcaacagcaggaagcaggggagccaggagggcctggagggggcgcctctgacaccggaggacctgatgggtgtggcggggagggtgggggtgccggaggaggtgacggtcctgaggagcctgctttgcccagcctggagggcgtcagtgaaaagcagtacaccatctacatcgcacctggaggcggggcgttcacgacgttgaatggctcgctgaccctggagctggtgaatgagaaattctggaaggtgtcccggccactggagctgtgctatgctcccaccaaggatccaaagtgaccccaccaggggacagccagaggaaggggaccatggggtatccctgtgtcctggtctatcaccccagcttctttgtcccccagtacccccagcccagccagccaataagaggacacaaatgaggacacgtggcttttatacaaagtatctatatgagattcttctatattgtacagagtggggcaaaacacgcccccatctgctgccttttctattgccctgcaacgtcccatctatacgaggtgttggagaaggtgaagaaccctcccattcacgcccgcctaccaacaacaaacgtgcttttttcctctttgaaacctgcaaaaaaa

SEQ ID NO: 852 - DNA, 3310 bp, Homo sapiens
cccggcggggggaggttggggacgggcctggcagttgtgaactcgaacctgccgctgtcgccgcggcggggcggggagcgagagtgggccgcggaggccggccttcgggctccatggacgggcgccgcgtccctgcacagcccgccgcagaggtaaggctggcctctctgcagtcagaggtctgagctctgccatggggataggggtgtctttattactgcagttttctctaacacctgggggctaccggagtgtgggccgaagcaggcgctgcagccgcggaagtatccccaggaacatccccaagaggagctggaaaaagcctcatccccagctctgcagtctccaggggagctcagtgtctgtttgtccagcttctcagagttgctgtgcagctcggatgtggcataggaaacagcagacacagggagagggcagcataaggcactgtagggagcagtggccacattttctgcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgccggtgccaggcccggctgcccttgccctgccctgagtgtggccgtcgctttcgccatgcccccttcttagcactgcaccgccaggtccatgctgctgccaccccagacctgggctttgcctgccacctctgtgggcagagcttccgaggctgggtggccctggttctgcatctgcgggcccattcagctgcaaagcggcccatcgcttgtcccaaatgcgagagacgcttctggcgacgaaagcagcttcgagctcatctgcggcggtgccaccctcccgccccggaggcccggcccttcatatgcggcaactgtggccggagctttgcccagtgggaccagctagttgcccacaagcgggtgcacgtagctgaggccctggaggaggccgcagccaaggctctggggccccggcccaggggccgccccgcggtgaccgccccccggcccggtggagatgccgtcgaccgccccttccagtgtgcctgttgtggcaagcgcttccggcacaagcccaacttgatcgctcaccgccgcgtgcacacgggcgagcggccccaccagtgccccgagtgcgggaagcgctttaccaataagccctatctgacttcgcaccggcgcatccacaccggcgagaagccctacccgtgcaaagagtgcggccgccgcttccggcacaaacccaacctgctgtctcacagcaagattcacaagcgatccgaggggtcggcccaggccgcccccggcccggggagcccccagctgccagccggcccccaggagtccgcggccgagcccaccccggcggtacctctgaaaccggcccaggagccgccgccaggggccccgccagagcacccgcaggacccgatcgaagcccccccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaactggtaaaaaaaaaaaaaaaaaa

SEQ ID NO: 853 - DNA, 4282 bp, Homo sapiens
cattttggtcaacaccctgcttactgcgcacggccaatcctatgagaactcagcatcccagctcatctgagcagatcctggaagtgatttctgcagctcaggattttttttttaagctacattgaaaatataggtttattttttgttcaggtttttcttttatattttttttctgcacaaaggaggaggatttttcacttactcatatcgaggccagatttttaaagccagctaaggcagcatcagctgtgcgggatttaaagcctatagctcagctgaaaaaaaaggtggggggcagggaagggaagataaaaggagaggaagctgggagaagacaagcatcatcttattttgctatgtggtaggaactgtctataagatagtgtagaattgtttatcttgagcagtttgttcttaacctataaggtatttttccttttttttttttttaaacctcccccacccttttcctgaaagctttgtttcagagctttgtattgggtttttttggtgaggaggttgtatttatttttttggtgtgtgtgtgtgagtgtgtgtgtgtctgtgtgtgtgttgtggtcccagctgagtcatcatgtctgctctgacgcctccgaccgatatgccaacccccaccactgacaagatcacacaggctgccatggagaccatctacctttgcaaattccgagtgtccatggatggagaatggctctgcctgcgagagctggatgacatctcacttacacctgacccagagcctacccatgaagatcctaattatctcatggctaatgaacgcatgaacctcatgaacatggccaagctgagtatcaagggcttgattgaatcagctctgaacctggggaggactcttgactctgactatgcacctctccagcaattctttgtggtgatggagcactgtctgaaacatggcttgaaagctaaaaaaacttttctcggacaaaataaatccttctgggggcctctagaactggtagaaaagcttgttccagaagccgcagagataacagcaagtgttaaagatcttccaggacttaagacaccagtaggtagaggaagagcctggcttcgtttggcattaatgcaaaagaaactttcagaatatatgaaagctttgatcaataagaaagaacttctcagtgaattctacgaacccaatgccctcatgatggaagaagaaggagccataattgctggtctgttggtgggtctgaatgtcattgatgccaatttctgtatgaaaggagaagacttggactctcaggttggagttatagatttttcaatgtatctcaaggacgggaacagcagtaaaggtactgaaggagacggtcagattactgcaattctggaccagaagaactatgtagaagaactgaacagacatttgaatgctactgtaaacaaccttcaggcaaaagtagatgcattagaaaaatccaacactaaactgacagaggagcttgcagttgcaaacaacaggatcattaccttacaagaagaaatggaacgagttaaagaggaaagttcctacatactggaatccaatcggaagggtcccaagcaagacagaactgcagaagggcaagcactaagtgaagcaagaaagcatttaaaagaagagacacaattacgattggatgttgagaaagaactggagatgcagatcagcatgaggcaggagatggaattggctatgaagatgctggagaaggatgtctgtgagaagcaggatgccctggtatctcttcggcagcagctggatgacctcagagctctcaagcatgaacttgcctttaagctgcagagttcagacttaggagtaaaacagaaaagtgaactaaacagtcgcttggaagagaagactaatcagatggctgctaccattaaacaacttgaacaaagtgaaaaggatttggtgaaacaggcaaagaccttaaatagtgcagcaaataaactgatcccaaaacatcattaggcatttttaagttggtcacgtcgcaagtccgatatcacaacttaattgtaaaaggaagaaatctgaaagttactacatttaagctctgattctatataaaatgtcaccaaaaagttgactttgaatttgttggacttttaaaaaaccagttggaaatataggttgggtttttttcttattgttttctccccagggttagaaaaattggtataagttcctaattaaaagctgaataaactttgagaaattatttctgagttgaccaataaataaaaataccactttctttaaaaaagcctagggaattgaagctctgtacatatactaatgatgcctttacaacccagtccttgataataccagattctcggtgcattgttcatgtctgtatctgcaagcctgttctgccattgcagtgtgatgaacctagaggtaactaccatgtgaacttgaactcttctaaaatagttctgtgtctcttagaccatgaccccttttcacttttgttatataggtttaatccccaagccaaggatagtacttagtatttcactacacttctattctcagtaaccaagattgcttgcaactttttttgccttggtgacttttgaaaaaaaaagaaaagaaaaagcagcatccttatatttctttaaaatacatagaaataaagttagtaattaggtaacctatgataacataataatgtggacgcctggggaaaccctcctcatgtttgtcatcttctacctctgccgttttcctgcaattccgcttcctacttaggcagttcagagagaacaattctaataaaaacactcctctcctattaacaaaaaatgatgcagtacccatttttcgtatcctgcttttcttatattggagtaaaaaggacagggtatagacatgaatgatgatattctgcctggcctgtcatttcttacctggaaacatttacttaagagtttctgttactttttgttcagatggggatttgctaaaggttctgggaagctaataattgaattattagaaaaacatttcagaataggaagtaaatgataaacttatattctttattattatttagtacaaaaatagattcccagtagatatccacaagcaatattagcagggcttctgtttctaagtgaccacagactaaccctttctaggctttaacattgtaaataatcctataaacagtttgattttttaagatgatttttgatttgaagagacaggctttacataagccttcattccttcaaaaggtcctgacaaaatacttgggtttttttctctttttttcattctggtatgctttgcagcatttcagctgctttggtggggacacagataaccccttcgcttccagctcttaaaattctttatctttttcttggcaaaaccagaattaagagtgtaagatagattccatgtgtgcttatataggtccctgcacagattggacttgaaccaaaattaagtccaaagaacatatgtttagaccaacttcatggaagtggaagatcctgtgctcttgaacttattttaattcttataatttgcacctatataaacaaagctcctactgtattcttctcttcatcaaccttttgtggtgatgggttgccttttctacgagcatttggaaggagtgatcaaataccgaaattgaactttctaaaacctacacatagcatgcgtttaaattctattatataaagccccaagtgctttaccttctaaaacatgcttctctataggtgcaaagttataagatatgtagaagaaaacatccatcagaatcttctggagaatatggtcagagtcttaaacaggcccagtgctgagttctttgtccacttagtcacacatcttttgtgggaatgggaaaggaaggagacagccaaactctgacaaaggcttttccttatagaataacccaaagcctaggtgagggttgatatataatgtcccatgatttaatatatgtggtttgggggaaaggacaagaaaaaactataattccacatataagaaggtagttgcccatttacaagttccagttatgtgtgtaaaacagaaaaattaagtaccaaacctattaggaaatttttttaaaaagtggatttaacttaaattactgtgtacttgaggttggctttggatatggattttctaaaaagtgatgttttattgtttatcatctaatggctgtaaactgtagtactagaataaaaaaaatggaaaatcaaaaaaaaaaaaaaaaaa

SEQ ID NO: 854 - DNA, 6266 bp, Homo sapiens
ggttgcctacgcgctggtgggccgtgggaagatggcggacggaaagggagacgccgccgctgtcgccggggctggggctgaggctccggcggtagcgggagccggagatggagtcgagactgagtccatggttcggggtcatcgccccgtatctccagcgccgggagcctcgggactgcggccgtgtctgtggcagctggagacagagctgagggagcaagaggtgtcggaggtctcatctttgaactactgccggagcttctgccagaccttattgcaatatgcaagcaacaagaatgcatcagaacatattgtgtatcttctggaggtatatcgacttgccatccaaagctttgccagtgcacgtccatacttaactactgaatgtgaagatgtcctcttagtgcttggcagattagtactgagttgtttcgaattactgctttcagtgtctgaaagtgaactgccatgtgaagtctggctaccattccttcagtctctacaggagtcacatgatgcattattggaatttgggaataataacctacaaatattggttcatgttaccaaggaaggggtgtggaaaaacccagttcttcttaaaattctgtctcaacagccagtagaaacggaggaagtcaataaattgattgcacaagaaggaccttcctttctgcaaatgcgaataaaacatttgttgaaatctaactgcatcccccaggctactgctttatcaaaactatgtgcagaatctaaagaaatttcaaatgtgtcatcttttcagcaagcctatatcacatgtttatgttctatgctccctaatgaagatgctattaaggagattgcaaaggtcgactgcaaggaagtactagacatcatttgtaatctggaatctgaggggcaggataacacagcatttgttctttgtacgacttaccttacccagcagctccaaactgcaagtgtatattgttcttgggaactgactcttttttggagtaaactgcaaagaagaattgacccttctttagatacttttttggagcgctgtcgtcagtttggtgtcatagctaaaacgcagcagcatttattttgcctcattagagttatacaaactgaagcacaagatgctggtcttggggtgtcaattttactgtgtgtcagagctcttcaactcagatcaagtgaagatgaggaaatgaaggcatcagtttgtaaaacaattgcctgtcttttaccagaagatttagaagttagacgagcctgtcagcttacagaattcttaattgaacccagtttggatggatttaatatgttagaagaactatatttgcaaccagatcaaaaatttgatgaagaaaatgcaccggttccaaattctcttcgatgtgagctcttactagctttaaaagcccactggccttttgatcctgagttttgggactggaaaactttaaaacgacactgccaccaacttttaggacaagaagcctcagattctgatgatgatttaagtggctatgaaatgtccattaatgacacagatgttttagagtcatttctcagtgactatgatgagggtaaagaagataaacaatatagaagaagagatttgacagatcagcataaggagaaaagagacaaaaaacctattggctcttctgaaagatatcagaggtggcttcagtacaagtttttctgtttgttatgtaagcgggaatgtatagaggctagaattcttcatcattctaagatgcatatggaagatggaatttacacctgtccagtttgtattaaaaaatttaagagaaaagaaatgtttgttcctcatgtgatggagcatgttaaaatgccaccaagcagaagggaccgctctaaaaagaaattactgttaaaaggctctcaaaagggtatttgtcctaagagcccctctgcaatcccagagcaaaaccattcattgaatgaccaagccaaaggagagtctcatgaatatgtcacattcagcaaattagaagattgccacctgcaagacagagatttgtatccatgtcccggtacagactgttcccgtgtgtttaagcaatttaaatacttaagtgtgcatcttaaagctgaacaccaaaataatgatgaaaatgccaagcactacttggatatgaaaaatagaagagagaagtgtacttactgtcgacgacattttatgtctgcttttcaccttcgagagcacgaacaagtgcattgtgggcctcagccttatatgtgtgtatctatagattgctatgctaggtttggatcagtaaatgaactacttaaccataaacaaaagcatgacgatctgcgttacaaatgtgaattaaatggctgtaatattgttttcagtgacttgggacagctttaccaccatgaagcacaacactttagggatgcatcttacacatgcaacttccttggctgtaaaaagttctattactccaaaattgaataccagaatcacctctcaatgcataatgttgaaaattcaaatggagacataaagaaatcagtgaaacttgaggagtctgcaacaggtgaaaagcaagattgtattaatcagccccatctacttaaccaaactgataaatcacatttacctgaagatcttttctgtgcagaatcagctaattctcaaatagatacagaaactgcagaaaacctgaaagaaaacagtgacagtaattctagtgatcagttaagtcatagctcttcagcttcaatgaatgaagagctaattgacacactagatcactctgaaactatgcaggatgtattgttatctaatgagaaagtctttgggccctccagtttaaaagaaaaatgttccagtatggcagtttgttttgacgggactaagtttacctgtggttttgatggctgtggttccacatacaaaaatgcaagaggaatgcagaaacatttacggaaggttcatccataccatttcaagcccaaaaagataaagacgaaagatctgtttccctctttgggtaatgaacataatcagacaactgaaaagttggatgcagaacctaaaccctgctcagatacaaacagtgactccccagatgaaggtctagatcacaatattcacattaaatgtaaacgagaacatcaaggttattcctcagaatcctccatttgtgcttctaaaaggccctgtacagaggataccatgttggaacttctgttacgcttgaaacatttaagcttgaaaaactcaataacacatggatctttctcagggtcattgcaggggtacccatccagtggtgctaagtctcttcagtcagtttcatctatctcagaccttaattttcagaatcaagatgaaaacatgccaagtcagtaccttgcacagttggcggctaagccgtttttctgtgagcttcaaggatgcaaatatgaatttgtgaccagagaggctctgttaatgcattatcttaaaaagcataattattcaaaagaaaaagtccttcagttaaccatgttccaacatcggtattccccatttcagtgtcatatttgccaaaggtcatttacaagaaaaacacaccttaggattcattataaaaataaacatcaaattggcagtgacagagcaactcacaaactattagataatgaaaagtgtgatcatgaaggcccatgttcagtagataggttgaaaggtgattgttctgcagaacttggaggtgatcccagtagtaactctgagaaaccacactgtcatcctaaaaaggatgaatgtagttctgaaacagatttggaatcatcttgtgaagaaacagaaagtaaaacatctgacatttcatcaccaataggcagccatagagaagaacaagaaggaagagagggcagaggtagcaggcgaactgttgctaaaggaaatctgtgttatattttgaataaataccacaaaccattccattgtattcataaaacttgcaactcctcattcaccaatctaaaaggcttaattcgccattacagaactgtacatcagtacaacaaagaacagttatgtttggagaaagacaaagcaagaaccaaaagggaacttgtcaaatgtaaaaagatatttgcttgcaaatataaggaatgtaataaacgcttcctgtgttccaaagctcttgctaagcactgtagtgattctcataacctagaccatattgaagagcctaaagtactttccgaagctggatctgcagcaaggttttcttgtaaccagcctcagtgccctgctgttttttatacattcaacaagttgaagcaccacttgatggaacagcataatattgaaggggaaatacattcagattatgaaattcattgtgatcttaatggctgtggccagattttcacccatcgcagtaattactcacaacatgtatattaccgacataaagactattatgatgatttgtttagaagccagaaagtagcaaatgagagactactaaggagtgaaaaggtatgtcaaacagctgatactcaggggcatgaacatcagaccaccaggagatcatttaatgctaagtctaaaaaatgtggcttaatcaaagaaaagaaagccccaataagttttaaaaccagagctgaggccctccatatgtgtgtggagcactctgagcacacacagtacccctgcatggttcaaggatgcttatctgtggtgaagttggagagcagcattgtgaggcattacaaacgcactcatcagatgagtagtgcctatttagagcaacagatggagaatcttgttgtttgcgttaagtacggtaccaaaattaaggaggaacccccttctgaagcagatccctgtataaagaaagaagaaaatagaagctgtgaatcagagcgcacagaacacagccattccccgggtgacagtagtgcacccatccagaacactgattgctgtcattcaagtgaaagggatggaggtcagaaagggtgcatagaaagcagctcagtatttgatgcagatactctgctctacaggggaactttgaaatgtaatcatagttccaaaaccacttccctagaacagtgtaatatagttcagcctcctcctccttgtaaaatagaaaattccatacctaatcccaatgggactgaaagtgggacttatttcacaagtttccagctgcctttaccaaggatcaaagaatcagaaactaggcagcatagttcagggcaagaaaacactgtaaaaaatccaacccatgtcccaaaagagaattttaggaaacattcacagccccggtcatttgatttgaagacttacaaacctatgggatttgaatcttcatttctgaaatttattcaggaaagtgaagagaaagaagatgattttgatgattgggagccttcagagcacttaacattaagtaattcttcacagtccagtaatgatttaacagggaatgttgtggcaaataatatggtgaatgacagtgaacctgaagttgacatacctcattcttccagtgactctacaattcatgagaacctgactgcaatcccacctttaatagtagctgaaacaacaacagttccttccttggaaaacctgagggttgtattggacaaagcattaacagactgtggagagcttgccttaaaacagcttcattatcttcggccagtggtggttcttgaaagatctaagttttccacaccaattttagacttatttccaacaaaaaagacagatgagctttgtgtaggaagttcataagtagcaattttgttttagtaacagactggctccaacactgcaacatggggacatttgccaactcgaacaaaggctgagaagcagccacaccgttgtttagggtagaataggctgtgtatttacatgaatgtataatatctatgtcagcagtattggctgagtccattagctctccagttggtttaatgattgggtttatttttgtttgtttgtttattaaaaaaatggaactgtacacttgtttggtgctaattaatacatcaaaatatactggggcttcctttttcaaattaagtgtgcatgattgtatatggaacaaatactaaggtcccagggtgggagggctagggaaagggatatggagttcttacttgacttgaatgtgcacctgagggtgctttgtgtaatatattgtacactacagcatcttatattttttgagttgagtttcaataaattacaatttttcacccaaaaaaaaaaaaaaaaa

SEQ ID NO: 855 - DNA, 3864 bp, Homo sapiens
atacagtccatccgggttctttgagatgctgtttggcgactcgtcgccattcccggagcaggtcggcctcggcccaggggcgagtatccgttgctgtgtcggagacactagtccccgacaccgagacagccagccctctcccctgcctcgcggcgggagagcgtgtccggccggccggccggcggggctcgcgcaacctccctcgcctccccttcccccgcagcctccgccccgccaggcccggcccggactcccgagccccggcctcctcgtcctcggtcgccgctgccgccgggcttaacagccccgtccgccgcttctcttcctagtttgagaagccaaggaaggaaacagggaaaaatgtcgccatgaaggccgagaaccgctgccgccgccgacccccgccggccctgaacgccatgagcctgggtccccgccgcgcccgctccgctccgactgccgtcgccgccgaggcccccgttgatgccgctgagctcccccaacgccgccgccaccgcctccgacatggacaagaacagcggctccaacagctcctccgcctcttcgggcagcagcaaagggcaacagccgccccgctccgcctcggcggggccagccggcgagtctaaacccaagagcgatggaaagaactccagtggatccaagcgttataatcgcaaacgtgaactttcctaccccaaaaatgaaagttttaacaaccagtcccgtcgctccagttcacagaaaagcaagacttttaacaagatgcctcctcaaaggggcggcggcagcagcaaactctttagctcttcttttaatggtggaagacgagatgaggtagcagaggctcaacgggcagagtttagccctgcccagttctctggtcctaagaagatcaacctgaaccacttgttgaatttcacttttgaaccccgtggccagacgggtcactttgaaggcagtggacatggtagctggggaaagaggaacaagtggggacataagccttttaacaaggaactctttttacaggccaactgccaatttgtggtgtctgaagaccaagactacacagctcattttgctgatcctgatacattagttaactgggactttgtggaacaagtgcgcatttgtagccatgaagtgccatcttgcccaatatgcctctatccacctactgcagccaagataacccgttgtggacacatcttctgctgggcatgcatcctgcactatctttcactgagtgagaagacgtggagtaaatgtcccatctgttacagttctgtgcataagaaggatctcaagagtgttgttgccacagagtcacatcagtatgttgttggtgataccattacgatgcagctgatgaagagggagaaaggggtgttggtggctttgcccaaatccaaatggatgaatgtagaccatcccattcatctaggagatgaacagcacagccagtactccaagttgctgctggcctctaaggagcaggtgctgcaccgggtagttctggaggagaaagtagcactagagcagcagctggcagaggagaagcacactcccgagtcctgctttattgaggcagctatccaggagctcaagactcgggaagaggctctgtcgggattggccggaagcagaagggaggtcactggtgttgtggctgctctggaacaactggtgctgatggctcccttggcgaaggagtctgtttttcaacccaggaagggtgtgctggagtatctgtctgccttcgatgaagaaaccacggaagtttgttctctggacactccttctagacctcttgctctccctctggtagaagaggaggaagcagtgtctgaaccagagcctgaggggttgccagaggcctgtgatgacttggagttagcagatgacaatcttaaagaggggaccatttgcactgagtccagccagcaggaacccatcaccaagtcaggcttcacacgcctcagcagctctccttgttactacttttaccaagcggaagatggacagcatatgttcctgcaccctgtgaatgtgcgctgcctcgtgcgggagtacggcagcctggagaggagccccgagaagatctcagcaactgtggtggagattgctggctactccatgtctgaggatgttcgacagcgtcacagatatctctctcacttgccactcacctgtgagttcagcatctgtgaactggctttgcaacctcctgtggtctctaaggaaaccctagagatgttctcagatgacattgagaagaggaaacgtcagcgccaaaagaaggctcgggaggaacgccgccgagagcgcaggattgagatagaggagaacaagaaacagggcaagtacccagaagtccacattcccctcgagaatctacagcagtttcctgccttcaattcttatacctgctcctctgattctgctttgggtcccaccagcaccgagggccatggggccctctccatttctcctctcagcagaagtccaggttcccatgcagactttctgctgacccctctgtcacccactgccagtcagggcagtccctcattctgcgttgggagtctggaagaagactctcccttcccttcctttgcccagatgctgagggttggaaaagcaaaagcagatgtgtggcccaaaactgctccaaagaaagatgagaacagcttagttcctcctgcccctgtggacagcgacggggagagtgataattcagaccgtgttcctgtgcccagttttcaaaattccttcagccaagctattgaagcagccttcatgaaactggacacaccagctacttcagatcccctctctgaagagaaaggaggaaagaaaagaaaaaaacagaaacagaagctcctgttcagcacctcagtcgtccacaccaagtgacactactggcccaggctaccttctccatctggtttttgtttttgtttttttttcccccatgcttttgtttggctgctgtaatttttaagtatttgagtttgaacagattagctctggggggagggggtttccacaatgtgagggggaaccaagaaaattttaaatacagtgtattttccagcttcctgtctttacaccaaaataaagtattgacacaagagatctcttcctgccaaggtttttagttcattgccagtttagtctttttgacccatgtgtaattaatttttctcaacccaaagtaagattgagtcccctttgagatgcattagagcagtccaacccagaatggcacacactgctctgctgtagcatcatgtcagggcttcctggactcagtacacctctcagtttgtcttttaaaaaacagctgaatctttactacctatttagttctccttgttaaagaaacaggggtgggaataaaatggatttaggacacccagtttgaattgcagtttttttttttctgacacatggccaggctgtggtgccagcttaatggagtaggctgtccttggcacttgcatgtgtgaaaggagggttttgcctcttcttgagcatggcttgagttggtaaggaaagctgtaactcacgaagccctgagacctgctacccctaagatcgagcttgttttcagtgactggcttgagtcataggaggaggagtctggtacagctgcaggagagcagggccatctgaagcggtagcattgccaccatctccctctcatctagagcagttttcttatgccttggtttgagctgaatttgatgtgaattcttttgctgcttaataaagtgacctctaggtgcattagaatgcgaaggcaaatagttgcaataaatcacctgcacaagcattgtgaaaaaaaaaaaaaaaaaa

SEQ ID NO: 856 - DNA, 10590 bp, Homo sapiens
gggcagtcgtttcctgtcgctgcttggtaacaatggggaagataatggctgcctgagcaacgtctccgagcaggcgctgggctagaggcgggtctcaaccagctactcattggaggcgggcttgagagcggcggccagggaggtgcggagcagcctcggcggcggcggccgaaccaaccgagtcggatcctgaccctaaaacctagtattttccacttgttcatcaatatggaaaactcagattccaatgacaaaggaagtggtgatcagtctgcagcacagcgcagaagtcagatggaccgattggatcgagaagaagctttctatcaatttgtaaataacctgagtgaagaagattataggcttatgagagataacaatttgctaggcaccccaggtgaaagtactgaggaagagttgctgagacgactacagcaaattaaagaaggcccaccaccgcaaaactcagatgaaaatagaggaggagactcttcagatgatgtgtctaatggtgactctataatagactggcttaactctgtcagacaaactggaaatacaacaagaagtgggcaaagaggaaaccaatcttggagagcagtgagtcggactaatccaaacagtggtgatttcagattcagtttagagataaatgttaaccgtaataatgggagccaaaattcagagaatgaaaatgagccatctgcaagacgttctagtggagaaaatgtggaaaacaacagccaaaggcaagtggaaaacccacgatctgaatcaacatctgcaaggccatctagatcagaacgaaattcaactgaagcgttaacagaggtcccacctaccagaggtcagaggagggcaagaagcaggagcccagaccatcggagaaccagagcaagagctgaaagaagtaggtcacctctgcatccaatgagtgaaattccacgaagatctcatcatagtatctcatctcagacttttgaacatcctttggtaaatgagacggagggaagttctagaacccggcaccatgtgacattgaggcagcaaatatctgggcctgagttgctaagtagaggtctttttgcagcttctggaacaagaaatgcttctcaaggagcaggttcttcagacacagctgccagtggtgaatctacaggatcaggacagagacctccaaccatagtccttgatcttcaagtaagaagagttcgtcctggagaatatcggcagagagatagcatagccagcagaactcggtctaggtctcagacaccaaacaacactgtcacctatgaaagtgaacgaggaggttttaggcgtacattttcacgttctgagcgggcaggtgtgagaacctatgtcagtaccatcagaattcccattcgtagaatcttaaatactggtttaagtgagactacatctgttgcaattcagaccatgttaaggcagataatgacaggttttggtgagttaagctattttatgtacagtgatagcgactcagagcctactggctcagtctcaaatcgaaatatggaaagggcagagtcacggagtggaagaggaggttctggtggtggtagtagttctggttccagttcgagttccagttccagttcgagttccagttccagttcaagttccagttccagtcctagttccagttccggtggtgaaagttcagaaactagctcagatttatttgaaggcagtaatgaaggaagctcatcatcaggctcatcaggtgccaggcgagagggtcgacatagggccccagtcacatttgatgaaagtggctctttgcccttccttagcctggctcagtttttcctcttaaatgaggatgatgatgaccaacctagaggactcaccaaagaacagattgacaacttggcaatgagaagttttggtgaaaatgatgcattaaaaacctgtagtgtttgcattacagaatatacagaaggcaacaaacttcgtaaactaccttgttcccatgagtaccatgtccactgcatcgatcgctggttatctgagaattctacctgtcctatttgtcgcagagcagtcttagcttctggtaacagagaaagtgttgtgtaattaagatctgaactctcagctatgtagctgatatagtgatgggcaaacaggaatcacttgcttttatgtccactttttgagtggtacttaaatgtaaagtaacaacctgaattgagtcattgctttctgaaggaatcattgtcctttctccagtttttgttccagaataaaaggaaatattttaaaagccacgttataggacctaaaaatctgatttccgtaccagttaaattggtagcatcactgttactgataatttatcatatacacttgtcaatttttcctttgttatcttaaaagatctgccttagcaatggctcctttttcatgttgatctttaaattttcccacaccataagagaggagcaaaggaaattaccagtttagactaagttacagtatgtgtttcataagtgattaaagctatatcattcccagttattagttaacacaaattcagccacattctgagtattgtttgttcacctttcagacttggtgatactggacatgtcagtgtaaataacactaaggttaggatcttctaagtgtataactgtctcctaagcccatcactgtggcacactgtagagtgagcttatagtttaattgagatatttatcttgtggaaatattaaaaagcctatgcttgtgtaagtgaaaaaaaatcacattcatttgtttaaaaatgtaaagctattttgtagaggctcagtacttttccaatgcactgttgtatgaatgcattaaaaattgtaaagtaccatgcttagaactgagaaaactgctttttgtgagccaacatagtaacaaacacaccaaacaaagtacaaagctgcttttgtaagtgtgtagatgtcaagagcagaacatatctataatatttaatgtgtgaacagctactgtgacatgcaaaggaaaggacagtgcagaattaaaccgtgttgaagaccagtggaaattgtataatttaacttggatttaggcaggaagtgaaatatgggaggagtaaagaaaactgaagaatttaaagttttcctgaagacagtaataatgcagacacaaactggtttcatatggtgagagcagccacagcagcagcttgacctggtattctacctgagtagatgaagcagaagatcagcaagtttggcagagttttggtttaagaaaaacaaaccactactacctagcacaagttaaatttacaagtctgctcctcaaaaatgaaaaaatggaggaaagagactataaaaccacttttagcatatgaattgcagttggtacacatgtgtgtgttaataggaaagtctcgaatttgtgttgtttttgagatttgtcatttaaggtaccagtgcacacttgatcatatttcattactatctctaacacagtcctaacatctcaaatttaaagaccagttgaagattaagggatttttatcctttgttgaaagtcatgttgggttatttgaaattcaaattttaattgtgctgcccatatatgaaaatgagactgctgactcgctatctatggacatgcactttatgttggtttcttagtagtaagagtaacttcatgataaccccagtcttcttgcctaatttcttttttgagactagctggggttaggattagaatgactatggagcagatatttgttcttctgggaaaagctttaacaggccaaaatagggattgaacttgtccttggcctttatcaaagcaagctagctacccagacgtagtcaaatactctacaaaataaacaagtctgctttaggaattgtctgggtaccttcactgttaccaacttagctgtaaagattatttcaaagctcactcttccatgatttcttctggctttcaatcctatctaagtatcaaggaaattaacttgtaaatatggtagttgtttactaaggatatgtactgctcttgcaaggaaataatgtccaaacaaagcttcacttattttttttaatataagcagatttcactgtttatggcgcttatgtaatacattttatctttttaaaaatttgtccgtgtaaaagtcaggattcctttatatttgtgagcctccttttctcctttcctaaggatgtaatctacagttttcagatctgcagggtagtcttgattggctaaaaacaaatcaattttcttcttggcataaagtgtttcattattataggggtgttcattttaaatagtttaaaaacaattgcagcacattctaagcataagagaaagttattgacaacaggtaccttcctaatctcccaagacgtacttactcatttgtgaagtattaaagtaagaggtaactcaagcagaatgctggctatgaatgtagatattgaagctattcataaacactggaaatagaattttaagcttttagccttcagtggaatgcacatattggacatgtgcatgtgaacacctttttcagtagcactcacggatttccattcgattgtatagaatgaatacaagtgttttagtggaatttgctacttaatttttaatcttgcgatgtccgtgattattacatgcttactagtgttgtggacattgaagacaaggtcattcgtaggtgtcagattacaatggagaacaaaaatcgttttccccccacccacatccaaacaccattctcgagggagcatttcttgcaaaacaccttacatttcattttctatctttgcactttttcttaagtacagaaaagttgtctttaagacctagtttgaacttcatgcagtaagaggaacaaggataaacaatgttgggagttcacattgttcagagcataaggaaaagtaccaaaacccaaattttcttgaatatttcagatgtttttaaaaactcacttctagtctgaaacatttgaattgttttaactctgagcagctgacaaagttgaggtttttttgttttgttttgttttgttttgtttttttgagacagagtcttacttggttgcccaggatgaagtgcaatggagcgatctcggctcactgcaacctctgcctcctgggttcaagcaattctcctgtctcagcctctcgagtagctgggattacaggcgcatgccaccacacctggctagtttttatatttttagtagagatggggacttcaccgtgttggccaggctggtcttgaactcctgacctcaagtgatgtgcctgcctcggcctccgaaaatgctgggattacaggcgtgagccaccatgtccagccaaagttgaggtttattagtactattagaaacaaaattgagcaagttaagttaaaagtttgctgactttgtatcaacactatagaagatgagccaccttgttaatttggaatatttgctctgaaaagaacatgttagttacaccttaatggtgttaatggaggtggggattgagaaaagtgttcacattagtgttggaatgtaggtaattgtacagtttataagacctttagcaccaggaaataaaatatgtgtgtgtacacacacagtttttaaaaacgattggaattcatccaaaccttaagattaggaaactgattggctgtaagtgttgcctcaagtaatgtgtcccccgccccataacatgtcttttctgtgccaagtatcctctcctagtgtcagtgtctcaaattatatttatgaagggttatcacataatatgctttgtatttaactacctgcttcccaggcgtccatgacatgaaatgggtgaagcatcagccatgactttcggtcagttcccaaaatacccaaatgatagggaggtaaagattgcaaaattcctcttaaaaggccatttttacagcttgctaaaatacagtggcaccttatggttgttaatattttttcttttaaagatggagaatgtttttattcttccccttttctcctttgttcttttgcgaacaaaaaaaattataatctgccttatttgattttttttttaagttttaccttacaggcttccctgtcacatgttttaccatattaagtacatagaagccatgtttgcagggcacttttattctcctagtcttataagactatgctaattgttactttctgaagtattctgtaccttagtatgcaagattgttaaggcacatgttaaagtgtcaggtgtgtttttttccctttaattcttcagtatgtttatattcaataacagtattgtaattcattgagttaactagtaaattgtgtgcttttgaaaaaacatgaaaaatgtaaattgacagcatacttcatttggaaaaaagtaaaagatccgaggaactagtatgtcacttatttatttttattttattttattttttactttttgagacagggtcttgctctgtcacccaggctggagtgcagtggcatggtcacagctcactgcagccttgacttcctgggctcaggtgattctcccacctcagccttccaagtagctgggactacaggcatgcaccacattgcctggctaattttttgtggagatggggtttcgccatgttgtccaggctgttcttgaactcctgggctcaggcaatttgcctgcctcattctcccaaagtgctgggattataggcgtgagccactgcgcccagccttacttatttttaaatcagattttttaatcaactaaaacagctatgagttaagtacctgccctgcaaaaatttttagaaaaagttttaggattatgaaattaagaattattttccttaactggaacagttctaaaatttatctgatacttctctaacaagtgagtgatctcatgtaaccccagtttgtatcttaaaggctgcagcatagaattgagctgtataacagtgttagaactgtcaagtgataatcacagaacagtttgtatcggttttataattctcatgtcttgatcagatctgaaggaaataggcataccctccaacattctaaaaattatttatttttattaggatttgtttattaaagttccacgagctgctttatggtcagttgggctgagtagtagatatcttaaagacatgcagtgaaagtgaaccctgtcatatcatggtgcctctttcaaggttcctctgtaagttcctcatcttgcagaattatttcaataccaaggtatggttgaaccagctgtccagccttaactctatttagtgccccattactaatgttcttttaactggtttgtatgtgttttaactgtccagtgtttggattttacctcttgatagctccatttgtccctggtgctgcttttaaggatgtagggccatgtgatcaggtatcaagttgagtaggtacgcagttggcctggtgatgtatctgtgcctgttttatcttctcccaggaagagctgctttggtatagttgtttacttggattcatacaaagaacagggcagcaatcttggaaagctttctgaagcttataagaacctgaaggggtttggagggggaacagtaacaaaggctgcctttatgtctttggtcacaaagcacatagatgtatgttctgtaaagactaaagtgattgttataccagggcttcctgaccttcgggagagactcaaaaaagcagagaggagcacaaagtgaagttaatttggttggcttgctttatctggtttctcattttctttcaatttaaacctgaacataacacccttctccgatacctatccagcagactcctggttgggaagccctgtattaaattttgagaatgtacacagttttcttttgtacagtgctttacaactgctaaaagttaacttgtttaaagcaaaacaagaccttgaaaggtcaatcatattaaagctggtttgattattaatagttatcttttaggaagaagcttttttccctatgtaagatgtcatactgcagatttaaaatatagactatcaataaaatgcatgaagtgatcatttgtgcttgatcatctctccttgggtttttctttaaaaaggggaatctgctataaaggttctgttgcttcaaaccaatgtcaaatagacttgatttttagagtcatggaattacagtgcaaccttgatttttattcccctcactgctatgagtgtgggcaggtactggtttatatgttataacttccgttttatctgtgttgtgtagttgaatggcttaatcgttgagtggtaaaataaaagattatattccaatacaagaatcctggaaagatttatgtgaatgacattttaagtaggcgcatctttgctgtttcttgtattctcgccattgctctgaccactcccttgcttgccctgtatatatacaaaaacttgtaggtgtgcacgtgtgcttgtacttctgtcttccatttctatcttaatctcttaaacatattgcttaagccactaagatgtccttgtttcaagtaaatcgtcacattgtgacacctggtgtattgtattatagtttcatttcctctggtgcctgcagagctatctgtcattggcatcataactcggtttctcaggatagttttgatgtagtcagctcttcaactcatgaccttcccaaggttttaagtttagtgtcattcatgattttattatttgaaactcaataccaccatcaaaaagttagtgctctagacaatgaagccaaagcacaggcatcttaggtcagtgaaaaggatccagacataaattagccaggtgtggtggtacacagctgtggtcccagctacttgggaggctgaggtggtagaatcacttgagcccgggaggtcaaggctgcagtgagccatgatcatgctgatgcactccagcctgggttacagagcaaaaccttgtctcaaaaaaacccccagatacctagaagaaaggattcgataaatctgggtggattataaactgaactcttaatggtcattttaaaaaataagaaagcaagggtccagtttctttgaggtctttgaatttagacaagatttaactataaggccttgcatggattactaactataattaaattagctaaacttttctggttgctgtcaggcattgtattaagtattctatataaattatttaatcatcacagtgactgtgaggtgaaagtataccacccattttataggtaatgcagctgagatacagatgtttggtaatttgcccaggtcacatagtaagtagcagattatttgcaatcatctttgatgcagtcatcttccttgtgctcttaatcccactactatatgacttctaatttgtttcttagtatttatcccaagccctagactagattgcttatgaggtgtgatttcttaggaaaaacatcagttttggctggtttgccaagaaaaaaaaaggccaaattggtttttgtttatttttttgtttgtttgagatggattctcgccctgtcgcccaggctggagtgcaatggtgcgatcttggctcactgcaacctctgcctctgggttcaaacgattctcctgcctcagcctcccgagtagctgggattacaggcgcccgccaccacgcccagctaatttttctatttttagtagagacagggtttcaccatgttggccaggctggtcttgaacccctgatcccatgatctgcccgtctcggcctcccacagtggtggtattacaggcgtgagccaccacgcccggccgcaaattgttttttgtttttttgttttttggaggattaatggtaatatactgtaaattcagtaaagcactgggcattaccagatacaccttagcactatgaataacatgaactatcattttagcagtttaagtgtaccttgtaatcagccctagggcaaacggtatcaaggtgttttatttccagaagtctcaaaatagactggaataaaaatttggtgaattcatcaacacagacaatgggtccacgtcttgcagctacagctgctgcagctactcctgctgtccgcaccgttccacagtataaatatgctgcgggagtttgcaatcctcagcaacatcttaatgcacagccacaagttacagtgcaacagcctgctattcatgtacaaggtcaggaacctttgactgtttccatgttggcatctgcccctcaagagcaaaagcaaatgttgggtgaatggctgtttcctcttattcaagccatgcaccctactcttgccggtaaaatcactggcgtgttgttggagattgataattcagaacttcttcatatgctcaagtctccagagtcactccattctaaggttgatgaagctgtagctgtactacaagcccaccaagctaaagagactgcccagaaagcagttaacagtgccaccggtgttccaactgtttaaaattgatcagggaccacgaaaagaaacttgtgcttcaccaaagaaaaatatctaaacatcgaaaaacttaaatatggaaaaaaatatcaaaatataaaagaaggaaactgaaaaaaaaaaaaaaaaaaaaaaaaa

SEQ ID NO: 857 - DNA, 2965 bp, Homo sapiens
ggatgaggcctcgccctcgcctctttagtaggtcgggtgagtgtagtgtgcagggaagagacgcgtcagcgccagggccaggcccgcccgggggcagcccggcagccgaatcttgggctactctgtcccaacagccggagcagatcagaccgaccggccctgcccgctcggtcccgcgccctccagaccctacggtctccgtttctaggggcacatggttagcggcaggcgcccacagccaatccactttgccagcctgccccttcctctgccaagagcagcttcttcagccgcgctccagttccgcagacgcctgccccaccctgctcttcccttccagggaagacggatcacgcggccaagaacgagactcgcaaactgggcatttctccgagccgggctagagcaagtagcgagactccgcgtgagagtgggaaagagccttaacaggcaaccatgttgcccagtgggttttctgtgcctttgggtgcggaccaatgaggcgcgtggggcgggacttccgcttcgcctaggtgttgtcgtccctgctagtactccgggctgtgggggtcggtgcggatattcagtcatgaaatcagggtagggacttctcccgcagcgacgcggctggcaagactgtttgtgttgcgggggccggacttcaagagagaaagagagagtgggcagacatcgaagccaaacagcagtatcccggaagcactcatgcaactttggtggcggccactcagttttctctgccagtgtctggtgattttacaacgagatgctgctctccatagggatgctcatgctgtcagccacacaagtctacaccatcttgactgtccagctctttgcattcttaaacctactgcctgtagaagcagacattttagcatataactttgaaaatgcatctcagacatttgatgacctccctgcaagatttggttatagacttccagctgaaggtttaaagggttttttgattaactcaaaaccagagaatgcctgtgaacccatagtgcctccaccagtaaaagacaattcatctggcactttcatcgtgttaattagaagacttgattgtaattttgatataaaggttttaaatgcacagagagcaggatacaaggcagccatagttcacaatgttgattctgatgacctcattagcatgggatccaacgacattgaggtactaaagaaaattgacattccatctgtctttattggtgaatcatcagctaattctctgaaagatgaattcacatatgaaaaagggggccaccttatcttagttccagaatttagtcttcctttggaatactacctaattcccttccttatcatagtgggcatctgtctcatcttgatagtcattttcatgatcacaaaatttgtccaggatagacatagagctagaagaaacagacttcgtaaagatcaacttaagaaacttcctgtacataaattcaagaaaggagatgagtatgatgtatgtgccatttgtttggatgagtatgaagatggagacaaactcagaatccttccctgttcccatgcttatcactgcaagtgtgtagacccttggctaactaaaaccaaaaaaacctgtccagtgtgcaagcaaaaagttgttccttctcaaggcgattcagactctgacacagacagtagtcaagaagaaaatgaagtgacagaacatacccctttactgagacctttagcttctgtcagtgcccagtcatttggggctttatcggaatcccgctcacatcagaacatgacagaatcttcagactatgaggaagacgacaatgaagatactgacagtagtgatgcagaaaatgaaattaatgaacatgatgtcgtggtccagttgcagcctaatggtgaacgggattacaacatagcaaatactgtttgactttcagaagatgattggtttatttccctttaaaatgattaggtatatactgtaatttgattttttgctcccttcaaagatttctgtagaaataacttattttttagtattctacagtttaatcaaattactgaaacaggacttttgatctggtatttatctgccaagaatatacttcattcactaataatagactggtgctgtaactcaagcatcaattcagctcttcttttggaatgaaagtatagccaaaacataaaaaaaaaaaaatcctcagtatagcttgcaattaagacctagatcacagtatttaagtgttttgcgttttatacatgaggtcagtgctacagccacctagcatgaactaacccagcttccacctccataaagttacctagagttgttgagttggaatatgttctggcatttacctgacctgccaatcattagggagaggcaacaaggtaattcagcctttcctcctatcagcacaaagaaactcaaagctgttttttccctttctgttccaaagcagtcttatcctgacaggagcggtctatactagtgcagatttcaacacttttttttaacgttttaattactatagtgttatgtagagatttgattgagcagctaatgtttctgaactttacttactaattttcagtgtccttaagggttctgtagtgttatcaaagcaaaaagaaaatgctgcataaaaataccaaacttcagcaactgttaatactcagatcatatacctcttaataaatagcatcttatgctaattagccctgctaaactatgtacagaggaaactgttcaagtattggatttgaaagtaagtgacttatgtttaacagaactaatgatgtattgaaacactgtattatgaaaagctaaattatacatcattgtaactatgtagaaagtgtagactaatgtataatcaaaatgctaaggatttttatatggccttgtatgaggggagtttgaatgttaataaacatgttttccactttaagatccagtaaa

SEQ ID NO: 858 - DNA, 2195 bp, Homo sapiens
gggtggcgccaaggaaggaggagaaaaggcggccgagaaaaggaggagggcaaggggaagaggaagggcgagggaggagcctgaggagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagcttctgccgccactgcctggaggccctgtggggcgcccgcgacgcccgccgctgggcctgccccacttgccgccagggcgccgcgcagcagccgcacctgcggaagaacacgctactgcaggacctggccgacaagtaccgccgcgccgcacgcgagatacaggcgggctccgaccctgcccactgcccctgcccgggctccagttccctctccagcgcggccgcgaggccccggcgccgcccggaactgcagcgggtggcagtagagaagagcatcacagaagttgctcaggagctgacagagctggtggaacatcttgtagacattgtcagaagcctgcagaatcagaggcccctatcagaatctggaccagacaacgaactgagcatcctgggcaaggctttttcttctggggtggatctttccatggcttctccaaagctggtgacttccgacacagctgcagggaaaatcagagatattctccatgacctagaagaaattcaggaaaaattacaagaaagcgtcacctggaaagaggctcctgaagcacaaatgcagggagaactcctggaagccccgtcttcctcctcatgcccattgcctgaccagagccaccctgcactcaggagagcttctcggtttgctcagtgggccatccatccaacctttaacttgaagagcctttcctgcagcctggaggtgtccaaggattcccgtacagtgactgtgtctcaccgcccacaaccctatcgctggagctgtgagaggttttctaccagccaggtcttatgttcccaggccctgtcttctggaaagcattactgggaagtggacactaggaattgcagccactgggcagttggggtggcttcctgggagatgagccgcgaccaggtcctgggaaggactatggactcttgttgtgtggaatggaaggggactagccagctctctgcatggcacatggtcaaggaaactgtccttggctcagacagacctggggtggtgggcatctggctgaaccttgaggagggaaagcttgccttctattcagtggacaatcaggagaagcttctgtatgagtgtaccatctctgcctcctctcctttgtaccctgccttctggctgtatggcttacatcctggaaattacctgataataaagcaagtaaaggtgtaaggtttcctaagggattacaacacagtggtttcctggtctctctccctgtcatcaatcagggtagtaacttgacttaagaataccactttttagaaaaattacgatagagatgggatctcactaggttgcccaggctggtgtcgaattcctggtctcaagcagtcctcccacctcagcctcccaaggtgctgggattacaggtgtgagccaccacacctggccaagaataccacttttgaagttaatccttttgtgtgatacaggatgaacttgggatgtttgaaccctggacattccaaataaagaataggcccctgcctggctcctgggagataacctctaagccattagaatatcttgcctgataagagtgtttttgtttacctgtgggccttgggccatgcagtatcagcttgaccttgcaaggtcaagctgaggagactaagttagccatgtgggcagtgaagcatgccaatgtgatcaatccctagtaaaagccctggacacctaggcatgggtgagctactctggttggtaatactctgtgcacacatcattgtagccacacatcattgctgggagaattaagcattatcctgaagactctgccaggagaggataattggaagttctcttggaccttaccttatgtgcctttcttcattgctgattttaatctgtatcctttcactgtaataaactgtaactatgagtgcaaaaaaaaaaaaaaaaaaaaaaaaaaaaaaaaaaaaaaaaaaaa

SEQ ID NO: 859 - DNA, 3321 bp, Homo sapiens
gctgcgggctactgggcctgcgctgccgggctttgggttctgggcctctgccgctctctggccctaagtgctgagctgccgggaacggcagcttctgacgctgggccattggacgctgcggaaccaggcttcttcactttgagtttccgccgcgaagcgccagtccgggccgaggagggagcctttactacttctccctggtttcattcatgttctgaggagggtgtgagaaggaaccatggatcccacagccttggtggaagccattgtggaagaagtggcctgtcccatctgtatgaccttcctgagggagcccatgagcattgactgtggccacagcttctgccacagctgtctctctggactctgggagatcccaggagaatcccagaactggggttacacctgtcccctctgtcgagctcctgtccagccaaggaacctgcggcctaattggcagctggccaatgttgtagaaaaagtccgtctgctaaggctacatccaggaatggggctgaagggtgacctgtgtgagcgccatggggaaaagctgaagatgttctgcaaagaggatgtcttgataatgtgtgaggcctgcagccagtccccagagcatgaggcccacagtgttgtgccaatggaggatgttgcctgggagtacaagtgggaacttcatgaggccctcgaacatctgaagaaagagcaagaagaggcctggaagcttgaagttggtgaaaggaaacgaactgccacctggaagatacaggtggaaacccgaaaacagagtattgtatgggagtttgaaaaataccagcgattactagagaaaaagcagccaccacatcggcagctgggggcagaggtagcagcagctctggccagcctacagcgggaggcagcggagaccatgcagaaactggagttgaaccatagcgagctcatccagcagagccaggtcctgtggaggatgattgcagagttgaaagagaggtcgcagaggcctgtccgctggatgttgcaggatattcaggaagtgttaaacaggagcaaatcttggagcttgcagcagccagaaccaatctccctggagttgaagacagattgccgtgtgctggggctaagagagatcctgaagacttatgcagctgatgtgcgcttggatccagatactgcttactcccgtctcatcgtgtctgaggacagaaaacgtgtgcactatggagacaccaaccagaaactgccagacaatcctgagagattttaccgctataatatcgtcctgggaagccagtgcatctcctcaggccggcactactgggaggtggaggtgggagacaggtctgagtggggcctgggagtatgtaagcaaaatgtagaccggaaggaggtggtctacttatccccccactatggattctgggtgataaggctgaggaagggaaatgagtaccgagcaggcaccgatgagtacccaatcctgtccttgccggtccctcctcgccgggtgggaatcttcgtggattatgaggcccatgacatttctttctacaatgtgactgactgtggctcccacatcttcactttcccccgctatcccttccctgggcgcctcctgccctattttagtccttgctacagcattggaaccaacaacactgctcctctggccatctgctccctggatggggaggactaagaaagctaccaccctaaccacagaggcttggaattgggcctggcccccatggggcttggaggaccgagccactgacaggtatcccctgaaactgagctgagcccagtatccaaggattcctctgtctgatcctttggtctttgctaccaggctgaagtctgtcatgaaaccacttattttaaaaagcagaggcccagtcaaatgagcattgcatcccatgagggaagcacgacagggctgatggtgaggatcagagcagttctaaggtgactcgttggggtaaggatcaggactttgtccatgtagtagccaaccaccctcttccctgattcccgtccggtgtcacagttcagtcagtgaggatgatgaagtagatacagtcttcaggacaccattagatgggctttcccaataggccaaaaaaatgctgcgcatacccagagctggttgttgtgctgaggccagtcagaggatgcttcccctgaggtttgctataactaagcaacctttatgtgactctcaccttctgacctcctggcaagagaaattcagtgcagcagggggacacagacctgcccaagccaccccactgccgttccctctctgagcacaagctgggcaaatcactgtcccttggactccaggagaccagtgtcctagtcttgccttttttctctaagtggcaggatcagaaaacctgcgagctttagtttgtattttcactttatgaatgaggaaactgaaatggccttaagggagcaagttatttctttttttttgacacggagtctcactctgttgcccaggctggagtgcagtggcacgatctcggctcactgcaggctctgcctcctgggttcacgccattctcctgcctcagcttcccgagtagctgggactacaggcgcccaccacgacgcctggctcatttttttgtatttttagtagagacggagtttcaccatgttagctaggatggtctcgatctcctgacctcatgatccgccctcctcagcctcccacagtgctgggattagaggcatgagccactgcgcccggcccctggagcaagttatttcttacaaagctgctgaaggtaagattatcaaaattataaagcatttttcacactcaagtgaaacaaggttgacaaactcacttcgcaggtcacatgcctatacatcacttattatatttgggtctgaaacttctcacatgtttgggaggttttatgtgtcctcattgggaaaatgggtgtaattcagcataaaacctcatatgattgtcctgcctcatggagctgttgtatagatcccagatccatcccatgatttgttcctgtctgaggcatagaggcaggcaagccgtggattttgcacatggtgactttcccactgtgccatgatacagtctgcatcttatagcagtgcctttgtctcagggcctctgctggcagtctagaccttttgggcagaaaggagcttcaaatggctgtgataaggaatattaaaaattgtgtttctactttaattgtattggctgttcatgtatgtaggagttaaaataggccaaactggagaaataaacgcattctgtccaccatgaaaaaaaaaaaaaaaaaaaaa

SEQ ID NO: 860 - DNA, 3144 bp, Homo sapiens
gccggcggtcgcgccagcgggatccgcctggctcagctgacagctcccgagaacggaagaggcggcgcgccggttgagcagggcgtctctaggcctggtcggctggcggcgatggcaggattttcataatatatgtagtatgagttccacatcttggcctcttacccagcttcagcagtctcagctccaccagttagagaataaatgggatttgcatgaactccactctgagctgaaatacagactgcggtgttaatatccttttcttctgattgttattaacaggtccttatgtcgtcagaagatcgagaagctcaggaggatgaattgctggccctggcaagtatttacgatggagatgaatttagaaaagcagagtctgtccaaggtggagaaaccaggatctatttggatttgccacagaatttcaagatatttgtgagcggcaattcaaatgagtgtctccagaatagtggctttgaatacaccatttgctttctgcctccacttgtgctgaactttgaactgccaccagattatccatcctcttccccaccttcattcacacttagtggcaaatggctgtcaccaactcagctatctgctctatgcaagcacttagacaacctatgggaagaacaccgtggcagcgtggtcctgtttgcctggatgcaatttcttaaggaagagaccctagcatacttgaatattgtctctccttttgagctcaagattggttctcagaaaaaagtgcagagaaggacagctcaagcttctcccaacacagagctagattttggaggagctgctggatctgatgtagaccaagaggaaattgtggatgagagagcagtgcaggatgtggaatcactgtcaaatctgatccaggaaatcttggactttgatcaagctcagcagataaaatgctttaatagtaaattgttcctgtgcagtatctgtttctgtgagaagctgggtagtgaatgcatgtacttcttggagtgcaggcatgtgtactgcaaagcctgtctgaaggactactttgaaatccagatcagagatggccaggttcaatgcctcaactgcccagaaccaaagtgcccttcggtggccactcctggtcaggtcaaagagttagtggaagcagagttatttgcccgttatgaccgccttctcctccagtcctccttggacctgatggcagatgtggtgtactgcccccggccgtgctgccagctgcctgtgatgcaggaacctggctgcaccatgggtatctgctccagctgcaattttgccttctgtactttgtgcaggttgacctaccatggggtctccccatgtaaggtgactgcagagaaattaatggacttacgaaatgaatacctgcaagcggatgaggctaataaaagacttttggatcaaaggtatggtaagagagtgattcagaaggcactggaagagatggaaagtaaggagtggctagagaagaactcaaagagctgcccatgttgtggaactcccatagagaaattagacggatgtaacaagatgacatgtactggctgtatgcaatatttctgttggatttgcatgggttctctctctagagcaaacccttacaaacatttcaatgaccctggttcaccatgttttaaccggctgttttatgctgtggatgttgacgacgatatttgggaagatgaggtagaagactagttaactactgctcaagatatggaagtggattgtttttccctaatcttccgtcaagtacacaaagtaactttgcgggatatttagggtactattcattcactcttcctgcgtagaagatatggaagaacgaggtttatattttcatgtggtactactgaagaaggtgcattgatacatttttaaatgtaagttgagaaaaatttataagccaaaggttcagaaaattaaactacagaatattaaatattataatgtgcccaaagctctgaatagttaaaaattaaatatttattttcttccccaagctttaggtaaggagaagaggggtcaagagttaaacttagagaccctttgtctctgagaagcatccttctaagacattctgttggagttccctcagtactattccttacaactggagtgggtagaagccttatgaaaattatactgagaacctgatctcgtttactccatgttaatcacattcctaccaacctaaatttctgccaagtcagttctctttggaggaagcccattactccgtaactgactggatggtccagtgtcattttgatctgcttttcagaatggaaatttataatataaatatatgttttaataccacaaacactgtggggcacttgatatttattagtggtgtatatggtccactggtttcaggccaaatctagaatttagtgatactggctcagaagaatttaagttctattcagccttcctgggtgttagaacctagattcaaaatggcttgtctttgctacttttgttccacattctctctctttacctttgccctaccttctgtttgtaaggatgattttaatattaattccaggaacacatgtttttatttcctctgctggaataggagaaagcttaatatattcccaagctgaatgttcttgaattatatctgcatttaccactgtatatgcatatagtgacagtataacctgtctatactacagtagttccagtcctaactttctgaattatttttaaagatcttctctaacaagctatgggaatttggcttcatactctttctttgcaacagcagtgttctgggtgataattttgaattgatacctgttcctttttctgggttttgttggctttttgaaaaattgtctttccttatcattggtgggaggcttggtagcaaagtaacattttttggaaaagaggacagaaaaattgaactacagcttgagaacgtattctttttttcctactttgttattgcaaattgaggaatcacttttaactgttttaggtgtgtgtgtccagagtgagcaaggattatgtttttggattgtcaaagaggatgcttagtcttaaaataaaaataaatttaaaaatcatcttataattagaaaaaaaaaaaaaaaaaaaaaaaaaaaaaaa

SEQ ID NO: 861 - DNA, 5740 bp, Homo sapiens
gagcctcccgcgtgcccggcctctgtgcgcgctcgcgccccgcccgcgcagccgcttctccccgcgcgggctctcggcaggcgggaggcggcagggctggcattgcagtgcgggccgtgcgggctgcgcgggcgcggggaggcgcgggcggcaaactgcgggcacccggcaccccgcagccagtaccgggcggaggcgtcagagccgcgcaccgcggacgagcaggcccaggcatccagtaccctgctgactctgacatgcccccagcctcccccagctctgcagggagccctggtgccagagaccttctcccatttctccctatgggtgcctgacctgagggcagagacatctgagtgtgtataagcacagcaggacaccaggacctggcctgaagacatttcctctcctcccctctggatttctcagagactgttctgcgatgaccacaacaaggtaccggcccacctgggacctggccctcgacccgctggtgtcttgcaagctctgtcttggggagtacccagtggagcagatgacaaccatagcccagtgccaatgcatcttctgtactctgtgcctgaaacagtatgttgagctcttgatcaaagaaggattagaaactgcaattagctgcccagatgctgcctgccctaaacagggccacctacaggagaacgagattgagtgcatggttgcagctgaaattatgcaaagatataaaaagctacaatttgaaagagaggtgctgtttgatccctgtcggacttggtgcccggcgtccacctgccaagctgtgtgtcagctccaggacgtggggctgcagaccccccagccagtgcagtgcaaagcctgccgtatggaattctgctccacctgcaaagccagctggcaccctggccagggctgcccggagaccatgccgatcaccttcctccccggggagaccagtgctgctttcaaaatggaagaagatgacgcgcccatcaagcgctgccccaagtgcaaagtctacatcgagcgagacgaaggctgcgcgcagatgatgtgcaagaactgcaagcacgccttctgctggtactgcctggagtctctggacgatgatttccttctgatacactacgataagggaccctgccggaacaagctgggccactcccgggcatctgtgatctggcatcggacacaggttgtgggcatttttgcaggatttgggctgctgctcttggtggcctcacctttcctactcctggccactccctttgtactttgctgcaagtgcaagtgcagtaaaggtgacgacgacccgttacccacctagaggaagcgcgatgctggaacacatccctgcctccgggaagtgtggctctcccccaaccctccccaccgtccccccttcactaaacatctttcttgccttatgtgccccattgagcttcacagtgtcaggctggacgccgtgatttcagggacctatgtcacaatgttcgctgaggccccaggtgtggtggggaggggaggcaggtgtgggtagcgcacatccccacagatcaatctctgcagatgacagggaggtgctgtgagaagtgcaccaggcagctttctctctgtggtagactaggcatgtctggggatggcctaagagactttctgctccttggcttctagatggcaccatgttgtcagagaagtcttttaaggactgccactctcttcagacagaatctgattattccagcttgagagaagcactctgtttatgacaactgtttttattactaatggcatttagtaaaatcctttttagaaggtattttttttccaactgagtagtgaaaatcaacaaggtgcatataaaccatcctatgcctttcttgaaatgtgcattttaagaagttatagttaaacgacttttcaggagatttagaaagccttatgcactctttgtgtttttcttgaaacttgctgtagtaactttttgaacgctgtaagctgtgtactgttataagtgtgcttcctatattgttgcatttccttgataatattgacgtgtttaaaggaacatctcatctccattagatttgccttttgttgttttctctctttggtgattcagctcagctcatgggcctcatcccttctctcccaggtagcagaaaacgctttttattgtattcaatcccactgctttgctcggcaatggttctcctccgaattgctgccgtctggcctctggcctcagtcttcagatagacagtaagaagaaagcagcctcattgatccgcagatgtaggggcctcttggcagaggctggaggactctgggggctagggaagagcctgccagattttcacatttttaaaatgttctagtcattttgagaaatcatatatcttacacagttccaagtcctgttgctaaccgttttgctcttgttggggaaaagaacctcccatttcacttcgttttaacgtggggattttaccacttgatcttttacagggctgtctgtgaccatttccatggcagcaggatgcagggattaataaggacacatacacattattccaccaattgactttgaaaagtggagaaagtgtattctttaaagagaatttacttctaaaagccacaggtgcttttacaaagcaaactgcattgaatttaaaacttctaaaaataacaggcaaatattgtagctatattacagtgggattttaaaaatcttgttaaacattctataaagaagtaaaacaaaatccttttatctcagttatttgcccatcacaagcacatttttaaaatgttgctttgtgtgtgtttgacttctgcatttgagtatcagtctcaggtcctagtttactttccctggttggaaatttatttcttatttcctaacattgaattcgttagaaaaaacagcgtcacctcactcttcacctgtcatgttgattttccttatgaacccgaagccatttagaaaatccctgtgtgtcaaaattacattcaaaaagctctccttgtaattgcaagtttagtaactcagtaagaacatgcctgcgactccctttctggatggaacctgggctgtggctctctgtcgtttgtggtgctgtgatggtgtctactgttagaatagcttttctggaggtgggtggcaactccacgcgggagtcattggctgggcttgagccctcagcctgtgatatgtggatgcagctgtccagccactgccctttaacatgcccagcacacatgggaggcctgtggccctgtgtccagtggcccacaggacacgcctccaccatatgctcatccttcctgcctgaaattgctgctgcccatcgcatgagcccacacagtagcacccccgtccttaggatgagagtcagagcctttggaaaggctgcatccccagggctagagctcagatgaccttatttctagagggacaggctgttctgttggaagagtctctggcccagtcatgcacatctgtagccccagccatccttgtgccttcacctctgatgtgtttcacaagcacgtagttcaacccagatagggaccacagagattctggggccagccaggggcagtcaaattggcacctactggctctgactttttgtatgaagcatgcctcagtttcctcattttgatctagatataaaattaaaattgtccatttcctatataaataccagcaagatcactctgagatacataaactcgcatttccttctgttttagtaaggagtgccagacttatctttgatgggaatacagtatgaaccctgcttgatgtaaaatggaaatagcacacaggcagatggccctgggtttggactttgatcttgccatcattccccagtaaaacctggggagttctgcgttgagtggacggacttattcctgtgaagcggcataatttgtctccattgaaaaatggcattcactcttacagatggtgttcactgcaagccccagaagcatatggcatgtgttcactaagaggcctttaatcctggggagtaaggggcgaaggcccttagacaaccatggctgctgtactgccgcccagggtgggtggccagtgaggactggccttagcccagtggacctgtggcttctctgaggcccttgagtaactgaccacatttggaggttttgctggaaatgcctgacctctcagtctggctctgctgtgtagtccatagcccagccagatgagcttgcagcctcataggaggtcagcaccttgcaaagatgcagtcaccatagatgtccacgtagcagagactgacttaggatctgagataaagcatcggattgcaggaataactgtccaaattagttcttcctcctcaactcataggagtagctgtggacagaggaaccaacatctgccacctctggcattttctttctttttttttctttttgagacggagtttcgcttttgtcccccaagctggagtacaatgacaggatctcggctcactgcaagctctgcctcccgggttcaagcgattctcctgcctcagcctcccaagtagctgggattacaggcacccaccacctcacccagctaatttttgtattttcagtagagacggggtttcaccatgttggccaggctactctcaaactcctgacctcaggtgatctgcccacctcggcttcccaaagtgctggaattacaggcctgagccaccccacccggcctattttcttaaaggggaacaaatgatcttgacaacatattattccataaaaccagtttagggcacaggccagttcctgattagaacacaggacctgtgggagggactatcagagatgcaaaaattacttcaagatgagtttattgttttcatttgtattgcaaaagttagaagtcattttacaaattaaaaaaacatttttttcttggtagtctttaaaaattaggggattgaaaggatccaggatgggctttgtgtgtgtgtctcagattctcatttattagtgagcacacctgtgtatatatataaatcacaaggagatcatcaagggaaaacattttgcatgtgtaaagcttcatgaagttctctttaaaaaataccaaagcttgtttatttctgataattaacctaagcccttatgaaaataaacaaaatgaagggattatgacaggtattaccaaaaacaccaaaaggaacaaaggggcctgcgttaaaacctaattgctaatgcttcacaactaggagagcatgccgtcttgatgtttaaaaaacccagggtctccacccttcctttgatttgtgcaattctgtcttccacagttccggagccttcagtgaggggtagctacatgccccatgcctgccctttctttccttctttgctcactttactatgggtgtattttaatcttgtataaaaatatgcatgaatgagtcatgcacatgtatacgttatgtatttgacaagtggtggtgaaacaaaatcaaaacagatttgatttgtgtttttgaaatgtcagtacattttgtgccactaacactgtgatgtataaaagagctgtttgaatgccttttaatgttgtgttttgtactctggaatcatatggaaaaagtttgatttgtaatttcaatacatattttaaatgtattgtgtcttacgtagtttgtccccccctttagcagggattcctttttaaagctattttggctggaatacaggtgacttttgtaaa

SEQ ID NO: 862 - DNA, 2163 bp, Homo sapiens
ctaatcttccagttgccccctattgactttaaaccaaagctttgattcatgaccactgggatccagccagcgggggatttcttttcctgatggactgtacccaggatctcacatttgcttaagcagctcccacaattgggttcttataaaaggacacggaagagacaagctcagttttctctgaaggagaaggactgcacttagaactgcattttggcgacctctgaaattcagtactgcagtgaatgagcttctgatcttgaggtgaacttaacaaaattatttttggaaaaatcgttgtgggaaccattaaaagaactccaggaaacatgaattctggaatcttacaggtctttcagggggaactcatctgccccctgtgcatgaactacttcatagacccggtcaccatagactgtgggcacagcttttgcaggccttgtttctacctcaactggcaagacatcccatttcttgtccagtgctctgaatgcacaaagtcaaccgagcagataaacctcaaaaccaacattcatttgaagaagatggcttctcttgccagaaaagtcagtctctggctattcctgagctctgaggagcaaatgtgtggcactcacagggagacaaagaagatattctgtgaagtggacaggagcctgctctgtttgctgtgctccagctctcaggagcaccggtatcacagacaccgtcccattgagtgggctgctgaggaacaccgggagaagcttttacagaaaatgcagtctttgtgggaaaaagcttgtgaaaatcacagaaacctgaatgtggaaaccaccagaaccagatgctggaaggattatgtgaatttaaggctagaagcaattagagctgagtatcagaagatgcctgcatttcatcatgaagaagaaaaacataatttggagatgctgaaaaagaaggggaaagaaatttttcatcgacttcatttaagtaaagccaaaatggctcataggatggagattttaagaggaatgtatgaggagctgaacgaaatgtgccataaaccagatgtggagctacttcaggcttttggagacatattacacaggagtgagtccgtgctgctgcacatgccccagcctctgaatccagagctcagtgcagggcccatcactggactgagggacaggctcaaccaattccgagtgcatattactctgcatcatgaagaagccaacaatgatatctttctgtatgaaattttgagaagcatgtgtattggatgtgaccatcaagatgtaccctatttcactgcaacacctagaagttttcttgcatggggtgttcagactttcacctcgggcaaatattactgggaggtccatgtaggggactcctggaattgggcttttggtgtctgtaatatgtatcggaaagagaagaatcagaatgagaagatagatggaaaggcgggactctttcttcttgggtgtgttaagaatgacattcaatgcagtctctttaccacctccccacttatgctgcaatatatcccaaaacctaccagccgagtaggattattcctggattgtgaggctaagactgtgagctttgttgatgttaatcaaagctccctaatatacaccatccctaattgctctttctcacctcctctcaggcctatcttttgctgtattcacttctgaccagagacaaatcagaaatgtgttcacatgctgtgggaacccctttatcccaggaagtcctcttccttgtgccttaacatacaggacaaataggctctattttatgtcttgaattgccttctaatgttatcaaaactcatttattgtgttactattaaatatgctgaaaacgctaaaagtatacgtattggttctttattaaataatttttgaaaaatcattattcatgatcatggcatacagtatattctcttttttttctttatttatgactgtcactgagtgaaataatagatgacagacatgtctgaatgaagtaaaaatcaatggaagacagtcgggatcttttgcttcatgcaaaaaacttggagtgaagtctcaatgataactgggaaatgtttttcttcctctttatctaactatattacacttatccatcaggtttcattgtattaatctatcctttgaggtaata

SEQ ID NO: 863 - DNA, 3551 bp, Homo sapiens
gcgcctccgcccctcgctcgctcgctccttcccgccctccccgcagcgccggccgagccggcttcccctcagtctctcatgaatattgagcggcccctgttgtatttcccgagctccattgcggaagctgaggctcgccatattgtgcggcggcgccggcgtccgcggcagctgataccagagtcttgctccggccgcggccagcggagccctgggctggggcaggagccgcaatgtctcaggctgtgcagacaaacggaactcaaccattaagcaaaacatgggaactcagtttatatgagttacaacgaacacctcaggaggcaataacagatggcttagaaattgtggtttcacctcgaagtctacacagtgaattaatgtgcccaatttgtttggatatgttgaagaacaccatgactacaaaggagtgtttacatcgtttttgtgcagactgcatcatcacagcccttagaagtggcaacaaagaatgtcctacctgtcggaaaaaactagtttccaaaagatcactaaggccagacccaaactttgatgcactcatcagcaaaatttatccaagtcgtgatgagtatgaagctcatcaagagagagtattagccaggatcaacaagcacaataatcagcaagcactcagtcacagcattgaggaaggactgaagatacaggccatgaacagactgcagcgaggcaagaaacaacagattgaaaatggtagtggagcagaagataatggtgacagttcacactgcagtaatgcatccacacatagcaatcaggaagcaggccctagtaacaaacggaccaaaacatctgatgattctgggctagagcttgataataacaatgcagcaatggcaattgatccagtaatggatggtgctagtgaaattgaattagtattcaggcctcatcccacacttatggaaaaagatgacagtgcacagacgagatacataaagacttctggtaacgccactgttgatcacttatccaagtatctggctgtgaggttagctttagaagaacttcgaagcaaaggtgaatcaaaccagatgaaccttgatacagccagtgagaagcagtataccatttatatagcaacagccagtggccagttcactgtattaaatggctctttttctttggaattggtcagtgagaaatactggaaagtgaacaaacccatggaactttattacgcacctacaaaggagcacaaatgagcctttaaaaaccaattctgagactgaacttttttatagcctatttctttaatattaaagatgtactggcattacttttatggacagatcttggatatgttgttcaattttctttctgagccagactagtttacgctattcaaatcttttcccctttatttaagatttcctttttggaagggactgcaattattcagtatttttttctttcctttaaaaaaatatatctgaagtttcttgtgtttttttttttccccacaaagtgtgtttccacttggagcaccattttgacccaggaatttttcatagtttctgtattcttataagattcagttggctgtccttttcctgctcccctcaaaagatttttagtcatacagaatgttaaatattatgtattctgactttttttttcccccggagtcttgtatatttatagttttctatataaactgtagtatcttcatgaagacccaaggctcaaatttactgtccttaaaaacaattctcataggattattcttttcatggtattttcttccataatatctcattttaaaaagaagttctttatgaacttagtgtccattgtcatgcaatgtttttttttttccattctttttccctgtaattttggaatttctggtcctgggaagaatcaaacaaaatcttaagttctatgagaacttggttcattgacatattctgctgaagaaagaaaaattaaattggtagtaaaatatagtcttcaagtatacgtttgagagtgcttttttttgtattagttctgctgtcacttcatttcctgtattatatgtgatgtttttccccattaaaataccagagataatggagatattttgcactttagccttgatgaaaagtacaagatatgttcaaagcttccctaatttttttcttatttgtagccacataagtttcaagaataacatggcacacagaacaatggaaaaaagtttgtttccattggaaaattatatcattttgggttgccacatcagtttataaatttggcgctcttttaattacactctgtagaaggttaatagagcttgagccctgctttaatatgtagtgaaagataattctgtagaaaaacgtcagccagtagggtaaagtcattctactgttcttaatttttatattgaggaacaatattgggtgtttgggagccagaaagctttgttgacagatcagaaataagattgacttgggtgttatatttcatctctctccagactctaggtatatttccaactttatatatcacagtatttaaaaagacatgtttgcattgagaaattaaccctaaagggttttcaatagggtgtagacctccagtacctttgtaactaaagtctgtctagtcattgtaaatatttatctgtcagttttgacagattggggccagcttgatgttttaaatcttcagcccggtatgaaaacttaaaggtatatattcaattttttaccattttatggaaaatatttaaaatctgtttttacagggttttttttttttttttttttttgtaatctgtgccatgaaatttgaaaaccaccaaaaatcaagggaacttttatatattcaattccttttctggtgtaatgttaaagttgtatagattattaatgcatgcccactgaatataaccctggttttgtgataaaactgcttagattttgttgatgacattagattagtagttgcattaaataactaaattcccattgtgattaattgaaattttgtctttaagcagagagttatttgtgactataagctttgtgcttagagaatgtatgtgtttttatctgtcagtatgggaggatataaactgcatcattagtgaaattattggttgtgtaatcctttgtgaaatataattctaggtatttgatagggtattgagtgtattttgtgtgtgtgtggatgtgtgttttggggtacggggagaggcgatgctattggccatcactaccaaccagggtttcaaaaagtattacctaagtaatttcttttatcactatctcaactgaggaagaaaaggctcaccacaagtggtgtgaaggctttgggtacttagttctaaatttttttatggtaacatatacatagccacatttacagttttaaccattttaaggcatgtaattcagtggggttaggtacattcacaatgttgtgtaatgatcaccgctgtctacttgtaaaactttttcatcaccccaaacagaaactctgtgtgcaattaaagtaatgcatttctcttcttcttaacccct

SEQ ID NO: 864 - DNA, 3374 bp, Homo sapiens
gcggccgccgcccccgggctggggtttgggggaccgagccgctccgggttcgggatgctgaggagaccgcgggcccgcgccagcctcccacacacacacactctcccggcgcctcggccggccgggcgcggtgtgcaggggtgaggcggtgtctccaggctgaggagggacgcggaggagggtccggcgcggccccgggactggagggtgagtccctcacaaagggcggagcggggctgtcacctggagatcacggagggaagttcatccatgagctcggatttcccacattacaacttcaggatgcctaatattggattccagaatctgcctctcaacatatatattgtggtttttggtactgctatatttgtcttcatccttagtttactcttctgttgctacttgattaggctaagacatcaagcacacaaagaattttatgcctacaaacaggttatattaaaagagaaagtaaaagaattgaatttacatgagctctgtgcagtgtgcctagaagacttcaagcctcgagatgagttggggatttgcccatgtaagcacgccttccacagaaagtgccttattaagtggctggaggttcgtaaagtgtgtcccctgtgcaacatgccagttctacagctggcccagttgcacagtaagcaggaccgtggaccccctcaggggccccttcctggggcagagaacattgtatagcttaccgcaaggatcagactgttgctggacacgacgtctgtgtggagccaggaggaacacatgtggtgtctgtatggctgctctctacctaggacaccagctgccacttcttttgcctcatgaagaactcttgggccagccaaactgggaacctaggtgtctgggtcttgtgacaaccaaagcactttgacactaccccctgccgagagaagaggagtggatgagcctgcgggtttgcctcaagaaacttcatgagggtctcttactaactccattacactctctctcctggagcctcatctccatgtcaagcaggagggtaaagaagggaactaagagcaggtctttcaagccacacccccacctgcggatggatgggtttctctgtaggccatgcaggcctttgtcgcagcaaaccttcccagcagcccttgagccaagtaaaaccagcacaaccagccaccagtggttggtgaggcagtgcccacaaggctcatgttgtatgcctttgataaggccatcttggctttgagtagcagtgttcctcgtcacccatttccccctcaggattacaacacctgctatcaaatcatctaagctgaaaacatgagatgcgcttggaaaggcctagtcagaagccatttcctcttatcatttccctctcctatgcaccagtaaggcccgtccagagccccagcagggagtgggccctgagtccacactgtccctgagtgatccaggaggctgcccacatccccacatgtgcactgtggttccagtgtagctgctgtgagcccactgccactgcctcagaagggagccactgtgaacctctcgagtggctccaaagagcagtggctttttgagaatggcccatacttctggcccggctggatgaagggaatgccgaccctttggcctctccccctccttccatctcttctctctcttgccctatctctctttctacttcagaaaaaaaaaaaaaaaaaaaaaaaagcctgtcattcactttttaacactttatcccaaataagatccctgtgtaattctgaagctggtgatccacttggaattgtagatagtttcaggaagctcctgcagggctgtccaccgttggtgtgtgcctcagtatttggacttccgaaactgaaagtgaaagtgtctttataggagagaaacgcatgctgctctttggctctttctgtccaacttttctagaaatgactcaaagtccattaagatttgtgaatattgtataaattagctatggaaagtagcaggtcagatggaaaattcttttccacagccctgctctccgcctccctccatcttaggagcgcctgcctcaattcctcgtcaactgctttgctccactccatcccacaggtgtgagtgggggaagtttttcattaggaatacagtctgcgtgacatggagaatggatggagggagctttgctactctgctcttggcatgactccaggatttttttctggaatccaacctctgtcctcttaggagaaggaacctgtccttggttcagatggctgggcatgaggaggaaaatttccattagtgtagaacagtgctggacagaatccggtttggaaaattacaaatccagttggtcaaaataggccatttcctatgtgtgacctattcgtggtatgccaactggactgcttcctaaacaggacgaggaaagtgaggaatatttttatatgaaagccttagcctgtctggcacccatgaaaaaaactatttatgcactcctactttcaccgtctttttgcattctctatttgtagcacaacagagttgaatgccacaaaacaccccgtttatagtgagctgttttcagtgaccaatatcagaaggaggcttgcttctggactagcctcactaattgccagcagccaccattttccatggaatggccttgggacagatgtcacctctgttatggggctctaataggaaagagaatgttttttcccttcctatgatcaatactgcaaattattgctgctcacagcttttataggattctcccaactgaaagttgcaggctttttctgtccctgtgcatcagtactaacaaaagacagcctcaccaagtctgtatatttgaacagaggcaagttaattcatccccccgtgtcagagccacaggcatgttgagggggttgatacgtagcactggaccagggcgcaaagcccagatagttccagccatgagaggagagcacaagaatgctctgcactctgcactcagcaccaccttgggtctgctttgcccagatgagggaccactaacaaccttctcagcacatgtgaatgtggactggttttaaaatgcattcattctgctaggattgggctggaagctggaacagtgagagtactttttctgctcctagtcatctccctttctcagcgtgacatcctcctgcagcaagcctagtatcactagcagtagttcctgcgactcttagcaacacaacccgaatatttgctccctgcatctgggtcctccaccaggatgggcctgcgcatctgcattgctgtacagacaaacaggccttttaatttacatcctcctttaattctcattaaaatcgcagggtttttgtttgaaaaaaaaaaaaaaaaaa

SEQ ID NO: 865 - DNA, 5666 bp, Homo sapiens
atgctccgagcgcggcgcccccgacgcggcgctcggctcggctcgggcatttccgcctctttgttttaaactccggacgggcttttttctcctcctcttgggggggacccagagggagcggcgccccctcccccctccggcgcggaccccgcgtgcgccttgctcgcccgcagccccgagaccgcaggcgtcacaatgtagcagggaccccaggcgtcgtgctcagaaaatggaaaaagagccagggccggaaggagggtgcagaagcgagtccgcgtgcggagccaggaggcagcgtcgcgtgggagtgctggcctgaagcctccatgccccggcagagggacggacacgcggacgtctagcggagaagccaaagatgttgaccaggaagatcaagctgtgggacatcaacgcccacatcacctgccgcctgtgcagcgggtacctcatcgacgccaccacggtgaccgagtgtctgcacaccttctgcaggagctgcctggtgaagtacctggaggagaacaacacctgccccacctgcaggattgtgatccaccagagccaccccctgcagtacatcggtcatgacagaaccatgcaagatattgtttacaaattggtaccaggcctccaagaagcggaaatgagaaagcagagggagttctatcacaaattgggcatggaggtgccgggagacatcaagggggagacctgctctgcaaaacagcacttagattcccatcggaatggtgaaaccaaagcagacgacagttcaaacaaagaggccgcggaggagaagccggaggaggacaacgactaccaccgcagcgacgagcaggtgagcatctgcctggagtgtaacagcagcaaactgcgcgggctgaagcggaagtggatccgctgctcagcccaggcgaccgtcttgcatctgaagaagttcatcgccaaaaaactcaacctttcatcctttaacgagctggacattttatgcaacgaggagatcctgggcaaggaccacacactcaagttcgtggttgtcactaggtggagattcaagaaggcgccgctcctgctgcactacagacccaagatggacttgctgtgaatggtgccacacagcgcccacagactgggccctcgcacccttgggtgctcccggccgccgcgcttaagaacattgcctctgggtgtcatgtggaccagacttctgaatagagaatatttataacttttgtatgagagagaattcacactcaacaagacactaccagcaccacgtttacagaggatgaaaacacttcacagtctcccagagccgatcgtcctctcccccgccccaccccgtgcttcagccttgcagggagagtgatgctccaggcaacacggttctgagtcaccttctgacacgagctccctctgcttgctttccaggtcttgaaaatctgaattcacttcagtttagtttatgaattttaggtttcatgataagcctcaagtgtagttggacttttattgaatccttcctaagttattgaaaaaatgtcttttcatggtgaatgacaatatttatgttgcctttagcttcttgaagatttagaagttatataaaaaattaatttaaaagcaaaccaaaagaggtttccattaacattatgatttaaccattgtatttaatttcccaccttatgaaacacaacagcagctccctgactggttcgcctttcattgtgtgaggtcggcacttggactcactcagaactgtcgctcacctgtggctgacacacccagccctggaaacggggccccagacgccacgtcgggatttctgacatgctcagcaggtagaccagaggccgtgtgaccagctcagtgctggtttacggaacaactcttacttttaaaaattacttgttcccccaaattgttgagtgccgccgtttggtttcctatgttttctttccctgttttgattttgctgaagggagaggtggtggtggttaggatcagagctctcctggcatccgtggggaggatttgctggtggtggcttcgggctcatgcccagacacactcactgccccgtctgtccaaggcctccccttcccctttgctggtgggaggagctcgtgtgctccttggccgcttactggaagggcgtttttcagagctgcagggacagggtgagcagctgaagggctaggagggaagccggcccccgctctgcagaagctgcatttcagctgaatctgtgtttcagcctcagttggttgcaccgttagcccctctcctcccggatggtcatgtttttgtcacattagagaataaacagccacacacacatttttttttttcctttaaaacagtaacttggaaatatgaaaaggccagaaggaggagcaagggctgttttctggagtggttgaggtgttgtcctgcagttgtcattgtcttctccaccgggctgttcccatttatttcctgtggaactgaatccctcctccctccactccttgggagcccaggtggtccttggccaccattcaggctttccaagaagccaaccaccttggagattttttttcttgaatttcgctgttttcttctgcttcctttagataaaaagcagctcaagagaccttatcttagggatgagaaaaacatgcatattaattccatctgagtgattgtcagtgtaaggccttttaaaacaaaagcaagttctttgttaggaattggtcaaaattcatctctttctttaagcccatcaactcccaggacggtttgagttactcagttacctaagcttgctattcatccaaatcattttctagagtcactgtataagggtctatgagtagctgtgtatgaataaatattacctgtctacctcaaaatacacatactgctgaagcattctgtacaaccgtgtgttatcacagtgcagttttaagtgtaacgttagaacttaggcattttcctgtgtggcggaataagaaaggattaaacagttacaagcctccaaattcaaataaaattaaatcacagttcagatgaaactgaatatcattgtaataatctcataatatatatttgtaactttgtagctatctttgaaatcacttgactttgcaatggtgctaagctgatagatttaaatacacagacgggcgagtggcgcccgtgtcgatgtcttcagccagtggtgaccctgcttttgtaaccgcgttaacctgacaaaacctcagcagcagaagtccctatttttctaggagttcatcgtgcagacagtcttcactacaggactcggccctggggcctctgcctctcgtctgaccttgcagccttagtcgttggaggctggagcgcaatggccctgccgtctgtggagcctctgggcggccttctttcctttctgtcaacctctcatttcacagaaaaaggctgaatttcattttttccagcatgaaagccaggatcggttagtggttggattctattggttttttttttttaaacagatggagttactgtgaagaagttttcacaactatttatgctggtaaaacaaatgctgttaaatcaccttatgcgtcgttttcaacagcagtggggctaattacccggaatacggtctcaccgatgcagttttcatggacatagaaaattcaaatagaatatataatattgaatttaagatttggggggttaaaaaagaaaacttaactttataaaattatttattctattttaagccttctatcatattttcccatccaattgtttggtttcagtggtccagctttatttacaggcatataaaatgaaattgtgagatgttttgcaagcttctttttactttgagtagcttttaatttgtatgtttttatgtggatgaagagcattttttatgcttttgtgcaataggttccaatatgcatttattagacatctgtttaaatggtaatgtagcatttattttgctaaattgaaagggaacatagatggaattccaaaatatgtacattcagctgtttggtttttcgtttttcattgttattattgtgagaatgctgttattggggttgtgtgtgagtgcccgtcagccagtgatgcctcgggccacgctgtggggccacctcagtcctgcctgggtcctggtgccttggaccccacgtgcttgtggccaggctgcccctgggcagggccatgtggcctcagaccacaagagcggagctgccctggcccaagcactgcagctgcctgcacccccgggcttcgcagccttgcttgttttctctgaacagcaacagaacagtgttcacagcgattcaaagggtggcattgggttggacgttctgggtacaagccaacctagtcccacgttgtacgtgaatgtttaatgtgctctcaaaacatggaaaataagtttagtgcacatagctaaatcacaaaacatccaatttctctgtttcctcaggaagtcattactgcgccaccacatcacatgaccttaacatgatcaatgtatttctctgccttgacatttaaatacataaattgagataagtagattagaaaatcattcaaatgataccataatttgtacgggacagggtgcgggcaatggccacgtggccaaggccctgcaggaacgcgccgaggtctccctcaccctccaggtgtccttcgcacccaacagtgcgtctgaggaacgagctgcagtttgagcgttcccctgagatgtgcgtagcctccgtgtaaatgtccactcccatggcttaattgcctatcagacgcattttcccagacgaaagcaatgttgggttggggaagacagtgcagccacccagcctttaccagcagcgtacggcagacgaaggcagtcgaggtgtggaggtgatcacgaagatacatgtgtttgactgtttaatttgaaagtttacattttttatgctttgtgttggtgtgtaatttttgtactcttggtggctagtttttgtcaaatcttttttggaatattgcttaaatgttttgattttatgatagtgaagcttgtattcagtgttttgccaattaatattatatgcttgtaataaaagcaaaagaaaagcttaagtgaaagtgtttctggctggaaatgtattacataaatcatttgtatgagcatgagagatgacttgctcatgggatgagcaatgctgtgggtattggatggaccactcaggcagcctggccgcacacacacacatgcatgctacatatgtgtacgctcagaccacatgcctgcacatatgtccacacaccagcccacggctcccttcctcaccccagccctccccactcccaggttaaccaatgtcccgatttgcttcaggcggcatttgtaaactgtcaccctgcttgcaaaccctcatttaaattggtccagcatttgctaccagagtttaggccacaaactttgtaaagctcagtttgtctccttgcagaaagaggttgctgcagtttggagctggttatgccaaggaaaatacggctaaaaaagaacttactgattcccataggtgtgtcaactgacaaatgaatgttccatctccctacgacaatttgctgcccctccccaaaaaaagcactatggccaaaatttcagtttttaaaggttaagtaaa

SEQ ID NO: 866 - DNA, 1434 bp, Homo sapiens
ggggagctatgaaccttaagattagaccactaactcgaatctaaatgagctgcccttgtctcctacaaaagaaaagttgggcaggtagggtattctaatgagggtttctctttctcttaagcaaatgatgatcaaagttaactgacaaactgtcacggaatctgccagacctcactctggccttgctgcttctctccagctcctgaacttttctttcttccatcatgctctgagcccattccttgaaaactaaaaggtccctgactcccagtctgcagccatcctgggcctgctgagctctgattcaagtgcctgcctctgccccttggtgggctgaagcttcatggaggaggagcttgccatccaacagggtcaactggagacaactctgaaggagcttcagaccctgaggaacatgcagaaggaagctattgctgctcacaaggaaaacaagctacatctgcagcaacatgtgtccatggagtttctaaagctgcatcagttcctgcacagcaaagaaaaggacattttaactgagctccgggaagaggggaaagccttgaatgaggagatggagttgaatctgagccagcttcaggagcaatgtctcttagccaaggatatgttggtgagcattcaggcaaagacggaacaacagaactccttcgactttctcaaagacatcacaactctcttacatagcttggagcaaggaatgaaggtgctggcaaccagagagcttatttccagaaagctgaacctgggccagtacaaaggtcctatccagtacatggtatggagggaaatgcaggacactctctgcccaggcctgtctccactaactctggaccctaaaacagctcacccaaatctggtgctctccaaaagccaaaccagcgtctggcatggtgacattaagaagataatgcctgatgatcctgagaggtttgactcaagtgtggctgtactgggctcaagaggcttcacctctggaaagtggtactgggaagtagaagtagcaaagaagacaaaatggacagttggagttgtcagagaatccatcattcggaagggcagctgtcctctaactcctgagcaaggattctggcttttaagactaaggaaccaaactgatctaaaggctctggatttgccttctttcagtctgacactgactaacaacctcgacaaggtgggcatatacctggattatgaaggaggacagttgtccttctacaatgctaaaaccatgactcacatttacaccttcagtaacactttcatggagaaactttatccctacttctgcccctgccttaatgatggtggagagaataaagaaccattgcacatcttacatccacagtaatgagtcataatattatacaaattcagagtgttattaaagaggtattgaaatatttaaaaaaaaaa

SEQ ID NO: 867 - DNA, 2947 bp, Homo sapiens
atggggggcggagccgaggcctccgaagcggaagtgggttgctgttgaggcggcggcatctttctcgaggagctctcctgggcggctgaagaaggagcttcttctccggagtgcgccggcggtggcgcctgcggacctaactagctccaggttaggccgagctttgcgggaaagcagcggacttgaaaatactggaaatctgtccggatccaaattattttgcaagccagatgagtaaccagagggcatgaaaggttgagaacatttgacttccctgcaaaccttggtatagatcacttccttttctgtaggaaaggaaaggcaccaaagagcacaatgagtacaagaaagcgtcgtggtggagcaataaattctagacaagctcagaagcgaactcgggaagcaacctccacccccgagatctccttggaagcagaacccatagaactcgtggaaactgctggagatgaaattgtggacctcacttgtgaatctttagagcctgtggtggttgatctgactcacaatgactctgttgtgattgttgacgaaagaagaagaccaaggaggaatgctaggaggctgccccaggaccatgctgacagctgtgtggtgagcagtgacgatgaggagttgtccagggacagagacgtatatgtgactacccatactcccagaaacgccagggatgagggcgctacaggcctcaggccctcaggtactgtcagttgtcccatctgcatggacggatactcagagatcgtgcagaatggacgtctcatcgtttccacagaatgcggccatgtcttctgtagccagtgcctccgtgattccctgaagaatgctaatacttgcccaacttgtaggaaaaagatcaaccacaaacggtaccaccccatttatatatgaagtattcagagccccccaggagagacggatggacagacagacagccaggttctccagtggtatctgcctccattttcctgagatcaaaaagactgtttcgaaaccaacatctgatatgtaaactgctcttttgtttccaaccccttccttttgttatctccagtttgatgctatggcgctggacccagggccctcccaggccatctctgttcctctggggtggtccagttctagagtgggagaaagggagtcaggcgcattgggaatcgtggttccagtctggttgcagaatctgcacatttgccaagaaattttccctgtttggaaagtttgccccagctttcccgggcacaccaccttttgtcccaagtgtctgccggtcgaccaatctgcctgccacacattgaccaagccagacccggttcacccagctcgaggatcccaggttgaagagtggccccttgaggccctggaaagaccaatcactggacttcttcccttgagagtcagaggtcacccgtgattctgcctgcaccttatcattgatctgcagtgatttctgcaaatcaagagaaactctgcagggcactcccctgtttcctaagaacgaaaaagtgcaataaaggccattcgttacctacttttcagcagcccacaagatgtagcactattagtgtccccctcagaggcttaatgttgcctgtggagcagtgcccatcccagcccgtttctgcccaccagttgttctcaggaaccttacccatgctccagcgtccttcacctggcacaggacatgcaagataaatagggcaggcacgtgtttgggtgtcctctcttttctgataaaatccatcccgtgtttgccacacgccctccagtcctcagttcccactgcctaacgtctgcccccgtgtagatactgagaggtggtggcagtaattgtggccttatcagccgctcagttccaggcttttgcccaggtcactgttgccccatgttcggagaacctggcccacctgtcttggctttctcatccttcccaacccagtgccgtttatttcagaagcttcctggccactgggcttggatgcttcgggcttctgactgctccataggttttgactggtgaaacaggggcccagatgacaacctctccttcgctccacaggtacgcgggagcctcaggttctctcaggggcagcaaagtggcccaagctgcccctgacagcacagggcctggggggtggctaacgagagaggccttacagtgccggcatgcctcctcttccactgtcgtccttcctcagagggcctcacgccaaacaaacggccttttcgtgtgaaacatcttcagggcgggaaaggggccacttctggctttgttagcaataactgaccttcagtttacccttctgaaggagcagggactcagcacagaattcactttagacggggctgaaggagtgtccctcctctatgtgaaaagaaaattgttttattcttcattctgactttttaactgtttggctcacttccagttagtttgaatgaaaataataattttctacttggagttgaagagggcagaatccgcagctctcatcattgtgatgtgtagcatgtctgccctctgactggacatcattgccattaactttcttctgggcatcacggcaatgtcacgatgcccagacttggagcaaggcaaccttggagtcagtccactcataaaatatggtaacacccattttaaaatttaagttttgtccttaaagacaacttcagtggttaattataaaagttgtgttacttcgtcctaaattaaattgatagaaagatttaaaaatgtgttttgtttctactattcagaaactgcgaactagggaaaggttggtatgaagaaatgtctttccttttttcaatgtacatagttcaactctttctttgttacatttaaactatatccatggatatcagtctgctttggactcctctgctagtgttacagatggaaataaaaccattaatttgaaccaaa

SEQ ID NO: 868 - DNA, 5639 bp, Homo sapiens
cttgcgcaggcgtagtgctcctgcttcctggccgagggcgggcgagcggagcctgctttcgcagcgatcgcgagcgtgtggcgattgcttctgtctgttatttagatatggaagctgaggggatgcacagaggcagccagaacctaggtcagggtctcgctcggtgctgaccgcccccggggtcgagtaggcgatgggggagcccggcttcttcgtcacaggagaccgcgccggtggccggagctggtgcctgcggcgggtggggatgagcgccgggtggctgctgctggaagatgggtgcgaggtgactgtaggacgaggatttggtgtcacataccaactggtatcaaaaatctgccccctgatgatttctcgaaaccactgtgttttgaagcagaatcctgagggccaatggacaattatggacaacaagagtctaaatggtgtttggctgaacagagcgcgtctggaacctttaagggtctattccattcatcagggagactacatccaacttggagtgcctctggaaaataaggagaatgcggagtatgaatatgaagttactgaagaagactgggagacaatatatccttgtctttccccaaagaatgaccaaatgatagaaaaaaataaggaattgagaactaaaaggaaattcagtttggatgaattagcaggtcctggagctgaaggcccctcaaatttgaaatccaaaataaataaagtgtcttgtgaatctggtcagccagtgaaatcacaggggaaaggtgaagtggccagtacaccctctgacaatttggatcctaagttgactgcccttgagccaagtaagaccacaggggctcccatttaccctggcttccccaaagtcacagaggttcatcatgagcagaaagcctcaaactcttcagcatctcagagaagcttacagatgtttaaggtgaccatgtccaggattctgaggctcaaaatacagatgcaggaaaaacatgaagccgttatgaatgtgaaaaagcagacccaaaaggggaactcaaagaaagttgtgcaaatggagcaggaacttcaggacttacagtcccagctgtgtgcagagcaggctcagcagcaggcaagagtggagcaactagagaagactttccaggaagaggaacagcatcttcagggtttggagatagcccaaggagaaaaggacctgaagcaacagctggcccaggctctgcaggagcattgggctctaatggaagagctaaatcgcagcaagaaggactttgaagcaatcattcaagccaagaacaaagaattagagcagaccaaggaagagaaggagaagatgcaagcacagaaggaagaagttcttagccacatgaatgatgtgctagagaatgagctccaatgtattatttgttcagaatacttcattgaggctgtcaccttgaactgtgcccacagtttctgctcctactgtatcaatgaatggatgaagcggaagatagaatgccccatttgtcggaaggacattaagtccaaaacgtactctttggttctggacaattgcattaataagatggtaaataatctgagctcagaagtgaaagaacgacgaattgttctcattagggaacgaaaagcaaagagattgttctgaagaccgtgctctaagggcatttgaaagactgccaggtagtgcgagcctgagatggtctggaggattctctctagccgtgactccgctgctctgaaggtcaactgagaagtcttgtgggacagagacttgagttaggaagccctcagtcacttgccttccacggtggccagccctgctgccatcattggctgaagcaccaccaggattcacggcacccaactgcttcagggtacttcgtagactctgcctcactacatgtcgaaagagttatttgagttctcttctgtttttttttaatttgttgttgttgttactgttttgatacctcggaaacacctccgttgacagttgttttggataggttgggtgtaccccatggctgcctctgaaggcagtgtctattttgagaggatggcttacctcttctttgtgaaaatactatctcatttcctggaaataaaatgtaaaacctgtcagttgctcagctgggctttggtgtatttaccttccttcccttcctgctcccagacagtctcacaagtaaacaccagcagctcatagattacaaccaagaaagtgactgtatcagatgatagacttcaagtgaatgtcagcctaagaggccaagctgcagatcgtggcaacagatgagctctgttaacctcctgactgtcgtgtttcctttttattacagaggtgggtcactgtttaccttgtttcaggggtgggagaaactcctttccttcagctggcatttgaatgtttccaaatctattttatctgacgtcatgaacacacaggcaatgattttatgacaacttgatgtgcttttttctttatttttcttttacattagaagttttctctcttttctccacctctcctttatttttaattttaattttaatttttgaaacaagatctgactctgttgcccaagctggagtacagtagtgcaatctcagctcactgcaacctccacctcccagactcaagccatcctcccacctcaacctcccaagtagctgggactacaggcatatgccatcacacccagctaatttttgtttttctgtagagacagggtttcaccatgttggccaggctggtctcaaattcctgaccttaagtgatccacctgcctaggcctctaaaatgctgggattacaggcgtgagccaccacgcccagcctataccccatgtattttcataaagggttggaaactattgattgccaactttttaaggatggtagggattttttctttgttgaatatactgtgaattttgggattctggagtccttagtcttcatttccattcttctgcccatgattactgatcaaaatactggtagagtcatggaggaagtaagttaaatgtggaaaaaatgctttaaaagtacttactataaccacatcataagaattctggaaaaatagagaacaaaaggaaaagattgttaccaccttgatttaataacttcttgtttccccatacatgtgttttgtttatagattgcatgggtatatgtcaatttttatatgttctgtgtttagtttacatattgtaattcatttttaagagagtacagacatacactttttgagtaggcaatatgttcacatagtttgaaattaaaggtacaaaatggcgtagaatgaaatgcctctcaccctttccccacagcgactacttcccactcagaggcaacaagtattacagttgcttgtatattcttccagagatctctgtctatacaagcaaaaacacatgtggtctttttccttgctttgcacaaatggtaaactgtacgctattctgaaccttgcttttttcagatatatgttggcaacagttccatgtcagtacatagtttcctttctttattacagctgcctgttttttcattgtgtatttgcaccatcatttacttttctggcttacttttgatagaaatctaggttggttcaaacctttttactcttaaaacaatgctgcagttaacacccttgtacatatatctttagagagaagatattttaaaaagaaatacctttttaaaaattattttattattttttaatagagactatgttgcctaggctggtcttgaaattctgggctaaagcaatcctaccaccttggcctcccaaagtgctgagattacaggcatgagccattgcacctggccaagaagagacatcttgacttgagcctgaagactatgtacagagactgacctcacagactgaccattccatcccacagctgctggacatagagtgatttgcagcccctcctttcagagtaccacatccctctcaagtgttccacaacatctaggaaagtgagctcttaaagacagactaaaaagagtaataaatcaatacaacaacattaaaagccagactagcggagtttgaatcttggccctgctgttagtaactgtgtgagccttgggcaagttactcagcctccttgtgtcttggttttggtttcttcatctctaagtaattatatctgtcattattgccctgatcacaaacaaaagcctgaatgtactatgtttaaaagacaaaccaaaaattaacccaaacttgcattatttgtctgagctacagaatgttctttccttggagagatatctgatattaaacatcatctgcattttacttgcctagaaaatacacggtaacttttctgccttgcagcatcaaactatagtacagctgagccccagtgctgtgcagtctgactctaattaaaggcaccttctttacagcagggctctggggaactggaaaagggggtttgtttcattatctggttttattaagcagatgaatgcagccagctatatgaagcactttgcagtgaatggcaggtgtcccatatctggttatgttaacctagaaagggctcactctacctctaggcatgtttcatcccaacaatcagactgtgccaaagcaggggactttgtcctttgtggattgcatagctggatacccatcatctgtttctctgattggaagctgctgttgtacagaaagacctgcatttcccccttgtctccagttctctcactactttttcctcctctgtgagtgaccatccaggcagtcaccataactgctggagtgtctgggattggtagctctctccaactgcctgcttgctctttacagcctctctctgtgactggaatctctccacctcatcgtatctaaggataacccagaaacatggggtgtcctaggtatgtttatctcgacactgaaccccctaggcttctgatgaatccagtgattagctaaatttgacatagaaagtaagaaggaatgtctactttgtattgtggtcctaatctaagatcaggagaatcctggaattgttatctgtctcttgctctgagatacagacttgttcataggtgtggggcctgattggaacaggatctgccattggtcacaataggtcaagggcttgttctgaaccctagttagcttcattcagagaaagaaacttcctacctggtcagctttttcagcttctccaacaaatgggagttgaggcagtaggagtgtggggttcttgggaagacgatggggccttgtattaaggagaaataatgaactatcttcttgattcttccattgagaaaagcatatgaatcctaggaaagggctcagcctgtgataggcattcaataaatactccaatgctgtcattcctttgtctacagcatccccaaacaatgtaccagtgatgggctacctgagctcatctagtcgccaagcagtatctcctgcttgctgctgctttactacattccagatgcccacctcatccaatttccagagccactatctctgctgtccactttccttcaggctctgtgaatacttcaacctgctgtgatttggggccgtttgtactctgcatgtattcaataaattcaattcagcaatagttaaaaaaaaa

SEQ ID NO: 869 - DNA, 10828 bp, Homo sapiens
ggtaccatagagttgctctgaaaacagaagatagagggagtctcggagctcgccatctccagcgatctctacattgggaaaaaacatggagtcagctccggcagcccccgaccccgccgccagcgagccaggcagcagcggcgcggacgcggccgccggctccagggagaccccgctgaaccaggaatccgcccgcaagagcgagccgcctgccccggtgcgcagacagagctattccagcaccagcagaggtatctcagtaacgaagaagacacatacatctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctcatgcatatgatttccattatgcctacagatatggaccctttttctgtcttgacttcttgatcattgacctctgtttacaacaggaggagggtactaaagtcggaggatttccttttcttgtagctcactgcccacagactttctacagagtcaccaatctgtcagtaacaacagagagtccagcaataatcggtgactggtgtgcatagcggaggttgcggcattactttgcacaactagctctttgtttcatgaaggaagtttttattttttcaccgattattgccagtccgcaggatggcatgaaaagggtccatagcagtagcaacaatagcattataatatattacagggtaaatgggcatgaagactatatatagctaaaagagatattgtttatatattgttttaagtaatataaaatgtagttactggtgtagcttttcctgttgaattgataaggcactttcattttgcacctttttctttaaattaaatgctagcgtgttcactgtcgtgtcgcatgtgcaccagaaacacaagtttaactgagaaggcttggaaggtacgttgggaggtatttatgctgctgtttacaaaattatttttaagagactggctggtcatatctagaaatcaccacgttggattttttttttaacatgtgaatttggaattagaaacggaactctccctaaattatactttgctttttggtaagtttaatgatagatgtgtttatgcttcatacaaagttgaatgattgattggcgtggtggacatataccatcatgctcattttttttttttaaagctttttaaaatgccacctcatggaggcgagggggaggagaagctcattttacacaattcagtagttaaatatggactcggtctcaacttggaattcttatgctttgagaacaaatcaacaaccagaatatttattggaatctagcttttattataagaaggacccaaagattatatcctgagcaaatgcacactccccatgtgaggacatgaagtatttactttgtgaatgtttatgttcttggtataatctaggaaccctatgagtttatctcagagtgaactaattctagatttgttgtcaatagatgctataattcaagaatgttgctctccatatttgaaaaacgatggataggagggtgagggaagcatacaatgttgaaccagtttctcttatttaaatattaaatactttaagcctttaaagtgaagttgatgctagctgcaaacatttactcttgtatttatcttcactaggaaactgtggactgtaatttattttattaaatatttagaagattatttggcttgtgtgttcaggtgagaaatactgagttgtttttgtttaatttcatggtttttttttttttaatgatccctagtgggggaaggggaaaggaatagtctgataaacagatgtgcatattttaaaaacaagtgaccttttgggaatgtaggcatttagacgatgattttagtcgcactaggggtgggattcaaactactggtcaaagaccattttgtacagaaaagggaacatctccgatgggtgttaaggtaggagtttccatgcagccctttatgtctgagaaatagtctcctctgccattggggtccctgcggaatcttctacaggaattgcagctcttcacgtcatgctaggttaccagcatgggcttcccagagcacttcactctgtttctaactccactgacttttctgacttgtttcttgagggacttggaaaaggggaaggtattattcacacagatgtgtgtatgaagcctaaataacatccaactttttttccaaaaacatagtaagagtttaaccataaatagaagagtaatattcctttaaatttcttacaggcatgtaaaattttatgtgtttatagagagatgctaactgtcagcatatagtatttatattggggcaagaagggttaaatcaaatctttaatttaagtaagcatagttcctttaaagatcagtagtatttatactctgaaaagagtaccaagcttagttcagttatttattcatccattttttttctattgtttctcctctggggggaaatggtgttttgtttttgtttgagttttgtgttttagttttttggttttggttttgttttgtttttttgtcattcagattcactaaatttggggatggttttattaaagtatattaacttctttttaaccaaagctttctgaatatgaccagcctcaggtgctagcgcattaaagagcaactaaacctaattccagtgtcgatttgtgaaataataaaagctaattgaatttctctaagggtgagagagaacataatgatgaacttaaaaagaaattccttttcccagaagggattctgcatgtacctacaaacaatcatgctctaaccacagtaatagtcatgccatggtgacattgcttttacggtaaaccaagataggtaatatgatgcttcttcccaggtgtttctgaaagaaaagcagcggtggagcttaagagccaagtccactgattgacataataggatggaattgtagacagagacatgctccatgaaacaaggaaacaactgactactatttggatctaagttgggatctgatgttaaacaataaattcagtttaaaaaaaatatggagctcagaaaaggatgtgaaaaactttgcattttcctttcttcattattacaaaaacacctatgtgatgacataaaatacttgggtgatatcagaacaattatccttaatagtttttataattaaagtttcctaaacttcagtctccaatagtcttttaaggattggaaccacatcactgtcagccccgctgctacaatgcctttgtacaatttttttacataaggcaaataaggcttttgtacaaagcctgaataccttctgttccaatggtgtccaaatggttattatattgtgaaaaacctggccttggtcacaatgcaaacaaaagtacagatgaaagtgctttttggacagtttgcaaattgtgttaaagctacggattttttttaaagtgttcagcatcttaacgtgtattaaagctatggatttttttttaaagtcttcagcatcctaattcaccctttctaacttaagaaaaacatgacttaagacactgcttctaagtttggttgttctttatagtgtggatacccagttatctgtgagcgtatgggggtgggctgagggtcaggtgaggaaggagtgtgtgtgtgtgtgtgtgtgtgtgtgtgtgtgtgtgtgatttgcatgtgtatgatgtgtgtgcgtcggaccgcttctaggctactaagtgtcaatggaaaagaaaatgtattcaaaatacttaaatcaaaactagaagatggggaaaaaaagatttattctatacaaagccttgtctggaccactttagagagacttctatttttttaacccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacagttctttgtgctgactggtgaaaaacaagggtaaataagcaccttataattgacttactgtgaatgacaatccatcttggtatcaacgatagaagccctatcattttggagttggggttaagagtcagaaacaatgtgctcagggatctcctaaaactcttaaaacagggtggccagtactactgggacaaattgtgttttttattattaataataatgataataatactatccctccaaggcacaagtgaactatatagaactgcgtgtgtgtaaactctttactctcgtctcattttgttgagtttagaacttgatgtgctcgtcagtcttgtgtttcaaaacactgaataacttccaaagcaaagttatgccagtgtgttcaaaagataaattaataatgtaccagcaaagagcatcattcaaagtatagtccttgcatattccagttaccatttctctaataattaaaatattcatgataaatatatatatagcatcatatgttaaaaactatttcaaattctacatattaaggatgaaaattttaaaatccagtaataagaggagagacctgcctatcagtacagtgatataggtaaaagatgaaatatgtttttaaaataccagcaattaactattgttttcatgggttctcctctagaagcaaaccaaaaattccttcatggaaaacaattcttacttctacatgtgtagtttatatctgatgcattacaagagctaatgtttaaagacaaaacaaaacctgcctgtatgacagcagcaactcgagccaacatttagtgttacatgttatatttttgaaataccgttttgttatcatattccacatattactttccataaagtcagagaagttcaatgtaattgttggctctgattcttccaccttgggatacacattcacaagaagatttatatattttcttactatgatagaggaacataatctgggaaaacttcccatgtctgtaagatgaaaaggatacctttaccatgttgtttttgataataaagaatatggaaaatggtagaaatctctcctctctatgtgtatttgtatatgtgtgtatacacacacacgttgacatttttacataacatgtgattgccacttcttataaagttatgatatagaaccccatgaaaacaactttatattatagatcaaataatgtgcccagaaacgcaattgcaacagtaaatcttgatctattggtaagagtctatgatacaggtcttcattctatccctaaacataatgttagtaaagaggttccatcagattgtattatagagaccttcctattgctatttatttttaagagatgagaagactgactagcaatgtctccacagtgcaattggtttcacttctgggtctgtctgtctgtttgtgtaggtgagatcagtgttgtcaggctctcagaataatttttaaaagaatccagaagcctgacttcacaccaagtagccatcctagatgggcgggggggatctccatgttcaaccaaaccctcagaacttagagcaataaatacattcagtcatttatttataaatgaatgacagaatattcaatccaaatagaaacaaccttttgtcagtgatgcaacataacatggagtcttatattgagaaagtgaatatgaatattttaaatagatgcctaggaaatctgtgtttgctgtttacatttaatgtactttgccacattagcagtaccacacttcttttactttcatccttctaagaactaatgaaagatagcttgctattagctttgacatgttgcacatgccattatgttgttctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatgatttcacaaaaaaaatccatatgtactgtatacatcttcctgaatccaaaattctcctgttatccacacagtttgaaatctcatattaaacagtggtaaatttttaaacattaggacattagctggctgcttctataaatgtacctgtattgtctgcctgctccttttgtggagatgtgtttttgtattggatgtttgggccaatgggaggcttcaagctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaataatctagccataactgaatgtcaagcaataaaacaaatgacttttgtgcatagacttaaaaaatacaaattttagacatctgcatgtaaatgcaatctcttgtttactgctttcttcaacttgagcaatcgattccttatttactattaacttaagaacttgtaacggcctgtaaacattttctctcttactcttctttcaaatttacctgtccctgcttttgagtcataatatttaatgttgttctgcacatctctatacagttaactttttggctttcattctgtatagataagaaaatgttatattataaacagcctactcagtgcaaatatttatctgtttatcaaatccacaatatgctgtataataccggttttactatataatctattttagacatagctgtttagaactagagtgtgctatttttgtgtttttctgatgtgtggtgctagacaagttacttttgtgaacaacaaaaattatcccttttattcctagacaataccacctttgggtcttgttaatttcactgagtataactatatatttgtatatatatacatatatatatatatctacctatgcccaactggcagctgtatcagagtgctggatttgggacatgcttttctctttaaatacataatatcattatataaattattctagagtgtatttaattaggataaaattacttccttagtatggatatttgacatctatagggtgaatttgtttataaatatggctatatggaaacttattagcatttactttatgtttgctacttggctttacagcatatctcctaagctgaaaaataatttgccaggccttcaagatcctaaagaaacttgtttaatggagtaatatacttttttttcttattaaggaattgtattactggcacctaacacagttgtattcttagctcctattatagataatgggcatttacataaaatatcctagatggcttgatggcagaataaacctttcccctcctacctgagtcatgagaaggatggagacgtcctctgccataacatgggccataaagcaaattcgacatgggatgttctgtttcagtatgacctcaaccagttccatgaactgagtgaaggaccttcattttcaaagttatttaataagtagcttaattaagcctttctacccattctcccaagatctactggcattattgaaaagcaaagtttatcaaatatctaactaaggatgtagttaaccttattaaatattgattagaattgttctgtaatattactgaatttgtaagatctttagcaaagatttttgagcaatttataaatgtagagcaaatgtttctgtttactgcactttttgtaactgaaggtgataaattctcaagccatgattattggcttccatgcactgcaatatttatccacaattctagacattttccatttttgtggaagagttgctgttaccttaattataaatgcaattgtgtggttaatgagagctaatgctagtagttaaccttttaaagtggattggctacagttgagggagaaatctcttttaatataaatcacatcattccttaactgcctctcttggaaagagattgaaaccttttttttaaagcacgatttagcatcctaagcttcctgagggtagagattgtatctttttgcgtctgcacaatggctagcacatgtcagcatttgacaattgttaaatgataacaagtgtgccccaattaaaacgtttttcctgggttgttttgttaaatttacaaagtaagccaagccttacggttaacattctcctctacaaccaagtattaaagccacatttaaaaagaccacatgaaatgctgattctaattgtgtgtaggtcttgaggattaagcacacaaatttcacaaacttctgtttgagtaaacaaactcagccttctgtaaatatacatgcaagtttggaaacagtaatactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccagctgtttattttattgagtcctgaatttaaaaaaaaaatattttgattcattttgtaaatacaagctgtacaaaaaagagagatttaatgttgtcttttaaatactccaattttcattctaatatgaatgttgttatattgtacttagaaactgtacctttaatattacattacctttattaaaagtgcattgaacacatcaattttagatgtgctttatgtactgttatcctataataaaacttcagcttctaatggaa

SEQ ID NO: 870 - DNA, 5967 bp, Homo sapiens
ctttgggcctcataaacaaccacagaaccacaagttgggtagcctggcagtgtcagaagtctgaacccagcatagtggtcagcaggcaggacgaatcacactgaatgcaaaccacagggtttcgcagcgtggtaaaagaaatcattgagtcccccgccttcagaagagggtgcattttcaggaggaagcgatggcttcagacagcatatttgagtcatttccttcgtacccacagtgcttcatgagagaatgcatacttggaatgaatccttctagagacgtccacgatgccagcacgagccgccgcttcacgccgccttccaccgcgctgagcccaggcaagatgagcgaggcgttgccgctgggcgccccggacgccggcgctgccctggccggcaagctgaggagcggcgaccgcagcatggtggaggtgctggccgaccacccgggcgagctggtgcgcaccgacagccccaacttcctctgctccgtgctgcctacgcactggcgctgcaacaagaccctgcccatcgctttcaaggtggtggccctaggggatgttccagatggcactctggtcactgtgatggctggcaatgatgaaaactactcggctgagctgagaaatgctaccgcagccatgaagaaccaggttgcaagatttaatgacctcaggtttgtcggtcgaagtggaagagggaaaagcttcactctgaccatcactgtcttcacaaacccaccgcaagtcgccacctaccacagagccatcaaaatcacagtggatgggccccgagaacctcgaagacatcggcagaaactagatgatcagaccaagcccgggagcttgtccttttccgagcggctcagtgaactggagcagctgcggcgcacagccatgagggtcagcccacaccacccagcccccacgcccaaccctcgtgcctccctgaaccactccactgcctttaaccctcagcctcagagtcagatgcaggatacaaggcagatccaaccatccccaccgtggtcctacgatcagtcctaccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctccgacccccgcatgcactatccaggcgccttcacctactccccgacgccggtcacctcgggcatcggcatcggcatgtcggccatgggctcggccacgcgctaccacacctacctgccgccgccctaccccggctcgtcgcaagcgcagggaggcccgttccaagccagctcgccctcctaccacctgtactacggcgcctcggccggctcctaccagttctccatggtgggcggcgagcgctcgccgccgcgcatcctgccgccctgcaccaacgcctccaccggctccgcgctgctcaaccccagcctcccgaaccagagcgacgtggtggaggccgagggcagccacagcaactcccccaccaacatggcgccctccgcgcgcctggaggaggccgtgtggaggccctactgaggcgccaggcctggcccggctgggccccgcgggccgccgccttcgcctccgggcgcgcgggcctcctgttcgcgacaagcccgccgggatcccgggccctgggcccggccaccgtcctggggccgagggcgcccgacggccaggatctcgctgtaggtcaggcccgcgcagcctcctgcgcccagaagcccacgccgccgccgtctgctggcgccccggccctcgcggaggtgtccgaggcgacgcacctcgagggtgtccgccggccccagcacccaggggacgcgctggaaagcaaacaggaagattcccggagggaaactgtgaatgcttctgatttagcaatgctgtgaataaaaagaaagattttatacccttgacttaactttttaaccaagttgtttattccaaagagtgtggaattttggttggggtggggggagaggagggatgcaactcgccctgtttggcatctaattcttatttttaatttttccgcaccttatcaattgcaaaatgcgtatttgcatttgggtggtttttatttttatatacgtttatataaatatatataaattgagcttgcttctttcttgctttgaccatggaaagaaatatgattcccttttctttaagttttatttaacttttcttttggacttttgggtagttgtttttttttgttttgttttgtttttttgagaaacagctacagctttgggtcatttttaactactgtattcccacaaggaatccccagatatttatgtatcttgatgttcagacatttatgtgttgataattttttaattatttaaatgtacttatattaagaaaaatatcaagtactacattttcttttgttcttgatagtagccaaagttaaatgtatcacattgaagaaggctagaaaaaaagaatgagtaatgtgatcgcttggttatccagaagtattgtttacattaaactccctttcatgttaatcaaacaagtgagtagctcacgcagcaacgtttttaataggatttttagacactgagggtcactccaaggatcagaagtatggaattttctgccaggctcaacaagggtctcatatctaacttcctccttaaaacagagaaggtcaatctagttccagagggttgaggcaggtgccaataattacatctttggagaggatttgatttctgcccagggatttgctcaccccaaggtcatctgataatttcacagatgctgtgtaacagaacacagccaaagtaaactgtgtaggggagccacatttacataggaaccaaatcaatgaatttaggggttacgattatagcaatttaagggcccaccagaagcaggcctcgaggagtcaatttgcctctgtgtgcctcagtggagacaagtgggaaaacatggtcccacctgtgcgagaccccctgtcctgtgctgctcactcaacaacatctttgtgttgctttcaccaggctgagaccctaccctatggggtatatgggcttttacctgtgcaccagtgtgacaggaaagattcatgtcactactgtccgtggctacaattcaaaggtatccaatgtcgctgtaaattttatggcactatttttattggaggatttggtcagaatgcagttgttgtacaactcataaatactaactgctgattttgacacatgtgtgctccaaatgatctggtggttatttaacgtacctcttaaaattcgttgaaacgatttcaggtcaactctgaagagtatttgaaagcaggacttcagaacagtgtttgatttttattttataaatttaagcattcaaattaggcaaatctttggctgcaggcagcaaaaacagctggacttatttaaaacaacttgtttttgagttttcttatatatatattgattatttgttttacacacatgcagtagcactttggtaagagttaaagagtaaagcagcttatgttgtcaggtcgttcttatctagagaagagctatagcagatctcggacaaactcagaatatattcactttcatttttgacaggattccctccacaactcagtttcatatattattccgtattacatttttgcagctaaattaccataaaatgtcagcaaatgtaaaaatttaatttctgaaaagcaccattagcccatttcccccaaattaaacgtaaatgttttttttcagcacatgttaccatgtctgacctgcaaaaatgctggagaaaaatgaaggaaaaaattatgtttttcagtttaattctgttaactgaagatattccaactcaaaaccagcctcatgctctgattagataatcttttacattgaacctttactctcaaagccatgtgtggagggggcttgtcactattgtaggctcactggattggtcatttagagtttcacagactcttaccagcatatatagtatttaattgtttcaaaaaaaatcaaactgtagttgttttggcgataggtctcacgcaacacatttttgtatgtgtgtgtgtgtgcgtgtgtgtgtgtgtgtgtgaaaaattgcattcattgacttcaggtagattaaggtatctttttattcattgccctcaggaaagttaaggtatcaatgagacccttaagccaatcatgtaataactgcatgtgtctggtccaggagaagtattgaataagccatttctactgcttactcatgtccctatttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcacatacccccacccagtaccaaatttcagaacacaagaaggtccagttcttcccccttcacataaaggaacatggtttgtcagcctttctcctgtttatgggtttcttccagcagaacagagacattgccaaccatattggatctgcttgctgtccaaaccagcaaactttcctgggcaaatcacaatcagtgagtaaatagacagcctttctgctgccttgggtttctgtgcagataaacagaaatgctctgattagaaaggaaatgaatggttccactcaaatgtcctgcaatttaggattgcagatttctgccttgaaatacctgtttctttgggacattccgtcctgatgatttttatttttgttggtttttatttttggggggaatgacatgtttgggtcttttatacatgaaaatttgtttgacaataatctcacaaaacatattttacatctgaacaaaatgcctttttgtttaccgtagcgtatacatttgttttgggatttttgtgtgtttgttgggaattttgtttttagccaggtcagtattgatgaggctgatcatttggctctttttttccttccagaagagttgcatcaacaaagttaattgtatttatgtatgtaaatagattttaagcttcattataaaatattgttaatgcctataactttttttcaatttttttgtgtgtgtttctaaggactttttcttaggtttgctaaatactgtagggaaaaaaatgcttctttctactttgtttattttagactttaaaatgagctacttcttattcacttttgtaaacagctaatagcatggttccaattttttttaagttcactttttttgttctaggggaaatgaatgtgcaaaaaaagaaaaagaactgttggttatttgtgttattctggatgtataaaaatcaatggaaaaaaataaactttcaaattgaaatgacggtataacacatctactgaaaaagcaacgggaaatgtggtcctatttaagccagcccccacctagggtctatttgtgtggcagttattgggtttggtcacaaaacatcctgaaaattcgtgcgtgggcttctttctccctggtacaaacgtatggaatgcttcttaaaggggaactgtcaagctggtgtcttcagccagatgacatgagagaatatcccagaaccctctctccaaggtgtttctagatagcacaggagagcaggcactgcactgtccacagtccacggtacacagtcgggtgggccgcctcccctctcctgggagcattcgtcgtgcccagcctgagcagggcagctggactgctgctgttcaggagccaccagagccttcctctctttgtaccacagtttcttctgtaaatccagtgttacaatcagtgtgaatggcaaataaacagtttgacaagtacatacaccata

SEQ ID NO: 871 - DNA, 5720 bp, Homo sapiens
ggactccaactgggagggggcgccagcgcacccaggacgcggtgccccaagggaccccattccaagctgcaaactcaagtcccccgcctccccaggccaaacacacccccgcgcccgttcgcagctgccaccccgggtgttccaaagactccggcaaagatctgcgcctcccgggtctccctacccgccagcccgactgcgccgcatcgccagactctgttggcccatcagactccgcccggcagtcggcctcatcaaacttgatttctcacctcctcagccccatcacctccatcctctttccccccgtctcgccttcacccccccaatttcctccttgcccctcatttccaccctcctccccctcccccggccacttcgctaacttgtggctgttgtgatgcgtattcccgtagatccgagcaccagccggcgcttcagccccccctccagcagcctgcagcccggcaaaatgagcgacgtgagcccggtggtggctgcgcaacagcagcagcaacagcagcagcagcaacagcagcagcagcagcagcaacagcagcagcagcagcaggaggcggcggcggcggctgcggcggcggcggcggctgcggcggcggcagctgcagtgccccggttgcggccgccccacgacaaccgcaccatggtggagatcatcgccgaccacccggccgaactcgtccgcaccgacagccccaacttcctgtgctcggtgctgccctcgcactggcgctgcaacaagaccctgcccgtggccttcaaggtggtagccctcggagaggtaccagatgggactgtggttactgtcatggcgggtaacgatgaaaattattctgctgagctccggaatgcctctgctgttatgaaaaaccaagtagcaaggttcaacgatctgagatttgtgggccggagtggacgaggcaagagtttcaccttgaccataaccgtcttcacaaatcctccccaagtagctacctatcacagagcaattaaagttacagtagatggacctcgggaacccagaaggcacagacagaagcttgatgactctaaacctagtttgttctctgaccgcctcagtgatttagggcgcattcctcatcccagtatgagagtaggtgtcccgcctcagaacccacggccctccctgaactctgcaccaagtccttttaatccacaaggacagagtcagattacagaccccaggcaggcacagtcttccccgccgtggtcctatgaccagtcttacccctcctacctgagccagatgacgtccccgtccatccactctaccaccccgctgtcttccacacggggcactgggcttcctgccatcaccgatgtgcctaggcgcatttcagatgatgacactgccacctctgacttctgcctctggccttccactctcagtaagaagagccaggcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccctaccccggctcttcccaaagccagagtggacccttccagaccagcagcactccatatctctactatggcacttcgtcaggatcctatcagtttcccatggtgccggggggagaccggtctccttccagaatgcttccgccatgcaccaccacctcgaatggcagcacgctattaaatccaaatttgcctaaccagaatgatggtgttgacgctgatggaagccacagcagttccccaactgttttgaattctagtggcagaatggatgaatctgtttggcgaccatattgaaattcctcagcagtggcccagtggtatctgggggccacatcccacacgtatcaatatatacatatatagagagagtgcatatatatgtatatcgattagctatctacaaagtgcctattttttagaagatttttcattcactcactcagtcatgatcttgcagccataagagggtagatattgagaagcagaaggctcaagagagacaattgcaatcgagcttcagattgtttactatttaagatgtacttttacaaaggaacaaagaagggaaaaggtatttttgtttttgttgtttggtctgttatcatcaataacctgttcatatgccaattcagagaggtggactccaggttcaggagggagaagagcaaagccgcttcctctctgtgctttgaaacttcacaccctcacggtggcagctgtgtatggaccagtgccctccgcagacagctcacaaaaccagttgaggtgcactaaagggacatgaggtagaatggatgcttccatcacagtaccatcattcagaataactcttccaatttctgctttcagacatgctgcaggtcctcatctgaactgttgggttcgtttttttttttttttttcctgctccaagaaagtgacttcaaaaataactgatcaggatagattattttattttactttttaacactccttctccccttttcccactgaaccaaaaagaaatcccatccctaaaacctgccttctccttttatgcaaaactgaaaatggcaatacattattatagccataatggtatagatagtgattgcgtttggctatgtgttgttttctttttttttaaattatgaatatgtgtaaaatctgaggtaacttgctaacgtgaatggtcatataactttaaagatatatttataattatttaatgacatttggacccttgaaacatttcttagtgtattgatatgttgacttcggtctctaaaagtgctctttattaaataacaaatttcttcagtggtctagagccatatctgaaatattgctaagcaatttcagttcatccaggcacaatgtgattttaaaaaatacttccatctccaaatattttagatatagattgtttttgtgatgtatgaaggaaatgttatgtttagttctttcagatctttgaatgcctctaacacagctttgccttctaaagcggtaattagggatttaaaaaacaacctttagccctttatcagcatgaaatgctggagtgatgtggttttctaatttctttggggtaattatgactcttgtcatattaaaaagacaagcacaagtaaatcattgaactacagaaaaatgttctgtggtttcatagttaagcaaaactctaaatcgccaggcttcatagcaaagacatagtcagctaaaagccgcacatgtggatagagggttcaattatgagacacctagtacaggagagcaaaattgcaccagagattcttaaccaaccagccttaccaaacaacacaacaggggaaccccaatctgccttacccaaggccccactggcagctttccacagaatttgcatttagaggagcagaatgacatcactgtcctttgggagtaggtcctctgaaaaggcagcaggttccagcaggtagctgagctgagaggacatatggcccacggggacctacagacagcctttgacatttgtatttcttacaatggagggccaaggagggcaaggggctgtggagtttggtgtctactagtgtgtatgaatttgagctagagtccttctgtggcatgcactttgaccactcctggcagtcacatggcagatttccaagtgcaaatccttaatccaaacaaggatcatctaatgacaccaccaggccaatccctgctctcctccccgaaaagtcagggtcccttcattggaatcctccacccacccaagcagaatttagcagagatttgccttcaaaccctaacggcccccttgttctctggtccttctcaaacccacctttgtaggccacccagcattgcaggacagcgtgtggggcagctggacctgtgcttcctgcctgggagtctcccttggaattcatcctgactccttctaataaaaatggatgggaaagcaaaacactttgccttctaaaggccgtataccaagtatgcttagataaataagccacttttctattacttaagtaagaaggaagtagtaattgatactatttattgtttgtgtgtggtagcttgaagcacaccactgtccatttatttgtaagtgtaaaatatgtgtgtttgtttcagcagcacttaaaaaagccagtgtctggttacacatttcaattttaattaattgacataaaaatgctaccgccagtgccagctgcatcctatttaattaaaaaggtactatatttgtacattattttttaatgttaaaagggcttttttaagtttacagtacacataccgagtgactttagggatgcttttgtgttgaaatgttactatagtggctgcaggcagcaacccagaaacactttagaagctttttttccttgggaaaaattcaagcacttcttccctccaccctcactccaaccaccccaatgggggtaattcacatttcttagaacaaattctgcccttttttggtctagggattaaaattttgtttttctttctttctttttttttttttttcactgaacccttaatttgcactgggtcatgtgtttgatttgtgatttcaagaccaaagcaaagtcttactactactgtggaaccatgtactagttcctgggaattaaaatagcgtggttctctttgtagcacaaacattgctggaatttgcagtcttttcaatgcagccacatttttatccatttcagttgtctcacaaattttaacccatatcagagttccagaacaggtaccacagctttggttttagattagtggaataacattcagcccagaactgagaaactcaacagattaactatcgtttgctctttagacggtctcactgcctctcacttgccagagccctttcaaaatgagcagagaagtccacaccattagggaccatctgtgataaattcagaagggaggagatgtgtgtacagctttaaggattccctcaattccgaggaaagggactggcccagaatccaggttaatacatggaaacacgaagcattagcaaaagtaataattatacctatggtatttgaaagaacaataataaaagacacttcttccaaaccttgaatttgttgtttttagaaaacgaatgcatttaaaaatattttctatgtgagaattttttagatgtgtgtttacttcatgtttacaaataactgtttgctttttaatgcagtactttgaaatatatcagccaaaaccataacttacaataatttcttaggtattctgaataaaattccatttcttttggatatgctttaccattcttaggtttctgtggaacaaaaatatttgtagcattttgtgtaaatacaagctttcatttttattttttccaattgctattgcccaagaattgctttccatgcacatattgtaaaaattccgctttgtgccacaggtcatgattgtggatgagtttactcttaacttcaaagggactatttgtattgtatgttgcaactgtaaattgaattatttggcatttttctcatgattgtaatattaatttgaagtttgaatttaattttcaataaaatggcttttttggttttgttaaaaaaaaaaaaaaaaaaaa

SEQ ID NO: 872 - DNA, 4270 bp, Homo sapiens
cccgccacttgattctggaggatttgttctggggctgcggccgcggagtcggggcggccgcgggcgagcttcggggcgggaggcggcggcagcggcacagccccgcgcgggccccgccgcggcccaggcagccgggacagccacgaggggcggccgcacgcggggccgcgcgccgaggatgcgggactagccgggcaggctgcgggcggccgtcgggccagcgaggcctcgcagcgggcgggccctggcgagtagtggccgggcgccgccccctgcgccctgaggcccgggccccgccgcttctgctttcccgcttctcgcggcagcggcggccgaggaggcgcccgcgccggccgcccccgggggaagccgcgccgtctccgcctgcccggcgccctgacggccgctgttatgcgtattcccgtagacccaagcaccagccgccgcttcacacctccctccccggccttcccctgcggcggcggcggcggcaagatgggcgagaacagcggcgcgctgagcgcgcaggcggccgtggggcccggagggcgcgcccggcccgaggtgcgctcgatggtggacgtgctggcggaccacgcaggcgagctcgtgcgcaccgacagccccaacttcctctgctccgtgctgccctcgcactggcgctgcaacaagacgctgcccgtcgccttcaaggtggtggcattgggggacgtgccggatggtacggtggtgactgtgatggcaggcaatgacgagaactactccgctgagctgcgcaatgcctcggccgtcatgaagaaccaggtggccaggttcaacgaccttcgcttcgtgggccgcagtgggcgagggaagagtttcaccctgaccatcactgtgttcaccaaccccacccaagtggcgacctaccaccgagccatcaaggtgaccgtggacggaccccgggagcccagacggcaccggcagaagctggaggaccagaccaagccgttccctgaccgctttggggacctggaacggctgcgcatgcgggtgacaccgagcacacccagcccccgaggctcactcagcaccacaagccacttcagcagccagccccagaccccaatccaaggcacctcggaactgaacccattctccgacccccgccagtttgaccgctccttccccacgctgccaaccctcacggagagccgcttcccagaccccaggatgcattatcccggggccatgtcagctgccttcccctacagcgccacgccctcgggcacgagcatcagcagcctcagcgtggcgggcatgccggccaccagccgcttccaccatacctacctcccgccaccctacccgggggccccgcagaaccagagcgggcccttccaggccaacccgtccccctaccacctctactacgggacatcctctggctcctaccagttctccatggtggccggcagcagcagtgggggcgaccgctcacctacccgcatgctggcctcttgcaccagcagcgctgcctctgtcgccgccggcaacctcatgaaccccagcctgggcggccagagtgatggcgtggaggccgacggcagccacagcaactcacccacggccctgagcacgccaggccgcatggatgaggccgtgtggcggccctactgaccgccctggtggactcctcccgctggaggcggggaccctaacaaccttcaagaccagtgatgggccggctccgaggctccgggcgggaatgggacctgcgctccagggtggtctcggtcccagggtggtcccagctggtgggagcctctggctgcatctgtgcagccacatccttgtacagaggcataggttaccacccccaccccggcccgggatactgcccccggcccagatcctggccgtctcatcccatacttctgtggggaatcagcctcctgccacccccccggaaggacctcactgtctccagctatgcccagtgctgcatgggacccatgtctcctgggacagaggccatctctcttccagagagaggcagcattggcccacaggataagcctcaggccctgggaaacctcccgacccctgcaccttcgttggagcccctgcatcccctgggtccagccccctctgcatttacacagatttgagtcagaactggaaagtgtcccccacccccaccaccctcgagcggggttcccctcattgtacagatggggcaggacccagcacgctgctggcagagatggtttgagaacacatccaagccagtccccccagcccagcttcccctccgttcctaactgttggctttcccccagccgcacgggtcccaggccccagagaagatgagtctatggcatcaggttcttaaacccaggaaagcacctacagaccggctcctccatgcactttaccagctcaacgcatccactctctgttctcttggcagggcgggggaggggggataggaggtcccctttcccctaggtggtctcataattccatttgtggagagaacaggagggccagatagataggtcctagcagaaggcattgaggtgagggatcattttgggtcagacatcaatgtccctgtcccccctgggtccagccaagctgtgccccatcccccaagcctcctgggaggatccagccaaatcttgcgactcctggcacacacctgtctgtaacctgttttgtgctctgaaagcaaatagtcctgagcaaaaaaaaaaaaaaaacaaaaaaacaaaaaaaaaacaaaacagtttttaaaactgattttagaaaaagaagcttaatctaacgttttcaaacacaaggtctcttacaggtatagttccgtgattatgatagctctgtgattataagcaacatccccgccccctctcccccccgcggacccccagctgcctcctgagggtgtggggttattagggtctcaatactttctcaaggggctacactccccatcaggcagcatcccaccagcctgcaccacaggctcccctgggaggacgagggaaacgctgatgagacgctgggcatctctcctctgtggctctaggacatctgtccaggaggctgggcggaggtgggcaggatgtgagaggtggggagtactggctgtgcgtggcaggacagaagcactgtaaagggctctccagccgcagctcagctgcactgcgttccgaggtgaagtcttgcccctgaattttgcaaaatgggaaagtgggcgcttgcccaagggccaggctgcatggattctcacatcagagttctctggccctagaaaggcttagaaaaggcgtaagggaactcataaaggctagcagcatgcggtattttaactttctgcctcggcctctgtggatgcagaaatctgccctacaaaatgctcttcattggttgtctctgtgagagcactgtccccacccaacctgtcacaacggccagaaccatacaccagagacacactggcaggttaggcagtccttctggtgatcctattccattccctcctgctgcggtttctcttggcctgtcctcactggaaaaacagtctccatctcctcaaaatagttgctgactccctgcacccaaggggcctctccatgccttcttaggaagcagctatgaatccattgtccttgtagtttcttccctcctgttctctggttatagctggtcccaggtcagcgtgggaggcacctttgggttcccagtgcccagcactttgtagtctcatcccagattactaacccttcctgatcctggagaggcagggatagtaaataaattgctcttcctaccccatcccccatcccctgacaaaaagtgacggcagccgtactgagtctgtaaggcccaaagtgggtacagacagcctgggctggtaaaagtaggtccttatttacaaggctgcgttaaagttgtactaggcaaacacactgatgtaggaagcacgaggaaaggaagacgttttgatatagtgttactgtgagcctgtcagtagtgggtaccaatcttttgtgacatattgtcatgctgaggtgtgacacctgctgcactcatctgatgtaaaaccatcccagagctggcgagaggatggagctgggtggaaactgctttgcactatcgtttgcttggtgtttgtttttaacgcacaacttgcttgtacagtaaactgtcttctgtactatttaactgtaaaatggaattttgactgatttgttacaataatataactctgagatgtgtggaagga

SEQ ID NO: 873 - DNA, 5547 bp, Homo sapiens
gcgacttttgcaacaactcgccgcgccgcggcctccgcgcgccgccgccgccaccgcagccgccggctccccgccgcccgggcccgggccggccgcgccgggggccgccgcgcccgccgcccgctgcctgcgccgccggccgggcatgagttagtcgcagacatggacaccaaacatttcctgccgctcgatttctccacccaggtgaactcctccctcacctccccgacggggcgaggctccatggctgccccctcgctgcacccgtccctggggcctggcatcggctccccgggacagctgcattctcccatcagcaccctgagctcccccatcaacggcatgggcccgcctttctcggtcatcagctcccccatgggcccccactccatgtcggtgcccaccacacccaccctgggcttcagcactggcagcccccagctcagctcacctatgaaccccgtcagcagcagcgaggacatcaagccccccctgggcctcaatggcgtcctcaaggtccccgcccacccctcaggaaacatggcttccttcaccaagcacatctgcgccatctgcggggaccgctcctcaggcaagcactatggagtgtacagctgcgaggggtgcaagggcttcttcaagcggacggtgcgcaaggacctgacctacacctgccgcgacaacaaggactgcctgattgacaagcggcagcggaaccggtgccagtactgccgctaccagaagtgcctggccatgggcatgaagcgggaagccgtgcaggaggagcggcagcgtggcaaggaccggaacgagaatgaggtggagtcgaccagcagcgccaacgaggacatgccggtggagaggatcctggaggctgagctggccgtggagcccaagaccgagacctacgtggaggcaaacatggggctgaaccccagctcgccgaacgaccctgtcaccaacatttgccaagcagccgacaaacagcttttcaccctggtggagtgggccaagcggatcccacacttctcagagctgcccctggacgaccaggtcatcctgctgcgggcaggctggaatgagctgctcatcgcctccttctcccaccgctccatcgccgtgaaggacgggatcctcctggccaccgggctgcacgtccaccggaacagcgcccacagcgcaggggtgggcgccatctttgacagggtgctgacggagcttgtgtccaagatgcgggacatgcagatggacaagacggagctgggctgcctgcgcgccatcgtcctctttaaccctgactccaaggggctctcgaacccggccgaggtggaggcgctgagggagaaggtctatgcgtccttggaggcctactgcaagcacaagtacccagagcagccgggaaggttcgctaagctcttgctccgcctgccggctctgcgctccatcgggctcaaatgcctggaacatctcttcttcttcaagctcatcggggacacacccattgacaccttccttatggagatgctggaggcgccgcaccaaatgacttaggcctgcgggcccatcctttgtgcccacccgttctggccaccctgcctggacgccagctgttcttctcagcctgagccctgtccctgcccttctctgcctggcctgtttggactttggggcacagcctgtcactgctctgcctaagagatgtgttgtcaccctccttatttctgttactacttgtctgtggcccagggcagtggctttcctgaggcagcagccttcgtggcaagaactagcgtgagcccagccaggcgcctccccaccgggctctcaggacaccctgccacaccccacggggcttgggcgactacagggtcttcgggccccagccctggagctgcaggagttgggaacggggcttttgtttccgttgctgtttatcgatgctggttttcagaattcctgtgtggccctcctgtctggagtgacatcttcatctgctctgaatactggtgcccagccagcccgtgacagcttccccctaatcaggaggggacagctgggggcgcaagctggtgtgtcatcagcaaagacctcagccgcctcggggatgagaggggactcgtggggcaagcaagctgccctgtgctctgagtgagggggaaggtagcccctttttccaaagataactcacagttttgccctcgagccaatgagaacatgagctgccctctgtgcaaggtttcggggccacctccaggctgcaggggcgggtcactcacccccctgttttctctctgccttggtgttctggtttcagactcccgactccccgttcagaccagagtgccccggcccctccccagcctgagtcttctccttgctctgcggggtgggctgaggcttgtccttgtttcctgcagggctggccctggctcgggcagggtggggcatcaccacctcactggccttgctggaggcacagggctctgcggacctgcagccatctgtgaggcccgcggggatgggaggggaggagggtggcctgttggtttccctcagagggggcaggtggcctggagagagaggggctcaggaactgggagcctcgtgggtggggcagatgctccgcggcctggagtggctctgccggggcattggtgggacccctgctcaggccttctctctggctgccagttgtgtctaaaagactcttggaatctgagaacccggagtcgcagcgccctcgggcctgggccacacgcaggccctggtgggaccacccagcctggtattgtccacggacagcgttgttcacccagagccttacttgggagcctcactgaacgcctgctctggttgaaggtggggtgggggcggggcttggggcctccctggctcagcccagtgcggcctggcgctcctcccgcaggctctgcccccgggctccggtggtgcggggccctctcaggttgaactcgcctcttttgcactggaaggccctccctttggcctgagtacttttcccgttcacgcctcagtcccgtggacccagcctttgtcagtggcaggtgcctgaacagagggtggatgggggggataccggagggggtcttgtcttcccagccgcagtctaggaatgatgcgggggggtggacgccttctccatagtctttccccacctggagcaggggcttcctcagtggtgaggggagctgcctacaggttggaccgggaggcagtggcttggagaggcagctttccagccttggtggggaagaaagtgtccattctttgccttcctggagctcccagccagagctgagcttaggcacccgagtggagcctgcagctgagtctgtgcccgagacaggctgtcagagattccagaagcctctcctccccgccgccctccacccctgcctttcagcgttgtggatccctagaggtggccccctgcccgatccaccgtcctgaggcagagtgttgagcctcatacctgtaccaggtccccggccagctgggcccctcccaggcactgccaggaagccccagctgcccctggcgggtgtggtggaaatggcaggagggtgcaggtactcttggggccccagcggtgggagtgcaaaagacccaacgccaacacctggtgccttctgcagccagcgcccacccatccgtgcccggacccttgggaatgcccgcggctccagaggaaaaagcccagggacggggcctccgttgcggggggtcggctgcttcttgggaactttgtcgtttccggcgctggctggctggctggctggctgtaaagcactgaagccccccggccgccaacccctgaaagcagaacctggcctccctggccacagcagccttacccaccgctctacgtgtcccgggcacttcccgcagccttcccgtccctttctcatcggccttgtagttgtacagtgctgttggtttgaaaaggtgatgtgtggggagtgcggctcatcactgagtagagaggtagaatttctatttaaccagacctgtagtagtattaccaatccagttcaattaaggtgattttttgtaattattattattttggtgggacaatctttaattttctaaagatagcactaacatcagctcattagccacctgtgcctgtccccgccttggcccggctggatgaagcggcttccccgcagggcccccacttcccagtggctgcttcctggggacccagggcaccccggcaccttcaggcacgctcctcagctggtcacctcccggctttgccgttcagatggggctcctgaggctcaggagtgaagatgccacagagccgggctcccctaggctgcgtcgggcatgcttggaagctggcctgccaggaccttccaccctggggcctgtgtcagccgccggccctccgcaccctggaagcacacggcctctgggaaggacagccctgaccttcggttttccgagcacggtgtttcccaagaattctgggctggcggcctggtggcagtgctggagatgaccccgagcccctccccgtggggcacccaggagggccctgccggaatgtgcagcctgtgggtagtcggctggtgtccctgtcgtggagctggggtgcgtgatctggtgctcgtccacgcaggtgtgtggtgtaaacatgtatgtgctgtacagagagacgcgtgtggagagagccgcacaccagcgccacccaggaaaggcggagcggttaccagtgttttgtgtttatttttaatcaagacgtttcccctgttttcctataaatttgcttcgtgtaagcaagtacataaggaccctcctttggtgaaatccgggttcgaatgaatatctcaaggcaggagatgcatctattttaagatgctttggagcagacagctttagccgttcccaatccttagcaatgccttagctgggacgcatagctaatactttagagaggatgacagatccataaagagagtaaagataagagaaaatgtctaaagcatctggaaaggtaaaaaaaaaaaatctatttttgtacaaatgtaattttatccctcatgtatacttggatatggcggggggagggctgggactgtttcgtttctgcttctagagattgaggtgaaagcttcgtccgagaaacgccaggacagacgatggcagaggagagggctcctgtgacggcggcgaggcttgggaggaaaccgccgcaatgggggtgtcttccctcggggcaggagggtgggcctgaggctttcaagggttttcttccctttcgagtaatttttaaagccttgctctgttgtgtcctgttgccggctctggccttcctgtgactgactgtgaagtggcttctccgtacgattgtctctgaaacatcgtggcctcaggtgccagggtttgatggacagtagcattagaattgtggaaaaggaacacgcaaagggagaagtgtgagaggagaaacaaaatatgagcgtttaaaatacatcgccattcagttcgttaaaaaaaaaaaaaaaaaaaaaaaaa

SEQ ID NO: 874 - DNA, 2892 bp, Homo sapiens
caaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctcagcggcatgccgcagggcagtgtgggccggtgggggtgcgaaaagaaatgcattgtggggtcgcgtcccggtggcggcggcgacggccctggctggatcccgcagcggcggcggcggcggcggtggcaggcggagaacaacaaaccccggagccggagccaggggaggctggacgggacgggatgggcgacagcgggcgggactcccgaagcccagacagctcctccccaaatccccttccccagggagtccctcccccttctcctcctgggccacccctacccccttcaacagctccatcccttggaggctctggggccccacccccacccccgatgccaccacccccactgggctctccctttccagtcatcagttcttccatggggtcccctggtctgccccctccagctcccccaggattctccgggcctgtcagcagcccccagattaactcaacagtgtcactccctgggggtgggtctggcccccctgaagatgtgaagccaccagtcttaggggtccggggcctgcactgtccaccccctccaggtggccctggggctggcaaacggctatgtgcaatctgcggggacagaagctcaggcaaacactacggggtttacagctgtgagggttgcaagggcttcttcaaacgcaccatccgcaaagaccttacatactcttgccgggacaacaaagactgcacagtggacaagcgccagcggaaccgctgtcagtactgccgctatcagaagtgcctggccactggcatgaagagggaggcggtacaggaggagcgtcagcggggaaaggacaaggatggggatggggagggggctgggggagcccccgaggagatgcctgtggacaggatcctggaggcagagcttgctgtggaacagaagagtgaccagggcgttgagggtcctgggggaaccgggggtagcggcagcagcccaaatgaccctgtgactaacatctgtcaggcagctgacaaacagctattcacgcttgttgagtgggcgaagaggatcccacacttttcctccttgcctctggatgatcaggtcatattgctgcgggcaggctggaatgaactcctcattgcctccttctcacaccgatccattgatgttcgagatggcatcctccttgccacaggtcttcacgtgcaccgcaactcagcccattcagcaggagtaggagccatctttgatcgggtgctgacagagctagtgtccaaaatgcgtgacatgaggatggacaagacagagcttggctgcctgagggcaatcattctgtttaatccagatgccaagggcctctccaaccctagtgaggtggaggtcctgcgggagaaagtgtatgcatcactggagacctactgcaaacagaagtaccctgagcagcagggacggtttgccaagctgctgctacgtcttcctgccctccggtccattggccttaagtgtctagagcatctgtttttcttcaagctcattggtgacacccccatcgacaccttcctcatggagatgcttgaggctccccatcaactggcctgagctcagacccagacgtggtgcttctcacactggaggagcacacatccaagagggactccaagccctggggcagggtggggggccatgttcccagaaccttgatggggtgagaagtacagggcagaaccaagaacataaaccctccaagggatctgcttgatatcccaagttggaagggaccccagatacctgtgaggactggttgtctctcttcggtggccttgagtctctgaatttgtcgggttctcccatgatttggggtgatttctcaccctctgtccttcccccagcacaaagcactggccttgcctccaggaccttgcttccttctcatcttgcctcattttgcttcccatctgaagagtggaaatggggaactcccccagaggtggatactggggggcaggcctcccaagctgatggacatgagagtagggccctgacaggccttcctcctctcaaacctggcagatgggggcctctctggaagagggaggggccctgtcactgtccagagtctctttttacacttcacctccttctgcagtcagactgaaatataaaaaaggtggtggtggtggtgaaggggctggtggagatgtaggaaccgatctgctatttttaatttcctgtgaggatagagacttgcagttagactcaaagaagtactgtactttcccaggttgactaagaaatgccagtggtggaggtgggtgtttgggaaaggcagggccctgaaatggcctgtccctagggctctccaagcactagccttcccagcttcccgccgccccccctatctcttcctgtctaacttggggaaggggcctgggctgtgaggacagggcccccacaggggatggtttcacgagtgtagtcccggaggccttccctttacagctctcctccagccctgggcacatagcataggctggggacacaggatcctggcctgagaattgaggggaggtggccagcccgcagaggtggggtgctggggctgcatgatttttgccctgcgtcccttctctttggggctcctttcccctctcatacataaaatcgctttcaaattaaaatcgctgttttctggaaaaaaaaaaaaaaaaaa

SEQ ID NO: 875 - DNA, 1856 bp, Homo sapiens
gtggcaagagtagcggtgacggcggcggcggcggcggcggcagcattatgcgtgattactgacaggcaccagctgctgccgccacagccgtctcaaacgcactatgtggactctccgatctagaggcagattcctgactaatcccagagggctggcccagcctgtgctccccgggctgctaggaagcgatgaccactcttgttagcccaagttgaagaaagccgggctgtgcctgggagccgagagaggcggtaatatttagaagctgcacaggagaggaacatgaactgacgagtaaacatgtatggaaattattctcacttcatgaagtttcccgcaggctatggaggctcccctggccacactggctctacatccatgagcccatcagcagccttgtccacagggaagccaatggacagccaccccagctacacagataccccagtgagtgccccacggactctgagtgcagtggggacccccctcaatgccctgggctctccatatcgagtcatcacctctgccatgggcccaccctcaggagcacttgcagcgcctccaggaatcaacttggttgccccacccagctctcagctaaatgtggtcaacagtgtcagcagttcagaggacatcaagcccttaccagggcttcccgggattggaaacatgaactacccatccaccagccccggatctctggttaaacacatctgtgccatctgtggagacagatcctcaggaaagcactacggggtatacagttgtgaaggctgcaaagggttcttcaagaggacgataaggaaggacctcatctacacgtgtcgggataataaagactgcctcattgacaagcgtcagcgcaaccgctgccagtactgtcgctatcagaagtgccttgtcatgggcatgaagagggaagctgtgcaagaagaaagacagaggagccgagagcgagctgagagtgaggcagaatgtgctaccagtggtcatgaagacatgcctgtggagaggattctagaagctgaacttgctgttgaaccaaagacagaatcctatggtgacatgaatatggagaactcgacaaatgaccctgttaccaacatatgtcatgctgctgacaagcagcttttcaccctcgttgaatgggccaagcgtattccccacttctctgacctcaccttggaggaccaggtcattttgcttcgggcagggtggaatgaattgctgattgcctctttctcccaccgctcagtttccgtgcaggatggcatccttctggccacgggtttacatgtccaccggagcagtgcccacagtgctggggtcggctccatctttgacagagtcctaactgagctggtttccaaaatgaaagacatgcagatggacaagtcggaactgggatgcctgcgagccattgtactctttaacccagatgccaagggcctgtccaacccctctgaggtggagactctgcgagagaaggtttatgccacccttgaggcctacaccaagcagaagtatccggaacagccaggcaggtttgccaagctgctgctgcgcctcccagctctgcgttccattggcttgaaatgcctggagcacctcttcttcttcaagctcatcggggacacccccattgacaccttcctcatggagatgttggagaccccgctgcagatcacctgagccccaccagccacagcctccccacccaggatgacccctgggcaggtgtgtgtggacccccaccctgcactttcctccacctcccaccctgacccccttcctgtccccaaaatgtgatgcttataataaagaaaacctttctacacatgaaaaaaaaaaaaaaa

SEQ ID NO: 876 - DNA, 4562 bp, Homo sapiens
gggccggtccgcgacgactccccggacggcgtttctcctccgagcggcgccggtttcggcttggggggggcggggtacagcccatccatgaccatgggcgacaagaagagcccgaccaggccaaaaagacaagcgaaacctgccgcagacgaagggttttgggattgtagcgtctgcaccttcagaaacagtgctgaagcctttaaatgcagcatctgcgatgtgaggaaaggcacctccaccagaaaacctcggatcaattctcagctggtggcacaacaagtggcacaacagtatgccaccccaccaccccctaaaaaggagaagaaggagaaagttgaaaagcaggacaaagagaaacctgagaaagacaaggaaattagtcctagtgttaccaagaaaaataccaacaagaaaaccaaaccaaagtctgacattctgaaagatcctcctagtgaagcaaacagcatacagtctgcaaatgctacaacaaagaccagcgaaacaaatcacacctcaaggccccggctgaaaaacgtggacaggagcactgcacagcagttggcagtaactgtgggcaacgtcaccgtcattatcacagactttaaggaaaagactcgctcctcatcgacatcctcatccacagtgacctccagtgcagggtcagaacagcagaaccagagcagctcggggtcagagagcacagacaagggctcctcccgttcctccacgccaaagggcgacatgtcagcagtcaatgatgaatctttctgaaattgcacatggaattgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatcatttataattggatgtgctcctgaatctactttttataaaaaaaaaaaaatctgctgtgcacaattttccatgtacattacaactggttttttgtttttgttttgttgccggtggggagggctgggagggggagggaacttttatttattgtgttcacaaactccatcctttcagcatatccttttaagtttagttctttcttccagttatactatgtactatcagttttgatataactatatatatataaatataaaattatatataaagggttatttgaaaccaatccatggcaacgctggtgcttgatacactgtgaagtgaatacaacattgaacagttacagatctgggacagtcccttctatgaaagtgctgaaatttaattaaaatcagtcttatatgaagtatgttccaatccatgtgggaacttgactctctcatctgtctaaagagtactggacgatataaaaatatatattttttaaacaatgtgatctcaaatttaaagactgctccagatagcctgcatttgcaatggaataactgacaaatcacaagtggtttagttgggcagggctttgatcattcaaaagtaactaaagtagctccagaatgccaagtattcgtgtaaattacggttacatgttatcatttgctgttcttacataagcactcatgaaaatatggtattctgtaacttgaattccatccattttccagacctctactcatgtctgaggtaaatctagaaattgtcttagttttaggattgaaacagtctataaactgtatttttggtccatccaggaagctagtcccttgtttctcctttctacatgacattgcagtggtggtttctgtaattaaaatttgtttgcctcatgtccctttgtctgataaaccttcactctaccgattcagttgtgagcattctttttttccttctcaaaacctactatgatttgttttactgaacaaaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaaaaaaaaaaaaaaaaataatcaaagaccactaataagattccacctctccttattaaaataattttttaaaattttgttttgcttttgtttggatgtggggtctctcttctatttgacttttacatttagatacagagtttgtagtacttcagagacatttcaagcatgagaatttgaggttacctctctttatttgacctttagggactcacgggagggcagcctgatttgtaatgaagcaccacattttggtgttaaaaacctggtttgcttaataatagcagtaatttctgtctgtggaggcaacaaataaaaaaattaacagcttgaattgagtagccaacaggaaaggttcctttcacatttacattaaaactattctgtagtcactaatgtaccataatttaaattcttttctcaaaggtatagattataaagcagtgccatttgttgctgtggtcctattctcaaatgcatggacaatgttcccccctttttaaaataatgcttgtgtctgggatgcaagctttgcttatctttttaaatacatttttaaagtatttattaatgaaccaaaggaaatcagatgctttctataagcatcagaatatataatacatagtgatttgactatgaattttaaatccacattttaatattggtgggatattgcaaagacattccttctaaagttttaatattccttttattaagggtctcagggagggtaaattagtcagccatatttattttccagaggtttaagaaattgctgtttttaactttttgaaaaaacttaaatgccaccaaactcatgtaggttgcactgcttattgaaccaataactgttggtatgcactttgttcagacacactgtgtactttttcaaaaactagtttcatgtaaagtgattggaccccatagattagtggaaaaagctgattaaccagctactcataggctgctaattcattcatgccaatgttttggtttttcagttttgcctccgtgataaattaaagaatggggaggggtgaaggaaggggaagaagattgctttagaacaagtggcatgaaattaccatctttgtagaaaccgcagctaacagtgggagttatctaagcaatcagatgttacagggccagccctttagctgctgtggtgtattctgttgggtagtgaggtagtaggtactttatagacttttaattttggaaattgatgacatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcagttacaaaaaaaaagacatcttgacacccacacaatattctaatcaaaacctttcagtttcaatctggatatttaaaaacattggcagaagcttctgtgagtttagttccactaagatgtttcacctgccttatcaagaccattctcagtctacttttttaagctaccgtatcttaaattattgaaaatttattaattgctgaatatataataacctttgcttgtatgtaaccgaaaatggtttaagagccaacatttagagtatgacaatggagctgaacagtttttaatgcgcaagcagttctgttcttgtgtatgacttgtaaccttaatttactgtgtaaagatggttacattatttccttagctttgtttgttggagacaaatagagaatgcttgttaagtatgtcaaaacaatcttatcttgtgaatttttgttaatgtattatacgagctatatttttcatttgcccagaaagacagcttgtataacgcttttggaagtttctgctctgtaatgtctttagagctgacagtctgttaggtttgtttttttcttcatgctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcacaaataaaatagtaaaatttacattggaaa

SEQ ID NO: 877 - DNA, 3018 bp, Homo sapiens
ataaaaccggcccggttctgtggaaagtgggcggcggagccagggtccctggaatggcggagactctgtcaggcctaggtgattctggagcggcgggcgcggcggctctgagctccgcctcgtcagagaccgggacgcggcgcctcagcgacctgcgagtgatcgatctgcgggcggagctgaggaaacggaatgtggactcgagcggcaacaagagcgttttgatggagcggctgaagaaggcaattgaagatgaaggtggtaatcctgacgaaattgaaattacctccgagggaaacaagaaaacatcaaagaggtctagcaaagggcgcaaaccagaagaagagggtgtggaagataacgggctggaggaaaactctggggatggacaggaggatgttgagaccagtctggagaacttgcaggacatcgacatcatggatatcagtgtgttggatgaagcagaaattgataatggaagcgttgcagattgtgtcgaagacgatgatgctgataacctccaggagtccctgtcggatagtagagagctagtcgagggggaaatgaaagagcttccggagcagcttcaggaacatgctatagaggacaaagaaactataaacaatttagatacttcatcatctgacttcactatattacaggaaattgaagagccatccctggagccagaaaatgagaaaatactcgacattttgggggaaacttgtaaatctgagccagtaaaagaagaaagttccgagctggagcagccatttgcacaggacacaagtagcgtggggccagacagaaagcttgcggaggaagaggacctatttgacagcgcccatccggaagagggtgatttagatttggccagcgagtcaacagcacacgctcagtcgagcaaggcagacagcctgttagcggtagtgaaaagggagcccgcggagcagccaggcgatggcgagaggacggactgtgagcctgtagggctagagccggcagttgagcagagtagtgcggcctccgagctcgcggaggcctctagcgaggagctcgcagaagcacccacggaagccccaagcccagaagccagagatagcaaagaagacgggaggaagtttgattttgacgcttgtaatgaagtccctccggctcctaaagagtcctcaaccagtgagggcgctgatcagaaaatgagttctcccgaagatgactcggatacaaaaaggctttccaaagaggaaaagggtcgcagcagttgtggtagaaatttctgggttagtggactctcttctacaaccagagctacagatttgaagaatcttttcagcaaatatgggaaggtggtgggcgccaaggttgtgacaaatgcccggagtcctggagctcgctgttacggttttgtcacgatgtccacagcagaagaggccacaaaatgcattaaccacctgcacaagacggagctccacggaaagatgatctccgtggagaaagccaaaaatgaacctgtgggaaagaaaacctctgacaaaagagacagtgacgggaaaaaggagaagtcgagcaacagtgacagatctacaaaccttaagagggatgataaatgtgacagaaaagatgatgctaagaagggtgacgacggaagtggagaaaagagtaaggaccaagatgatcagaaacctggcccctcagagcgatctcgagccacaaagtcaggaagtcgagggaccgaacggactgtagtaatggataaatccaaaggggtgcctgtgattagtgtaaaaacgtccgggtccaaagagagagcttccaaaagccaggatcgcaaatcagccagcagagagaagcggtccgtcgtgtcctttgataaggtcaaggagcctcggaagtcaagagactcagagtcccatagcagggtgcgtgaacgcagtgaacgcgaacaacgcatgcaggcgcagtgggagcgcgaggagcgtgagcggctggagattgcccgagagaggctggccttccagcgccagcggctggagcgggagcgcatggagcgggaacggctggagcgcgaacgcatgcacgtggagcacgagcgcaggcgcgagcaggagcgcatccaccgtgagcgcgaggagctgaggcgccagcaggaactgcgctatgagcaggagcggcggcccgcggtgcggcggccctacgacctggaccggcgagatgatgcctattggccggaagccaagcgggccgccctggatgagcgctaccattctgactttaaccgccaggaccgcttccacgactttgaccacagggaccgcggccgctaccccgaccactcggtggacaggagagaaggttcaaggtcaatgatgggagaacgagaaggacagcattacccagaacgccatggaggaccagagcgccacggccgggactcccgcgatggctgggggggctatggctctgacaagaggatgagcgagggccgggggctgcctcctccccccagacgtgactggggggaccatggccgaagagaggatgaccggtcatggcagggcacggccgacgggggcatgatggacagggatcacaagaggtggcaaggtggcgagagaagcatgtccggtcactccgggcctggccacatgatgaaccgaggaggaatgtcagggcgcggcagctttgccccaggcggggcctcccggggccaccccatcccacacggtggcatgcagggcgggtttggaggccagagccgggggagcaggcccagcgatgcccgcttcactcgccgctactgagtacttggaatcctgtgtcctgtctcgtggcaacaaggctatgttctgttaggagttaccttaaactgtgtaaaaatatttttttttaatctgctgccatattgtagctcaatacaatgtgaatttgtttttcgttttggggttttttttttttgtaataaatgtgtttccgttcacataccctttaaaaaaaaaaaaaaaaaaaaaaaaaaaaaaa

SEQ ID NO: 878 - DNA, 5143 bp, Homo sapiens
ttattctgccccagctgatgtttgagccagcatgtcgcggaggaagcaagcgaagcctcaacatttccaatccgaccccgaagtggcctcgctcccccggcgagatggagacacagaaaagggtcaaccgagtcgccctactaagagcaaggatgcccacgtctgtggccggtgctgtgccgagttctttgaattatcagatcttctgctccacaagaagaactgtactaaaaatcaattagttttaatcgtaaatgaaaatccagcctccccacccgaaaccttctcccccagcccccctcctgataatcctgatgaacaaatgaatgacacagttaacaaaacagatcaagtggactgcagcgacctttcagaacacaacggacttgacagggaagagtccatggaggtggaggccccggttgctaacaaaagcggcagcggcacttccagcggcagccacagcagtaccgccccaagcagcagcagcagcagcagcagcagcagcggcggcggcggcagctcctccacaggtacctcagcgatcacaacctctctacctcaactcggggacctgacaacactgggcaacttctccgtaatcaacagcaacgtcatcatcgagaacctccagagcaccaaggtggcggtggcccagttctcccaggaagcgaggtgcggcggggcctctgggggcaagctggccgtcccagccctcatggaacaactcctagctctgcagcagcagcagatccaccagctgcaattgatcgaacagattcgtcaccaaatattgctgttggcttctcagaatgcagacttgccaacatcttctagtccttctcaaggtactttacgaacatctgccaaccccttgtccacgctaagttcccatttatctcagcagctggcagcagcagctggattggcacagagcctcgccagccaatctgccagcattagtggtgtgaaacagctacccccaatccagctacctcagagcagttctggcaacaccatcattccatccaacagcggctcttctcccaatatgaacatattggcagcggcagttaccaccccgtcctctgaaaaagtggcttcaagtgctggggcctcccatgtcagcaacccagcggtctcatcatcgtcctcaccagcttttgcaataagcagtttattaagtcctgcgtctaatccacttctacctcagcaagcctccgctaactcggttttccccagccctttgcccaacatcggaacaactgcagaggatttaaactccttgtctgccttggcccagcaaagaaaaagcaagccaccaaatgtcactgcctttgaagcgaaaagtacttccgatgaggcattcttcaaacacaagtgcaggttctgcgcgaaggtctttgggagtgacagtgccttgcagatccacttgcgttcccataccggagagaggccattcaagtgcaacatctgcgggaacaggttctccaccaaggggaatctgaaagtccactttcagcgccacaaagagaaataccctcatatccagatgaacccctatcctgtgcctgagcatttggacaatatccccacgagtactggcatcccatatggcatgtccatccctccagagaagccagtcaccagctggctagacaccaaaccagtcctgcctactctgaccacttcagtcggcctgccgttgcccccaaccctcccaagcctcatacccttcatcaagacggaagagccagcccccatccccatcagccattctgccaccagccccccaggctcagtcaaaagtgactccgggggccctgagtcagccacaagaaacctaggtgggctcccagaggaagccgaagggtccactctgccaccctctggtggcaaaagcgaagagagtggcatggtcaccaactcagtcccgacggcgagcagtagcgtcctgagctccccagcggcagactgcggccccgcgggcagtgccaccaccttcaccaaccctttgttgccgctcatgtccgagcagttcaaggccaagtttccttttgggggactcctggactcagctcaggcatcagagacgtccaagcttcagcaactggtagaaaacattgacaagaaggccactgaccccaatgagtgcatcatctgccaccgggttctcagctgccagagcgccttgaaaatgcactacaggacacacactggggagaggccctttaagtgtaagatctgtggccgggctttcaccacgaaagggaatcttaaaacccactacagtgtccatcgtgctatgcccccgctcagagtccagcattcctgccccatctgccagaagaagttcacgaacgctgtggtcctgcagcagcacatccgaatgcatatgggaggccagatccccaacaccccagtccccgacagctactctgagtccatggagtctgacacaggttcctttgatgagaaaaattttgatgacctagacaacttctctgatgaaaacatggaagactgtcctgagggcagcatccctgatacacctaagtctgcagacgcctcccaagacagcttatcctcttcgcctttgcccctcgagatgtcgagcatcgctgctttggaaaatcagatgaagatgatcaatgctggcctggcagagcagctacaggccagcctgaagtcagtggagaatgggtccatcgagggggatgtcctgaccaatgattcatcctcagtgggtggtgacatggaaagccaaagtgctggcagcccagccatctcagagtctacctcttccatgcaggctctgtccccgtccaacagcacgcaggagttccacaagtcacccagcattgaggagaaaccacagagagcggtcccaagcgagtttgccaatggtttgtctcccaccccagtgaatggtggggctttggatttgacatctagtcacgcagagaaaatcatcaaagaagattctttggggatcctcttcccttttagagaccggggtaaatttaaaaacactgcttgtgacatttgtggcaaaacatttgcttgtcagagtgccttggacattcactatagaagtcataccaaagagagaccatttatttgcacagtttgcaatcgtggcttttccacaaagggtaatttgaagcagcacatgttgacacatcagatgcgagatctgccatcccagctctttgagcccagttccaaccttggccccaatcagaactcagcggtgattcccgccaactcgttgtcatctctcatcaagacagaggtcaacggcttcgtgcatgtttctcctcaggacagtaaggacacccccaccagtcacgtcccgtctgggcctctgtcttcctctgccacatccccagttctgctccctgctctgcccaggagaactcccaagcagcactactgcaacacatgtggcaaaaccttctcctcatcgagtgccctgcagattcacgagagaactcacactggagagaaaccctttgcttgcactatttgtggaagagctttcacgactaaaggcaatcttaaggtacacatgggcactcacatgtggaatagcacccctgcacgacggggtcggcggctctctgtggatggccccatgacatttctaggaggcaatcccgtcaagttcccagaaatgttccagaaggatttggcggcaagatcaggaagtggggatccttccagcttctggaatcagtatgcagcagcgctctccaacgggctggcgatgaaggccaacgagatctccgtcattcagaacggtggcatccctccaattcctggaagcctcggcagtgggaacagctcacctgttagtgggctgacgggaaacctggagaggctccagaactcagagcccaatgctcccctggccggcctggagaaaatggcaagcagtgagaacggaaccaacttccgcttcacccgcttcgtggaggacagcaaggagatcgtcacgagttaaagcagctcgggctggagacatagcattcattcctgttcagaatgcgacctatggtggcctcctactccttgccccccaccccgccccgccccttccttctgttccccagatctatgaactacaacattatgaagacattcttttgtaccttgttcaactttagagttctaagaaagcttatttattagcgatataaccttgctttgcaaacagaatgcaagcgttaactttggtcttctgtattttggactaaatactaattgactagagtgctgtaaacttgctgtaacatttatggcaattgcaagttgccctgctaggcagttgtaatctggcattaacttattttctatatccagtttaatatgaatctggtgttgatgcaatgcctcagtgatgcattagatctctaataaagtctgtatatacatgtacactttgatcctgctggaaaattttatcagcaaacacattgtctaatctttcaaaacagatttaaggaaaggactgaaagtacagactgaacagtgtggttctttgaaaggtttggttttttaatttttattctaaaattcaacctttttttttgtcgatttaaccatttccattttgaactgctatttgtattgtgctttttacttgagtcgtcttcaatgttaataagtttctgtacagtaataagcacgcagaattctttagagaaaaagaaaacaagcgttgttttggtagttgaaactgagacgtaacattttgccttgtaggtatattcacgatagaaaatgtgtgctggaatttcacaatgctgctaagtatagcatcttgaacaaccttcagtggagaaaatgtagatgctcttgtatatacaataagaaatatcactttcattcaaatgtacatatgttccttacaagagcaaatgcttcttcttgatcaagagagcaggtatagtgtttgtttattttgtcttaggtatggaagaaaaaaattggactgttacatgcactttcttggaaagttgaaaggaaagggggggtccaatttctttaacatttaatacttactaacaacagagatactgtaattttactcaagtaatcaaatacattttttttgcaacagataaaacaaaatactgtg

SEQ ID NO: 879 - DNA, 4910 bp, Homo sapiens
gagctgcagaagcgtagggaagaagctgaagaaaaaaagggggcgtctcccctttaaagacttgcaaagattgagagagaaagagagagagtcaagaacagagaatcagagagagagagagagtctgtgtctctgggaaagaagaacatctctgcttcacagtgatttgcgctgggggagaggcatcaattggcttcggacccaagggggagacgagaccaggtcaccccggttaagaccaagtgagcgttgcccctccctctcccaactctctacccgggaatgtctcggcgaaagcagcggaaaccccaacagttaatctcggactgcgaaggtcccagcgcgtctgagaacggtgatgctagcgaggaggatcacccccaagtctgtgccaagtgctgcgcacaattcactgacccaactgaattcctcgcccaccagaacgcatgttctactgaccctcctgtaatggtgataattgggggccaggagaaccccaacaactcttcggcctcctctgaaccccggcctgagggtcacaataatcctcaggtcatggacacagagcatagcaaccccccagattctgggtcctccgtgcccacggatcccacctggggcccagagaggagaggagaggagtcttcagggcatttcctggtcgctgccacaggtacagcggctgggggaggcgggggcctgatcttggccagtcccaagctgggagcaaccccattacctccagaatcgacccctgcaccccctcctcctccaccaccccctccgcccccaggggtaggcagtggccacttgaatatccccctgatcttggaagagctacgggtgctgcagcagcggcagatccatcagatgcagatgactgagcaaatctgcaggcaggtgctgttgcttggctccttaggccagacggtgggtgcccctgccagtccctcagagctacctgggacagggactgcctcttccaccaagcccctactacccctcttcagccccatcaagcctgtccaaaccagcaagacactggcatcttcctcctcctcctcctcttcctcttcaggggcagaaacgcccaagcaggccttcttccacctttaccacccactggggtcacagcatcctttctctgctggaggggttgggcgaagccacaaacccacccctgccccttccccagccttgccaggcagcacagatcagctgattgcctcgcctcatctggcattcccaagcaccacgggactactggcagcacagtgtcttggggcagcccgaggccttgaggccactgcctccccagggctcctgaagccaaagaatggaagtggtgagctgagctacggagaagtgatgggtcccttggagaagcctggtggaaggcacaaatgccgcttctgtgccaaagtatttggcagtgacagtgccctgcagatccaccttcgttcccacacgggtgagaggccctataagtgcaatgtctgtggaaaccgttttaccacccgtggcaacctcaaagtgcatttccaccggcatcgtgagaagtacccacatgtgcagatgaacccacacccagtaccagagcacctagactatgtcattaccagcagtggcttgccttatggtatgtccgtgccaccagagaaggccgaggaggaggcagccactccaggtggaggggttgagcgcaagcctctggtggcctccacaacagcactcagtgccacagagagcctgactctgctctccaccagtgcaggcacagccacggctccaggactccctgctttcaataagtttgtgctcatgaaagcagtggaacccaagaataaagctgatgaaaacacccccccagggagtgagggctcagccatcagtggagtggcagaaagtagcacggcaactcgcatgcaactaagtaagttggtgacttcactaccaagctgggcactgcttaccaaccacttcaagtccactggcagcttccccttcccctatgtgctagagcccttgggggcctcaccctctgagacatcaaagctgcagcaactggtagaaaagattgaccggcaaggagctgtggcggtgacctcagctgcctcaggagcccccaccacctctgcccctgcaccttcatcctcagcctcttctggacctaaccagtgtgtcatctgtctccgagtgcttagctgtcctcgggccctacgccttcattatggccaacatggaggtgagaggcccttcaaatgcaaagtgtgtggcagagccttctccaccaggggtaatctgcgtgcacatttcgtgggccacaaggccagtccagctgcccgggcacagaattcctgccccatctgccagaagaagttcaccaatgctgtcactctgcagcagcatgtccggatgcacctggggggccagatccccaacggtggtactgcactccctgaaggtggaggagctgctcaggagaatggctccgagcaatctacagtctccggggcagggagtttcccccagcagcagtcccagcagccatcaccggaagaggagttgtctgaggaggaggaagaggaggatgaggaagaagaggaagatgtgactgatgaagattccctggcagggagaggctcagagagtggaggtgagaaggcaatatcagtgagaggtgattcagaagaggcatctggggcagaggaggaggtggggacagtggcggcagcagccacagctgggaaggagatggacagtaatgagaaaactactcaacagtcttctttgccaccaccaccaccacctgacagcctggatcagcctcagccaatggagcagggaagcagtggtgttttaggaggcaaggaagaggggggcaaaccggagagaagctcaagtccggcatcagcactcaccccagaaggggaagccaccagcgtgaccttggtagaggagctgagcctgcaggaggcaatgagaaaggagccaggagagagcagcagcagaaaggcctgcgaagtgtgtggccaggcctttccctcccaggcagctctggaggagcatcagaagacccaccccaaggaggggccgctcttcacttgtgttttctgcaggcagggctttcttgagcgggctaccctcaagaagcatatgctcctggcacaccaccaggtacagccctttgccccccatggccctcagaatattgctgctctttctctagtccctggctgttcgccttccatcacctccacagggctctccccctttccccgaaaagatgaccccacgatcccatgagcctgtttttctgtacctgctgctctttgtcccacagagcagaaacagcttcacaaaaggacctcccagagttatgagccctgattttgtctttttctctaagttcttaacatgttatgtccctagtggcttttctgtagtccctgagcttggaaattactgtgcttacaaggggatggccccctaaggaatttttcttccctcctcattctttgtacctgaggaacatagattctctgcagctttctcaaggggaaccctctccagcttccctggtgtgacccttcttccccctcctctctcctctccctttccctttggtaggtgcacctgagcacctacatttggcattgcagcctagccaaaaagggctggcagctgtctctggagggcccagtgccactcctctggggtgacctttctgctcagctggtgggtatgggtcccctatctttctagaaccagtatgtggcattcctgtcaaatggcctgcccatgaagccctggaattccagctccacctccactaccactccaagcctggccccaccagtgctgtttggcctaggaactgtggctgggaaggtgcctccaacaatgggatccagggaagccaaggagaagacagcccccctcctatttcagcctcctgcacccaaggcagtgcctgagaagcccatcatagacaagaagtagcaaactgtacattccttcttcctccccctgctccagaaggtgccggtactgaagatgctccagtaattggtgacccaaccctaggaagtagggagaaatgaaggaagggcataggaaaattttcccagtaaatcccctgatggtcacattaaggtaaaggttttggctggtcagtgtgccaagacctctccagcttctcattcatgatgacctctcaaagttgggaaacaagctgatttcttgccaagaggtctcccaggagatatttgggaaatgtgaagttcgtatctttaaggagcatttttggtcagcatggttgatgaactaatgatgagagagttaaggaatgttgctagaacatagggcttgctggtacctatgtgactaagaaagggacatgatgtaagggaaaaggcctcaaattcttgtgaatgtggacattctcgttaatattcttttgggctaatagtgacatagtgtgcagaggtgtaccagggatcatgggggatttcctagcactagtatgcttctagttttagataactccctcctttattccctggccccttgtattttccttatcttcctctttcaagacccctacccattttgcctatccgtaggctggggcttgtgtctttgtcattgtctggttcttaagagtcccagctccaggtggcgtcctccctgcctctccgtcttgtaatgagttgtagtatttactcttaacataggatcatttggaacaggagttctgaggaggagagagtgagggttttgctattgactgacttgaacgatggcttctcctcaagctgtaggctccagagcttcctaacctagtaaaatgtcaagaacagacgggagatattagtgtctttccctctatcattaaaggtgttttaacc

SEQ ID NO: 880 - DNA, 4775 bp, Homo sapiens
atgtctcggcgcaagcaggccaagccccagcacctcaagtcggacgaggagctgctgccgcctgacggggctcccgagcacgccgccccgggggaaggtgcggaggacgcagacagcgggcccgagagccgcagcgggggcgaggagaccagcgtgtgcgagaaatgctgcgccgagttcttcaagtgggcggacttcctggagcaccagcggagctgcaccaagctcccgcccgtgctgatcgtgcacgaggacgcgcccgcgccgccccccgaggacttccccgagccttcgcccgccagctcccccagcgagcgcgccgaaagcgaggcggccgaggaggcgggtgcggagggcgcggagggcgaggccaggccggtggagaaggaggccgagcccatggacgcggaacccgcgggggacacgcgcgcgccccggcccccgcctgcggcccctgcacccccaacgcccgcctacggcgcgcccagcaccaacgtgaccctggaggcgctgctgagcaccaaggtggcggtggcgcagttctcgcagggcgcgcgcgcggcaggcggctcgggagcaggtggaggcgtggcagctgcagccgtgcccctgatcctggaacagctcatggccctgcagcagcagcagatccaccagctgcagctcatcgagcagatccgcagccaggtggccctcatgcagcgcccgccgccgcggccctcactcagccccgcggccgccccgagcgcaccgggcccggcccccagccagctgcccgggctggccgcgctcccgctgtcggccggggcccctgccgccgccatcgcgggctcgggccccgccgccccggccgccttcgagggcgcgcagccgctgtcccggcccgagtctggcgccagcacccccggcggccctgcggagcccagcgcgcccgccgcccccagcgccgcccctgcccccgctgcccccgccccggcgccagcgccgcagagcgcagcctcgtcgcagccgcagagcgcatccacgccgcctgccctggccccggggtccctgctgggtgcggcgcccggcctgccaagtccgcttctacctcagacttccgccagcggcgtcatcttccccaacccgctggtcagcatcgcggccacggccaacgctctggacccgctgtccgcgctcatgaagcaccgcaagggcaagccgcccaatgtgtcggtgttcgagcccaaagccagcgccgaggacccgttcttcaagcacaaatgccgcttctgcgccaaggtcttcggcagcgacagcgcgctccagatccacctgcgctcgcacacaggcgagcggcccttcaagtgcaacatctgcgggaaccgcttctccaccaaaggcaacctgaaggtgcacttccagaggcacaaggagaagtacccccacatccagatgaacccttacccggtccccgagtacctggacaacgtgcccacctgctcgggcatcccctacggcatgtcgctgccccccgagaagcccgtgaccacctggctggacagcaagcccgtgctgcccaccgtgcccacgtccgtggggctgcaactgccgcccactgtccctggcgcgcacggctacgccgactctcccagcgccaccccagccagccgctccccgcagaggccctcgcccgcctccagcgagtgcgcctccttgtccccaggcctcaaccacgtggagtccggcgtgtcggccaccgccgagtccccacagtcgctcctcggcgggccgcccctcactaaagccgagcccgtcagcctgccctgcaccaacgccagggccggggacgctcccgtgggcgcgcaggctagcgctgcacccacatcggtggacggcgcacccacgagcctcggcagccccgggctgcccgccgtctccgagcagttcaaggcccagtttccgttcggggggctgctagactcgatgcaaacgtcggaaacctcgaagctgcagcagctggtggagaacatcgacaagaagatgacggacccgaaccagtgcgtcatctgccaccgggtgctgagctgccagagcgcgctgaagatgcactaccggacgcacacgggggagcggccgttcaagtgcaagatctgcggccgcgccttcaccaccaagggcaacctcaagacgcacttcggcgtgcaccgtgcaaagccgcccctgcgcgtgcagcactcctgccccatctgccagaagaagttcaccaacgccgtggtcctgcagcagcacatccgcatgcacatgggcggccagatccccaacacgccgctgccggagggcttccaggatgccatggactccgagctggcctacgacgacaagaacgcggagaccctgagcagctacgatgacgacatggacgagaactccatggaggacgacgctgagctgaaggacgcggccaccgacccggccaagccactcctgtcctacgcggggtcctgcccgccctccccgccctcggtcatctccagcattgccgccctggagaaccagatgaagatgatcgactcggtcatgagctgccagcagctgaccggcctcaagtccgtggagaacgggtccggggagagtgaccgcctgagcaacgactcctcgtcggccgtgggcgacctggagagccgcagcgcgggcagccccgccctgtccgagtcctcgtcctcgcaggccctgtcgccggcccccagcaatggtgagagcttccgctccaagtccccgggcctgggcgccccggaggagccccaggaaatcccgctcaagaccgagaggccggacagcccagccgccgccccgggcagcggaggcgcccctggccgcgcgggcatcaaggaggaggcgcccttcagcctgctgttcctgagcagggagcggggtaagtgtcccagcactgtgtgtggtgtctgtggcaagccttttgcttgcaagagcgcgttggaaatccactaccgcagccatactaaggagcggccattcgtctgcgcgctctgcaggcgagggtgctccactatgggtaatttaaaacagcacttactgacacacagattgaaagagctgccttctcagttatttgaccccaactttgctctaggtcccagccaaagcactcctagcctgatctccagcgccgcacccaccatgatcaaaatggaagtgaacggtcacggcaaggccatggcgctgggcgagggtcccccgctgcccgcgggcgtccaggtccccgccgggcctcagacagtgatgggcccgggcctggcgcccatgctggcccccccaccgcgccggacgcccaagcagcacaactgccagtcgtgcgggaagaccttctcctcggccagcgccctgcagatccatgagcgcacgcacaccggcgagaagccgttcggctgcaccatctgcggccgggccttcaccactaagggcaacctcaaggtgcacatggggacacacatgtggaataacgcccccgcgagacgcggccgccgcctgtctgtggagaaccccatggctctcctagggggtgatgccctgaagttctctgaaatgttccagaaggacctggcagctcgggcaatgaacgtcgaccccagtttttggaaccagtatgctgcagccatcactaacgggctcgccatgaagaacaacgagatctccgtcatccagaacggcggcatcccccagctccccgtgagtcttgggggcagcgccctcccccctctgggcagcatggccagtgggatggacaaagcacgcactggcagtagcccacccatcgtcagcttggacaaagcgagctcagaaacagcagccagccgcccattcacgcggtttatcgaggataacaaggagattggtatcaactagccagtgactcgctcatctgccctgcccaggcccacgttttgaagttggagcatcaggcctccgacctttcttgcctcggttctcattacactttcacccatagcagaaaacactttgtgcggctgccgagaggtggtcttgtaagcgctgcatggcgctcccttcaacagcaagcctgactgttctcgagaactctgcaatcttttaaataagcttccttcaaaaaaaaaagtgcttggaaaaccgccttaggaacagaaagagctcagaccatgtccacttcctttctcctgaaacctaataatctctccgagggagaaaggggttctctgcggtattccagtgaaactcatttgatggtttcttttgaattagttagacacttgaacggtgttttttagaactcttcatgttaaagacgtggtttagtactcccaatgctgtgtatcatgacactatcttcgtctgtagtatttatgatgttaagataatgcgggtaacagacaatataatagccccgaccttaaacgaagcttttgtactgcagaatacatctggctgtgtgatttttttttttaagcaagatttgttttactataaataagtggattatttcaatgcaggcaaaattgtgaagttctgttgggaaagatagcatgcttttcgtgtgcaagtacctgtcagtaataagccttttttttttttttttttaatttaaatgtttgtagctgctatgtggacagttgttttctagtgtggtctgtagcccaataactggggaacgagttacagacaaacatcaccgtaaatgactcacaacattataaacagttgtgagaaaatatttcacattatcaaagctgtacaataaa

SEQ ID NO: 881 - DNA, 3487 bp, Homo sapiens
atgcgcgttccggccgaaggggggtaaatttcccaactccaggaatttgtggcggagagggcaaataactgcggctctcccggcgccccgatgctcgcaccatgtcgaggcgcaagcaggcgaaaccccagcacatcaactcggaggaggaccagggcgagcagcagccgcagcagcagaccccggagtttgcagatgcggccccagcggcgcccgcggcgggggagctgggtgctccagtgaaccacccagggaatgacgaggtggcgagtgaggatgaagccacagtaaagcggcttcgtcgggaggagacgcacgtctgtgagaaatgctgtgcggagttcttcagcatctctgagttcctggaacataagaaaaattgcactaaaaatccacctgtcctcatcatgaatgacagcgaggggcctgtgccttcagaagacttctccggagctgtactgagccaccagcccaccagtcccggcagtaaggactgtcacagggagaatggcggcagctcagaggacatgaaggagaagccggatgcggagtctgtggtgtacctaaagacagagacagccctgccacccaccccccaggacataagctatttagccaaaggcaaagtggccaacactaatgtgaccttgcaggcactacggggcaccaaggtggcggtgaatcagcggagcgcggatgcactccctgcccccgtgcctggtgccaacagcatcccgtgggtcctcgagcagatcttgtgtctgcagcagcagcagctacagcagatccagctcaccgagcagatccgcatccaggtgaacatgtgggcctcccacgccctccactcaagcggggcaggggccgacactctgaagaccttgggcagccacatgtctcagcaggtttctgcagctgtggctttgctcagccagaaagctggaagccaaggtctgtctctggatgccttgaaacaagccaagctacctcacgccaacatcccttctgccaccagctccctgtccccagggctggcacccttcactctgaagccggatgggacccgggtgctcccgaacgtcatgtcccgcctcccgagcgctttgcttcctcaggccccgggctcggtgctcttccagagccctttctccactgtggcgctagacacatccaagaaagggaaggggaagccaccgaacatctccgcggtggatgtcaaacccaaagacgaggcggccctctacaagcacaagtgtaagtactgtagcaaggtttttgggactgatagctccttgcagatccacctccgctcccacactggagagagacccttcgtgtgctctgtctgtggtcatcgcttcaccaccaagggcaacctcaaggtgcactttcaccgacatccccaggtgaaggcaaacccccagctgtttgccgagttccaggacaaagtggcggccggcaatggcatcccctatgcactctctgtacctgaccccatagatgaaccgagtctttctttagacagcaaacctgtccttgtaaccacctctgtagggctacctcagaatctttcttcggggactaatcccaaggacctcacgggtggctccttgcccggtgacctgcagcctgggccttctccagaaagtgagggtggacccacactccctggggtgggaccaaactataattccccaagggctggtggcttccaagggagtgggacccctgagccagggtcagagaccctgaaattgcagcagttggtggagaacattgacaaggccaccactgatcccaacgaatgtctcatttgccaccgagtcttaagctgtcagagctccctcaagatgcattatcgcacccacaccggggagagaccgttccagtgtaagatctgtggccgagccttttctaccaaaggtaacctgaagacacaccttggggttcaccgaaccaacacatccattaagacgcagcattcgtgccccatctgccagaagaagttcactaatgccgtgatgctgcagcaacatattcggatgcacatgggcggtcagattcccaacacgcccctgccagagaatccctgtgactttacgggttctgagccaatgaccgtgggtgagaacggcagcaccggcgctatctgccatgatgatgtcatcgaaagcatcgatgtagaggaagtcagctcccaggaggctcccagcagctcctccaaggtccccacgcctcttcccagcatccactcggcatcacccacgctagggtttgccatgatggcttccttagatgccccagggaaagtgggtcctgccccttttaacctgcagcgccagggcagcagagaaaacggttccgtggagagcgatggcttgaccaacgactcatcctcgctgatgggagaccaggagtatcagagccgaagcccagatatcctggaaaccacatccttccaggcactctccccggccaatagtcaagccgaaagcatcaagtcaaagtctcccgatgctgggagcaaagcagagagctccgagaacagccgcactgagatggaaggtcggagcagtctcccttccacgtttatccgagccccgccgacctatgtcaaggttgaagttcctggcacatttgtgggaccctcgacattgtccccagggatgacccctttgttagcagcccagccacgccgacaggccaagcaacatggctgcacacggtgtgggaagaacttctcgtctgctagcgctcttcagatccacgagcggactcacactggagagaagccttttgtgtgcaacatttgtgggcgagcttttaccaccaaaggcaacttaaaggttcactacatgacacacggggcgaacaataactcagcccgccgtggaaggaagttggccatcgagaacaccatggctctgttaggtacggacggaaaaagagtctcagaaatctttcccaaggaaatcctggccccttcagtgaatgtggaccctgttgtgtggaaccagtacaccagcatgctcaatggcggtctggccgtgaagaccaatgagatctctgtgatccagagtgggggggttcctaccctcccggtttccttgggggccacctccgttgtgaataacgccactgtctccaagatggatggctcccagtcgggtatcagtgcagatgtggaaaaaccaagtgctactgacggcgttcccaaacaccagtttcctcacttcctggaagaaaacaagattgcggtcagctaagggagaacttgcgtggaaggagcaatgcagacacagtgaaatctctagaatctgctttgttttgtaagaactcatctcctcctgttttctttttcttactgatatgcaaatgatgtttactacgttggttgtgaccacaacctcaggcaagtgctacaatcacgattgttgctatgctgctttgcaaaaagttgaaaaaataaaaaaaaaatgcataccaaaaa

SEQ ID NO: 882 - DNA, 2318 bp, Homo sapiens
taaagtgtcgagcttctcctcgcgagagacttagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagaccgagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacagtacgacagtgtattgtaaattccctttagtttgttacagtagccaattgaaaatgtatatcccaaaatttaaaaaaaaaagtaccagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaagtggttgggctgctttgtcaaattccaccctttgcttggttccaacatggaatttctcctttaaagatttcaatatcccatcaaaagtacagttagagaatacctagtgaatttattgaatataatgctaagaatcaaaagacttgtactagtttacctctggctttggtaagtgtggctttgagtaataactgagctgtttccccgcatataaaatagaaataaataagtagtcatcatgacagcaaaaaaaaaaaaaaaaaa

SEQ ID NO: 883 - DNA, 1126 bp, Homo sapiens
tccccatgtgacagtgagcggggtccccgctccaggagacgctcgagtctgcgtcccggccctcagcactgtccactgtttcggtgccagcagagaccagcaggcccgggacagttggtgtttggccgtgccgctgtctaacttggtgtgcagagtgaattgccgctgccggagcggagagaggcggagcggccaggagagaggggatttctgtcagcgccggcctcgggagctcggagacatgaacggcttcacgcctgacgagatgagccgcggcggggatgcggccgccgcagtggccgcagtggtcgctgccgcggccgccgccgcctcggcggggaacgggaccggcgcgggcaccggggctgaggtgccgggcgcgggggcggtctcagcggctgggcccccgggggcggccgggccgggccccgggcaactgtgctgcctgcgggaggatggtgagcggtgcggccgggcggcaggcaacgccagcttcagcaagaggatccagaagagcatctcccagaagaaggtgaagatcgagctggataagagcgcaaggcatctttacatatgtgattatcataaaaacttaattcagagtgttcgaaacagaagaaagagaaaagggagtgatgatgatggaggtgattcacctgttcaagatattgataccccagaggttgatttataccaattacaagtaaatacacttaggagatacaaaagacacttcaagctaccaaccagaccaggacttaataaagcacaacttgttgagatagttggttgccactttaggtctattccagtgaatgaaaaagacaccttaacatatttcatctactcagtgaagaatgacaagaacaaatcagatctcaaggttgatagtggtgttcactaggagacgtggaattgagactaataacttggatgttaacactgtttactgttttttcacatgtagaaatgttctttgtgtattttttctacagaggattttctctgattttattttctttgtttctgactctaataattagttggaaactcatataaaatgagctttcctaaattaaatctattttaaataaaggttattactattaaaaaaaaaaaaaaaaaa

SEQ ID NO: 884 - DNA, 4377 bp, Homo sapiens
agttgtgacggaacgcatgccattataatgagtttttatatctggtgggagcttttacagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcagttgtctatcaacgtctatgactacaactgccatgtggacttgatcagactgctcaggctggaaggggagcttaccaaggtgaggatggcccgccagaagatgagtgaaatctttcccttgactgaagagctctggctggagtggctgcatgacgagatcagcatggcccaggatggcctggacagagagcacgtgtatgacctctttgagaaagccgtgaaggattacatttgtcctaacatttggctagagtatggccagtactcagttggtgggattggtcagaaaggtggccttgagaaagttcgctccgtgtttgaaagggctctctcgtctgttggtttacatatgaccaaaggactcgccctctgggaggcttaccgagagtttgaaagtgcgattgtggaagctgctcggcttgagaaagtccacagtcttttccggcgacagttggcgatcccactctatgatatggaggccacatttgcagagtatgaagaatggtcagaagacccaataccagagtcagtaattcagaactataacaaagcactacagcagctggagaaatataaaccctatgaagaagcactgttgcaggcagaggcaccaaggctggcagaatatcaagcatatatcgattttgagatgaaaattggcgatcctgctcgcattcagttgatctttgagcgcgccctggtcgagaactgccttgtcccagacttatggatccgttacagtcagtacctagatcgacaactgaaagtaaaggatttggttttatctgtacataaccgcgctattagaaactgcccctggacagttgccttatggagtcggtacctcttggccatggagagacatggagttgatcatcaagtaatttctgtaaccttcgagaaagctttgaatgccggcttcatccaggccactgattatgtggagatttggcaggcataccttgattacctgaggagaagggttgatttcaaacaagactccagtaaagagctggaggagttgagggccgcctttactcgtgccttggagtatctgaagcaggaggtggaagagcgtttcaatgagagtggtgatccaagctgcgtgattatgcagaactgggctaggattgaggctcgactgtgcaataacatgcagaaagctcgggaactctgggatagcatcatgaccagaggaaatgccaagtacgccaacatgtggctagagtattacaacctggaaagagctcatggtgacacccagcactgccggaaggctctgcaccgggccgtccagtgcaccagtgactacccagagcacgtctgcgaagtgttactcaccatggagaggacagaaggttctttagaagattgggatatagctgttcagaaaactgaaacccgattagctcgtgtcaatgagcagagaatgaaggctgcagagaaggaagcagcccttgtgcagcaagaagaagaaaaggctgaacaacggaaaagagctcgggctgagaagaaagcgttaaaaaagaagaaaaagatcagaggcccagagaagcgcggagcagatgaggatgatgagaaagagtggggcgatgatgaagaagagcagccttccaaacgcagaagggtcgagaacagcatccctgcagctggagaaacacaaaatgtagaagtagcagcagggcccgctgggaaatgtgctgccgtagatgtggagcccccttcgaagcagaaggagaaggcagcctccctgaagagggacatgcccaaggtgctgcacgacagcagcaaggacagcatcaccgtctttgtcagcaacctgccctacagcatgcaggagccggacacgaagctcaggccactcttcgaggcctgtggggaggtggtccagatccgacccatcttcagcaaccgtggggatttccgaggttactgctacgtggagtttaaagaagagaaatcagcccttcaggcactggagatggaccggaaaagtgtagaagggaggccaatgtttgtttccccctgtgtggataagagcaaaaaccccgattttaaggtgttcaggtacagcacttccctagagaaacacaagctgttcatctcaggcctgcctttctcctgtactaaagaggaactagaagaaatctgtaaggctcatggcaccgtgaaggacctcaggctggtcaccaaccgggctggcaaaccaaagggcctggcctacgtggagtatgaaaatgaatcccaggcgtcgcaggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggtgtgctgcgtgctcgcaaccacagatggctcctcggctttagacagaaaggggaaggggttctaagtcaagagcctttcagtgctccctcatattgagggcagtggcagaaaagtgaccactctgcaggctgggcccaggatgtggtgtcctgagatagttttgtatcttaaagactgaggcacagaagcgaaacgagaacacactgtttttgagacacagttgtccaaatgtttctggccagctccggcccctttttgtatgacacttctcttccaccctgcacagcacatgtgcccgtcattcttttaattttaaaagatgaaatggcagatgctagtaattcacagaatggcctcttgtgggggtgggtctgagggaagtcagctataaaacatttgctggagttttgttcaatggggctgtgcatttttatattatgtgtttgtaaatgacatgtcagccattgtttcatgtttcctaaaagcagaatatttgcaacatttgttttgtataggaattatttgtgccacctgctgtggactgttttctttgcctagtgactagtgacctgtgttgtctaaacatgagtttcagccctttggttttgtttaataccatgtcaaatgcaaacttcaattctccccatttagctttattaaactgacgttctcttcaaaacttcttgctgaatggtactcagatgtgcattcacatacagatgtgttttgaagtgggtgtaccttgctttacctaatagatgtgtaaatagaacttttgtaagtcaaatcccattgtcactttgatttaaattattccagctgtgatgtgtcttcattttatagcagtttgacactggagcttttgagcttttttacctcacatcttttatcaaataatatttactgctttgaaaacagcaacagcattggccagttcagtaggggaagcttgctttattaagacactctggagaaagacgtcagggaatccttgtatatgtcgtgggaatcaactcctcatttatctgttgcgtaagtttaagtttttgtgcatcagtcgggttttctatatttttttaacttaacattttttaatataaccgattaaaaagtagacagaacagtaaaataaactcctgtgtgcctaccaaaaaaaa

SEQ ID NO: 885 - DNA, 5423 bp, Homo sapiens
tttctcgctcgctcccgttccccggacgcggcggatgagccggccccgctggggaaggctccgggcggcggcgggcggccgggaggaggctgcgtgctcggggctggggctgcgagcggggtgattttgtattaaaatgaggaggaggaagaagaggcacccacagcggcagcggcggcggcggcggcagcagcagcaggagcagcggcggagagggctgcagcccgggcggacgcgcggagccgagcggggcacggcggcggcagcgacagcggccgggatgagtcaactaataatttaatgggggcagagacggcagcgaggggtagagctagcgagggagagagcgagagaagcagccccgtccggggactcgcgctcacactcacgcacacacacaaacacacacacacctctccctgtgccacccagcaacacccggcctcgtcacaacaacaacagccgcggccgccctctatcctgcccgggggcccagccgaaagccagggcgactctagaggacgctgcccgcccccctctttcatttcgggaaactcctgatcagttttgtcggggtttctgggtttcttttcccccaaagtcctagtgccattgtggtgctcgttgtttacctcggactctggacgagtgagagcttggcgactttttggggggagggggcggggagtttgtcgctgcctaggcggtggaggtggctgggggtgccttctgatcttcctcctcctccccctccccccgaacctcttctctcctcacttgctgggaccccagacgctcacagccccgcgtcaatgggcagggagagggtccttgcggctgttgtcagcgagggcagaatcaaaagtggcattttagtgcctttccggggcttttctcgcgaccccctgccccccaccctcgctgtcccccgctagatgccctcgttgggggtgcgaggctgtggggaaaagtttaaggtttgttaatattagtcgcgattgttggcgaggggggtgggggtgattggaagggaggcgaggtggccttcccaatgcgcgttattcggggttattgaagaataatattgcaagtgacagccagaagtagactttctgtcctcacaccgaagaacccgagtgagcaggagggagggagagacgcgaagagaccttttttcctttttggagaccttgtccgcagtgatttttttttttttaagagaatcctcagtcaccacgtcgtttccccagcaccatcacagtgtacagctcataacgggttttgctttgtttttacgatttccccccaacgaatcacttgtcagatcaattttatcttcttcctcctccctgcttcccactctcccctcctccccatcgcaaaccctgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttatttttttttttttaattaaaaaaaaaaaggacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtatgacatggtagggtttgtctgcttatgtgaagtaactaaaggagtcaaaggatggccctctcatttaggtgcatgttaataacttgttatttcactgattttaaaaagagcaattgacaagttacttgaaacactgtaaatttaaatcacaaacacatgctcattttt

SEQ ID NO: 886 - DNA, 5306 bp, Homo sapiens
agaggcgcttaagttaccaagggattagggctgatctcaggagaggtaaacgaccatccttggaacacggagcccttcttccctgcccggtatctgcgcgtgccttgggtagtccgcacaaccctccccagctccggatgccctgggatacccggacccaggagagagcgcgtcagcggggcgcagctactttgcactcgccgattctgacacaacagatagttaattggggccttcgaaatcaaggactaagaagtactgaactcctaatatcaccaattcttctaagttcctggacattgatccggaggaggattcgcagttcaacatcaaggtccctgtgcgttttattgcgacctgccggtgggaactttgtctccgagtcggagcagcatggagcggcggagcgagagcccgtgtctgcgggacagccccgaccggcggagcggcagcccggacgtcaaggggcctcccccagtgaaggtggcccggctggagcagaacggcagccccatgggagcccgcgggaggcccaacggcgccgtggccaaggccgtgggaggtttgatgattcctgtcttttgtgtcgtggagcagttggacggctctcttgaatatgacaacagagaagaacacgccgagtttgtcctggtgcggaaagatgtgctttttagccagctggtggagactgcgctcctggccctggggtattctcacagctctgcggcccaggcccaaggaataatcaagctgggaaggtggaaccctctccccctcagttatgtgacagatgcacccgacgcgacagtggccgacatgctacaagatgtctatcatgttgtgacgttgaaaatccaattacaaagttgttcaaagttggaagacttgcctgcggagcagtggaaccatgccacagtccgcaatgccttaaaggaactgctcaaagagatgaaccagagcacattagccaaagaatgccctctctcccagagtatgatttcatccattgtaaatagcacatattatgccaatgtgtcagcaaccaagtgccaggagtttgggagatggtataaaaagtacaagaagattaaagtggaaagagtggaacgagaaaacctttcagactattgtgttctgggccagcgtccaatgcatttaccaaatatgaaccagctggcatccctggggaaaaccaacgaacagtctcctcacagccaaattcaccacagtactccaatccgaaaccaagtgcccgcattacagcccatcatgagccctggtcttctttctccccagcttagtccacaacttgtaaggcaacaaatagccatggcccatctgataaaccaacagattgccgttagccggctcctggctcaccagcatcctcaagccatcaaccagcagttcctgaaccatccacccatccccagagcagttaagccagagccaaccaactcttccgtggaagtctctccagatatctaccagcaagtcagagatgagctgaagagggccagtgtgtcccaagctgtctttgcaagagtggcattcaaccgcacacagggattgttgtctgagattctgcgtaaggaagaagaccctcggacagcctctcagtctcttctagtaaacctgagggccatgcagaatttcctcaatctgccagaagtggagcgagatcgcatctaccaggatgagagggagcggagcatgaatcccaatgtgagcatggtctcctcggcctccagcagtcccagctcctcccgaacccctcaggccaaaacctcgacaccgacaacagacctccctattaaggtggacggcgccaacatcaacatcacagctgccatttatgacgagatccaacaggagatgaaaagggccaaggtgtctcaagccctgtttgccaaagtggctgcaaataaaagtcagggctggctgtgtgaactgctccgctggaaggagaacccaagcccagaaaaccgcaccctctgggaaaacctctgtaccatccgtcgcttcctgaaccttccccagcatgagagggatgtcatctatgaggaggagtcaaggcatcaccacagcgaacgcatgcaacacgtggtccagcttccccctgagccggtgcaggtacttcatagacagcagtctcagccagccaaggagagttcccctcccagagaagaagcgcctcccccacctcctccgactgaagacagttgtgccaaaaagccccggtctcgcacaaagatctccttagaagccctggggatcctccaaagctttattcatgatgtaggcctgtacccagaccaggaagccatccacactctttcggctcagctggatctccccaaacacaccatcatcaagttcttccagaaccagcggtaccacgtgaagcaccacgggaagctgaaagagcacctgggctccgcggtggacgtggctgaatataaggacgaggagctgctgaccgagtcagaggagaacgacagcgaggaaggctccgaggagatgtacaaagtggaggctgaggaggaaaatgctgacaaaagcaaggcagcacctgccgaaattgaccagagataatgtgaacttctactaggcaaagcaatacatcggtccaaggattttctgctttcatttctttaaaagttttttgttagtttgttttttgtttttgtttttgggtttttttggctttatttttgtctttttatgtctgttttgtttttcttacccttttggacatttctttgttgcacaggatacacctatagactgaataagttcagtatttccgaatcagacatcgccttggcaaagacactaaagcgttacactttatcccgtctctatgactggatcatagtcattataatcacaggagactctgccttcattatccttgcacttaacggaagttacatcaggcaagtaccaggatgaaaagaactatgaaataaatgaaggaagctacaagtgtgtgtgtatatgtatatgtatatatctctatatttacatatatatattaaaattgcatgggacagagactttgcaatccgaaagaatagactgtgaaatgagttcttaaagaaaagacttgtttatgtattaaaaaaaccacttcacagtgagtcgctttggctttttgataaactgcggcctgctctcagggtggggtgactatttttgaattcctatttattttttgtgtttgtccctgattttttttttttaattctatggcttcctatctggcagcttaatgggtaatttttgaggtatgtatttaacaaaataaacgacactgccgaaaaaaaaaaaagtgaagtgaaaacaatcagggcacattaaaatgatacaagtcaaataaatcttaaagacacaatgcacacttaaaatgactcaataaaatgacttgctacgttccgttattcaatttgtcattactgtagtgaacagatgcatttctgtggaattccaaataagtaaaactgaaattcagtgcagagaaaactttgtccactagtgcaagtcttgatcaaatgacattttgacattggacatatggaattcatagtatgagccacattttgttgtgaaatttatttacctgcttgtggcttcaaatctgaaaattaataagcctgctcgtttaaaagttgtttgttgttgctgtttttttgtctttttgttttttactagaaaatagttcagtgtaatattaagttagaaaagaagttgctgcccagttaaaggggctccctctcaaataaatctccatccttccctctcccaaaagacatttctgatttctgcttcactttgggcttcctcttcttcgtacacattccatctacctaatcaaacattttcagtccctgatctctcctgtcccttttcctgggatgacagccctaacaagaactgtttttgaatcgttgtgcagctccaggcaatagagtatgtgaagcgatttcagtagaatcacttactcatcctaaaagaaaacattatcccagttacctacatcgcaattaccttatgtaaagcagaactaatgctgactggatgtttaatgggatgagcattaaagctgcaatctactatagtactccagatctctttcggcttcctatgagaaacaccagaagcattactttccacttctacttacagtaattgcaagaggagacctcacattcaggactggcctagtgaacgtaatccatgctttaaactggccattaaacagtcccacatggttggattttttttttttttttgagttgtgctttcacaaaaccttgtcaaagacctcatgcaatatcactttgaaagttattttctgtttactacacaaacattgtaatataactgttaatactatttatatatttgaaaggtataaaaggtaggagttaaaaaaaaaacctctatgtgtagatattaactcagaacttacaatatacagggagaagacatgttgcaatacaagctaattctagctgctcagtaacctctggagtttttaaagggacattttcctgtactttttcaaataatgatgtttaaaaattatcttgacataagcgtcatatacctttgcaaaaggatggttgtttgcagttagccctggccccatccttcctatttctgtagtatgctgcagctttaatcagaaagtccatggttgctgcttcctgatctccgagttactctttccaaattgtcttcttacactgttgctgaaggtcactctgtacacgtaatggaaactgattttgccaagctcttacaaggtggttcatctatcgatggcatccgcatttggtatcttttacacttcaaccaaaaatttattaggtatttttcaatgctaagtcttgccttttattttttaatttcactgccaagtttgcagtggttctaagtgaatctgtgggcattttagcctgtggtcttgccagatctttgcgaattacaatgcatatatgtctatttattcaatatctgtcatataatatctatttggaagaagaaactttctcttgtagtgcctcttgacaaagcacaatttcccgcctttttttttttttgtgaaatgaaaaaaacaaattgtgttttattgcggtatcaacaatgtgaataaggattaacatattgtaaatgttcttttttccatgtaaatcaactatctttgttatcactaagtgataattaatttttaacttatgtgcattgttaggctgttagaattttttggttgttaaaataaacgcattcaataaatatga

SEQ ID NO: 887 - DNA, 3286 bp, Homo sapiens
ctgaggcggcgacgagtggtaggagtcttctttcccctccttcccctttcccttcccttcccgggagaggctgggacccggcaccagggcagtactgtggccgctgcggcctcagctccgactgggtcaggttgcggagactccaggccgcttccagggcgagtactcctgattgtgacatcacattcatcccctgggcgatggagcttgtcactgggaaggaatactcagtcggagaatagccaacaagatgggttactgggagaatctcttcagtggcactgagtggaggcatcagggggttggagccttgtgaacagggaacctgccccccaacacttggaaggacctgggtttcagtgatgagacatggggtatgatgtaacccgtttccagggggatgttgacgaagatcttatctgccctatttgcagtggagtcttggaggagccagtacaggcacctcattgtgaacatgctttctgcaacgcctgcatcacccagtggttctctcagcaacagacatgtccagtggaccgtagtgttgtgacggtcgcccatctgcgcccagtacctcggatcatgcggaacatgttgtcaaagctgcagattgcctgtgacaacgctgtgttcggctgtagtgccgttgtccggcttgacaacctcatgtctcacctcagcgactgtgagcacaacccgaagcggcctgtgacctgtgaacagggctgtggcctggagatgcccaaagatgagctgcccaaccataactgcattaagcacctgcgctcagtggtacagcagcagcagacacgcatcgcagagctggagaagacgtcagctgaacacaaacaccagctggcggagcagaagcgagacatccagctgctaaaggcatacatgcgtgcaatccgcagtgtcaaccccaaccttcagaacctggaggagacaattgaatacaacgagatcctagagtgggtgaactcccttcagccagcaagagtgacccgctggggagggatgatctcgactcctgatgctgtgctccaggctgtaatcaagcgctccctggtggagagtggctgtcctgcttctattgtcaacgagctgattgaaaatgcccacgagcgtagctggccccagggtctggccacactagagactagacagatgaaccgacgctactatgagaactacgtggccaagcgcatccctggcaagcaggctgttgtcgtgatggcctgtgagaaccagcacatgggggatgacatggtgcaagagccaggccttgtcatgatatttgcgcatggcgtggaagagatataagagaactcgactggctatcaggaagagatggaaatcagaaaatcccatcactccagcagctgggacctgagtcctacccaccattcttaatactgtggcttatacctgagccacacatctccctgcccttctggcactgaagggccttggggtagtttgctcagcctttcaggtgggaaacccagatttcctccctttgccatattcccctaaaatgtctataaattatcagtctgggtgggaaagcccccacctccatccattttcctgcttagggtccctggttccagttattttcagaaagcacaaagagattcaatttccctggaggatcaggacagaggaaggaatctctaatcgtccctctcctccaaaaccagggaatcagagcagtcaggcctgttgactctaagcagcagacatcctgaagaaatggtaagggtggagccaaatctctagaaataagtagtgaggccgttaattggccatcactgatggcccttagggaaagactggacctctgtgccaagcagtatccctgttcagcccaccttaaaggtgtaggcacccactgggtctaccagtatgcaggttgggatactgaaaatttccagatgagctcttctttcctacaagttttcataattagggaatgccagggtttagggtaggggttaatctgttgggggttgatgtgtttagcaagaagctactcctagcttttgctaaaatatggttggcactgcctcttgtggcacaggccataattgttccatagacccctctctagccctgtgactgtagttagttactttgataattttctttggccattgtttgtttatatttcacaaactccacctactgcccccccccctcttttttttaagaatggcctgatcatggctatctcagccacattgttggcaatttaatttatttacttcctttttttttttttaagaaaggaaaaaagaaaaaaaaatcaaacttgaaacttttcttttgatgttcctattgtgggggttctggatagggtgggacagggatgggggtgtgttttatattttttccttttcagcacaacctttggctttaatataggaagagccaagggagtcctcggctgaacttacgatatctgccccaaacctctgtaaccccaactgaaatgaggagcttcctctcttcctgtgaaggatatgacagtccagcatcgatgcctgtgccctctggaaaaatttcctcctagcccttccagggccttatcataaaactctggatttagagtattcattttgaaggcaactcccccttccccaagtttccttggagctgtatagctgggttctaagcttcaccatgcaaatcagaaattttatctctaagtacaggctgtgccgtgtctcacccacacccccctggggacttcagttccatttcaggttacctggggtataccttgatccctagagtgactggcagagtaagagaaggggagagataataggtgtgattattttaatatggaggtgggagtgtggttggagatagaaaggctcctccccaccatgtaatggcttcctctcagaattttattccaggctagcttgctgcaggtctgggtagttggatcatggctccactgggattggggtggaaagcttgaggggagtagggttccagctctgggacattgtgctcaggaatttgaaaacgctgctatacttactctggttactacatttcttccactcccctttcccctacctgccttaaccaaggctcatactgtcctgtccttaccctcagatggagccaggaagctcagtgaaaggcttccctaccctttgcactagtgtctctgcaggttgctggttgtgttgtatgtgctgttccatggtgttgactgcactaataataaaccttttactcaactctctaaaaaaaaaaaaaaaaaaaa

SEQ ID NO: 888 - DNA, 5822 bp, Homo sapiens
gatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaactattcttactgtgctgtgaatttatatcttcttctgcaagacctggggctatttttttttcttaaggtatgaaatcaatttcaataaccttaaacaattgaccctctgtcaggcatatgtcaggctccactcttaaggagtcagtgaccatgacctctttgcatatcctggaaaaatgacatcatcaaagtatagttgataatgttataaaggatgattttaaaaatagggtataatcatgactcacaaagatatgaggctgggtgtggtggctcacgcctgtaatcccagctctttgggaggctgaagcgggtggatcatgaggtcagaagatcaagaccatactggctaacacggtgaaaccccgtctctactaaaaatacaaaaaaaaaaaa

SEQ ID NO: 889 - DNA, 3352 bp, Homo sapiens
gtctccttgcggccggcggggtgctgggttcccgtctgctgcctctcggagagtcccgggtgactgccgcaggctccatcgccctgtggcctgcaggtattgcgagatttatagggaggacgctgggacccccaaaagctgggaaatgggactattggcattcagggatgtggctctagaattctctccagaggagtgggaatgcctggacccagctcagcggagtttgtatagggatgtgatgttagagaactacagaaacctgatctcccttggtgaggatagcttcaatatgcaattcctatttcacagtcttgctatgtctaagccagaactgatcatctgtctggaggcaaggaaagagccctggaacgtgaacacagagaagacagccagacactcagttttgtcttcttatcttactgaagacattttgccagagcagggcctgcaagtttcattccaaaaagtgatgctgagaagatatgaaagatgttgtcttgagaaattacgcttaaggaatgactgggaaattgtgggtgagtggaaagggcagaaggcaagttataatggacttgacctatgctcagcaactactcatagcaaaaactttcaatgcaataaatgtgtgaaaggttttagtaaatttgcaaatctaaataaatgtaagataagccatactggagaaaaaccattcaaatgcaaagaatgtggcaatgtctcttgcatgtctttaataatgactcaacagcagagaatccatattggagagaacccgtaccaatgtaaaaaatgtggcaaagcctttaatgagtgctcatgctttactgactgtaagagaattcatgttggagagaaacattgcaaatgtgaagaatgtaataacatttttaagtcttgctcaagtcttgctgttgttgagaaaaatcatactgaaaagaaaacctacagatgtgaagaatgtggcaaagcttttaacctgtgctcagttcttactaaacataagaaaattcatactggagagaaaccatacaaatgtgaagaatgtggcaaatcctttaagttgttcccataccttactcaacacaagagaattcatagtagagagaaaccctacaagtgtgaagaatgtggcaaagtctttaaattgttgtcataccttactcaacatagaagaattcatactggagagaaaaccttccgatgtgaagaatgtggaaaagcctttaaccagagctcacatctgactgaacataggagaattcatactggtgagaaaccatacaaatgtgaggaatgtggcaaagcttttacctggttctcataccttattcagcataagagaattcatactgggcagaaaccctacaaatgtgaggaatgtggcaaagcttttacctggttttcataccttactcaacataagagaattcatactggagagaaaccctacaaatgtgatgaatgtggcaaagcttttaactggttttcatatcttactaatcataagagaattcatactggagagaaaccctacaaatgtgaagaatgtggcaaagcctttggccagagctcacacctttctaaacataagacaattcataccagagagaaaccatacaagtgtgaggaatgtggcaaagcctttaaccactctgcacaacttgctgtacatgagaaaactcatacctgagaaaaaccctacaattctaaacaatatggcatagtctttaatacctattcacaacttcacagcagaatatttttactgaataagagtgttacaaatgtaatgactgtcaaaaggccatttacagtctatgagcctttgagtgcactaaaatgtttaggctacgaacaatacaaatagaccggttcaacacctccacttatatcacagctcttactgtacacagaagaatttatactggagggaaaccctccagttgctcaaactgtattcaatttcaaagactttgtattggagagaaaccctacaaatgtaataaatgcagaaacaacatttgttcaaaaaatatacctcagaaaacaccagagtgttcacactaaaaactgttttacagatgcagtaaatgtgaaaaaatgtctaatcaaaaattacatcaaaacacatccaagaattcatagtaaaaagcactaagtcactgacactttcagacattactgtaaatctgagtgttggttatagagaataattcaaagttaagttaaagtaagtaggagattcaccttttggggaagttataattacatttcaagtataccttttggtgccaggcacggtggctctttcctatagttgctgcacttttggatgccgaggtcgggggattgcttgagcccaggagtttgggaccaggctgggcaacatggcaaaacctcatctctacaaaaagtaaaataaaagccaggcttggtggcacatgcctgttgtcccagctacttggaaggctcaggtgggaggattgcttgagcctggaggttgaggatgcagtgagctgctatctggcaacttcactcctgcctgggcaacagagcaagaccctttctcaataataataataacaacataataataaagtatactcggtgcactgaaagagttttagcttttttgaaaatcacatatttatgtaattcaagtcttaaatcacttgataccatgccttcatttctagtgtttatgtgaaggcatgaggcctactgttgctacatgaaagctgtgagagtttcttctatattcgggtgggtgttgttcatatccttttctttggaagattatggacattgcattgtaagcttcctgaagaaatttaactggagaggctctttgtacttgtcttataatagggttgtaagtgattcatgagataggtcttcagagtactattctgcattatatttaagaaagaaacatttgagttttacaagtcagttgtttttcctattgcacattaaggtaataaaattcagtggattttgaaatgctctttttagactgtttgaacttaatttgttttaataagacattgttttaatgtctttggaccgttgtacattaagtgatgcgtatcctaccaccaacgttaacctatctcaccttagttacggttgtaggtaacaaatggtaacaatacaatagtgggtaacatggtggaatagtatctctaatgatcccttctcccagtggcattaaacttcaaataatttgaaaaatattgttcccacacgttacaccttcattctgtttgctctttttgtaatgacagtgtcattattaaggctataataaagcctatataggattataatcaaaaaaaaaaaaaaaaaa

SEQ ID NO: 890 - DNA, 4712 bp, Homo sapiens
acccccgagaaagcaacccagcgcgccgcccgctcctcacgtgtccctcccggccccggggccacctcacgttctgcttccgtctgacccctccgacttccggtaaagagtccctatccgcacctccgctcccacccggcgcctcggcgcgcccgccctccgatgcgctcagcggccgcagctcctcggagtcccgcggtggccaccgagtctcgccgcttcgccgcagccaggtggcccgggtggcgctcgctccagcggccggcgcggcggagcgggcggggcggcggtggcgcggccccgggaccgtatccctccgccgcccctcccccgcccggccccggcccccctccctcccggcagagctcgcctccctccgcctcagactgttttggtagcaacggcaacggcggcggcgcgtttcggcccggctcccggcggctccttggtctcggcgggcctccccgccccttcgtcgtcctccttctccccctcgccagcccgggcgcccctccggccgcgccaacccgcgcctccccgctcggcgcccgcgcgtccccgccgcgttccggcgtctccttggcgcgcccggctcccggctgtccccgcccggcgtgcgagccggtgtatgggcccctcaccatgtcgctgaagccccagcagcagcagcagcagcagcagcagcagcagcagcagcaacagcagcagcagcagcagcagcagcagccgccgcccgcggctgccaatgtccgcaagcccggcggcagcggccttctagcgtcgcccgccgccgcgccttcgccgtcctcgtcctcggtctcctcgtcctcggccacggctccctcctcggtggtcgcggcgacctccggcggcgggaggcccggcctgggcagaggtcgaaacagtaacaaaggactgcctcagtctacgatttcttttgatggaatctatgcaaatatgaggatggttcatatacttacatcagttgttggctccaaatgtgaagtacaagtgaaaaatggaggtatatatgaaggagtttttaaaacttacagtccgaagtgtgatttggtacttgatgccgcacatgagaaaagtacagaatccagttcggggccgaaacgtgaagaaataatggagagtattttgttcaaatgttcagactttgttgtggtacagtttaaagatatggactccagttatgcaaaaagagatgcttttactgactctgctatcagtgctaaagtgaatggcgaacacaaagagaaggacctggagccctgggatgcaggtgaactcacagccaatgaggaacttgaggctttggaaaatgacgtatctaatggatgggatcccaatgatatgtttcgatataatgaagaaaattatggtgtagtgtctacgtatgatagcagtttatcttcgtatacagtgcccttagaaagagataactcagaagaatttttaaaacgggaagcaagggcaaaccagttagcagaagaaattgagtcaagtgcccagtacaaagctcgagtggccctggaaaatgatgataggagtgaggaagaaaaatacacagcagttcagagaaattccagtgaacgtgaggggcacagcataaacactagggaaaataaatatattcctcctggacaaagaaatagagaagtcatatcctggggaagtgggagacagaattcaccgcgtatgggccagcctggatcgggctccatgccatcaagatccacttctcacacttcagatttcaacccgaattctggttcagaccaaagagtagttaatggaggtgttccctggccatcgccttgcccatctccttcctctcgcccaccttctcgctaccagtcaggtcccaactctcttccacctcgggcagccacccctacacggccgccctccaggcccccctcgcggccatccagacccccgtctcacccctctgctcatggttctccagctcctgtctctactatgcctaaacgcatgtcttcagaagggcctccaaggatgtccccaaaggcccagcgacatcctcgaaatcacagagtttctgctgggaggggttccatatccagtggcctagaatttgtatcccacaacccacccagtgaagcagctactcctccagtagcaaggaccagtccctcggggggaacgtggtcatcagtggtcagtggggttccaagattatcccctaaaactcatagacccaggtctcccagacagaacagtattggaaatacccccagtgggccagttcttgcttctccccaagctggtattattccaactgaagctgttgccatgcctattccagctgcatctcctacgcctgctagtcctgcatcgaacagagctgttaccccttctagtgaggctaaagattccaggcttcaagatcagaggcagaactctcctgcagggaataaagaaaatattaaacccaatgaaacatcacctagcttctcaaaagctgaaaacaaaggtatatcaccagttgtttctgaacatagaaaacagattgatgatttaaagaaatttaagaatgattttaggttacagccaagttctacttctgaatctatggatcaactactaaacaaaaatagagagggagaaaaatcaagagatttgatcaaagacaaaattgaaccaagtgctaaggattctttcattgaaaatagcagcagcaactgtaccagtggcagcagcaagccgaatagccccagcatttccccttcaatacttagtaacacggagcacaagaggggacctgaggtcacttcccaaggggttcagacttccagcccagcatgtaaacaagagaaagacgataaggaagagaagaaagacgcagctgagcaagttaggaaatcaacattgaatcccaatgcaaaggagttcaacccacgttccttctctcagccaaagccttctactaccccaacttcacctcggcctcaagcacaacctagcccatctatggtgggtcatcaacagccaactccagtttatactcagcctgtttgttttgcaccaaatatgatgtatccagtcccagtgagcccaggcgtgcaacctttatacccaatacctatgacgcccatgccagtgaatcaagccaagacatatagagcagtaccaaatatgccccaacagcggcaagaccagcatcatcagagtgccatgatgcacccagcgtcagcagcgggcccaccgattgcagccaccccaccagcttactccacgcaatatgttgcctacagtcctcagcagttcccaaatcagccccttgttcagcatgtgccacattatcagtctcagcatcctcatgtctatagtcctgtaatacagggtaatgctagaatgatggcaccaccaacacacgcccagcctggtttagtatcttcttcagcaactcagtacggggctcatgagcagacgcatgcgatgtatgcatgtcccaaattaccatacaacaaggagacaagcccttctttctactttgccatttccacgggctcccttgctcagcagtatgcgcaccctaacgctaccctgcacccacatactccacaccctcagccttcagctacccccactggacagcagcaaagccaacatggtggaagtcatcctgcacccagtcctgttcagcaccatcagcaccaggccgcccaggctctccatctggccagtccacagcagcagtcagccatttaccacgcggggcttgcgccaactccaccctccatgacacctgcctccaacacgcagtcgccacagaatagtttcccagcagcacaacagactgtctttacgatccatccttctcacgttcagccggcgtataccaacccaccccacatggcccacgtacctcaggctcatgtacagtcaggaatggttccttctcatccaactgcccatgcgccaatgatgctaatgacgacacagccacccggcggtccccaggccgccctcgctcaaagtgcactacagcccattccagtctcgacaacagcgcatttcccctatatgacgcacccttcagtacaagcccaccaccaacagcagttgtaaggctgccctggaggaaccgaaaggccaaattccctcctcccttctactgcttctaccaactggaagcacagaaaactagaatttcatttattttgtttttaaaatatatatgttgatttcttgtaacatccaataggaatgctaacagttcacttgcagtggaagatacttggaccgagtagaggcatttaggaacttgggggctattccataattccatatgctgtttcagagtcccgcaggtaccccagctctgcttgccgaaactggaagttatttattttttaataacccttgaaagtcatgaacacatcagctagcaaaagaagtaacaagagtgattcttgctgctattactgctaaaaaaaaaaaaaaaaaaaaatcaagacttggaacgcccttttactaaacttgacaaagtttcagtaaattcttaccgtcaaactgacggattattatttataaatcaagtttgatgaggtgatcactgtctacagtggttcaacttttaagttaagggaaaaacttttactttgtagataatataaaataaaaacttaaaaaaaatttaaaaaataaaaaaagttttaaaaactgaaaaaaaaaaa

SEQ ID NO: 891 - DNA, 916 bp, Homo sapiens
ggacgcagagaagccagagactttcgcttccggctgccgcaggcgcttcgctggtgcaggtaagctccgcacactctcggccggtcccgagtccgactccctcaagggtgacgcgagctctgccctttaaccggaaacgtctccctgctcaccccacccccgcgcagacgcagtgctgagcacacagctaccggacaaagagtgacgcccggagctggagttatggcggctacggagccgatcttggcggccactgggagtcccgcggcggtgccaccggagaaactggaaggagccggttcgagctcagcccctgagcgtaactgtgtgggctcctcgctgccagaggcctcaccgcctgcccctgagccttccagtcccaacgccgcggtccctgaagccatccctacgccccgagctgcggcctccgcggccctggagctgcctctcgggcccgcacccgtgagcgtagcgcctcaggccgaagctgaagcgcgctccacaccaggccccgccggctctagactcggtcccgagacgttccgccagcgtttccggcagttccgctaccaggatgcggcgggtccccgggaggctttccggcagctgcgggagctgtcccgccagtggctgcggcctgacatccgcaccaaggagcagatcgtggagatgctggtgcaagagcagctgctcgccatcctgcccgaggcggctcgggcccggcggatccgccgccgcacggatgtgcgcatcactggctgagcggtggagctgcgggcggccagggccgggcgctctgtgcggactggggccatgatcgggcccgggggcctgagcctgggaccccaccccgtgttaatgaaaaatgagttttggcagcgccaaaaaaaaaaaaaaaaaaaaaaaaaaaaaaaaa

SEQ ID NO: 892 - DNA, 3353 bp, Homo sapiens
tccggtgctcagtggctagccgaatagccgtgtttgggacctgggctcgggcttcttgcgtccccgctaagaacatgtcacggggccgaatcgtccgtattctctcagcttcaagctcctctacttttcaaccaggtcactagcccttgactcctcttatcaaacttccggaactgccaccccaccagtgactccacaggcaccagggcatgcaacagggctgggacaggaaggctctcttcttcacctcaagcctgctgggctaacacttgcgatttttactagagttaactttgtaatgtatgtctctgactctagaatttcaagagaagttccacttagtgactcctaagtggaagttctaagatggcttcccagtgaggtgatgaagaggtttgagctttagagtgcggttgcaaagctcttctctgacctgaacaatggctgtagctgtggaccaacaaatccagactccttcagtacaagatctccaaatagttaaactggaagaagattcccactgggagcaggaaatttcccttcaagggaattaccctggaccagagacatcctgccagagcttttggcatttccgttaccaagaagcatcacgaccccgagaggccctcctccagctccagaagctctgttgtcagtggctaaggccagagaagtgtacaaaagagcagatcctggagttgctggtcctagaacagttcccgactgtccttctccaggagatccagatctgggtcagacagcagcatccggagagtggagaggaggcagtggccctggtggaagacttgcagaaagaacctggaagacagaggctggagcctcgggcgaggccgtccggccgcacccctcctgctcagctgcggtcgccatggccaatgacagctgcgggcccggcgagccgagctcgagcgagcgagaccggcagtactgcgagctgtgcgggaagatggagaacctgctgcgctgcagccgcagctccttctgctgcaaggagcgccagcgccaggactggaagaagcacaagctcgtgtgccagggcagcgagggcgccctcggccacggagggggccctcaccaggactccggccccgcgccgcccgctgcagcgccgccgtccagggaccgggccctggaggccaggaaggcagcgaggcgccgggacagcgcctccggggacgcagccaaggcaaaggccaagtccgcggccgaccccgcggcggccgcgtccccgcctcgcgcgtccccgggccggacaaaagccatggctgcttgttatccggtcaatggaacgggttatgtacgtcatgttgataatccaaatggagacggaagacgtgtgaaatgtattacattacgttaaagaacgggatgccaaggtaagtggaggtatacttcgaatttttctagaaggtaaagcctagtttgctgacattgaacccaaatttgatagactgctgtttttctggtctgaccatcgcaaccctcatgaagtacaaccagcatatgctacaaagtacgcaataactgtttggtatttgatgcagatgagagagcacgagctaaagtaaaatatctaacaggtgaaaaaggtgtgaggattgaactcaataaaccttcagattcagtcagtaaagacgtcttatagagcctttgatccagcaataccccacttcacctacaataattgttgacgctatttgttaatttgtgaatacgaataaatgggataaagaaaaatagacaaccagttcgcattttagtaaggaaacaaacaactttgtgtgttgcatcaaacagaagattctgactgctgtgactttgtaccgcatgatcaacttagaatctgtgattgcttacaggaagaagataagctactaatagaaaatgtttttacctctggatatgaaataagtgccctgtgtagaatttttttcattcttatattttgccagatctgttacgtagctgagttaatttcatctctacttttttaatatatgtcaagtttgaattggaataatttttctatgattaggtacaatttatcaaaactgaattgagaaaaaattacagtatttctcaaaataacgtcaatctatttttgtaaacctcttcatactattaaattttgccctaaaagacctcttaataatgattgttgccagtgactgattaattttattttacttaaaataagaaaaggagcactttaattacaactgaaaaatcagattgttttgcagtccttcctatcttacactaatttgaactcttaaagattgctgcttttttttgatattgtcaataatgaaacccaattgtaaaacagtcaccatttactaccagtaacttttagttaatgtcttacaaggaaaaagacacaataagaagagtttaattttttttttttttttgacctgggcgacagagtgagactccgtctcaaaaaaaaaaaaaaaaagaaatgtttcattttggtttttcaccaaccttcctttgataggacaaagcagatactaagagggggaggaaaggctgttctgtgtctgaacccagttgggctagtccccaagaggagctgagagccatgtactctaatgcctcccttttcttcccccagccctgcctgatgtggctctgggaattcctgcagagaagagcaggggtggccaggagatagtgagcagctcccaggaggcatggagggatccagaacctggactgaagaaccacctagaaataactcagcagaattctgaaaatgaggtcacgctgggtaagaatgcctttttttttttttcatagtcaaagttagctatggagtttctgtagtattcactactccagacctttttcaagttgaattttttttctttttccctatgtctgttcttacgtattttttttaaacttttatttcagtagtgtttggggaacaagtagtgtttggttgcatggaaaagttcttcagtggtgatttctgagattttggtgcacccatcacccaagggtagtcttttttatccatcaagtctgtacccaatgtgtagtctttgtttttttcttttttttttttttgagactgagtctcattctatcacccaggctggagtggagtggtatgatcttgactcactgcaacatctgcctcccgggttcaagtgattctcctgcctcagcctcctgagtcgctgggattactgtgatcatgccactgcattccagcctgggcgacagagtgagacccagactcagctgaaaaataataatattattaaaagaatttaaaataaagtgttccatagatgtgaaaaaaaaaaaaaaaaaaaaaa

SEQ ID NO: 893 - DNA, 3293 bp, Homo sapiens
cccgcgtctccgctccctccctgcgcagcggaaacatggcggcgggaagagagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagataccaaaaaaaaaaaa

SEQ ID NO: 894 - DNA, 2842 bp, Homo sapiens
gtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgcaggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcaaaaaaaaaaaaaaaa

SEQ ID NO: 895 - DNA, 4212 bp, Homo sapiens
ggcagtggcggttgcggggcatgcgcggctccgcgcgcggcttctcaaacatggcggcggcggtgtgaagctcggtgccggctcgcgcgatcggtgggacagaatttcgttgttttcaccgacgagactggaggaaacaacaccaaatagggataccatgggacaaacagtgaatgaagattccatggatgtcaagaaggagaatcaagagaaaactcctcagtcaagtacatcttctgtacaaagggatgatttccactgggaggagtatttgaaagagactgggtctataagtgctccttcagagtgcttccgtcagtctcagattccacctgtgaatgatttcaaagttggtatgaaattggaagcccgtgaccctcgcaatgccacttcagtatgtattgctacggttattggaattactggggccaggttacggttacgactggatggtagtgacaacagaaatgatttttggaggcttgtcgattccccagacatacaacctgttgggacatgtgaaaaggaaggagacttacttcaacctccactagggtaccagatgaatacatcctcctggccgatgttcctcttaaagacactaaatgggtctgaaatggcatctgccacattatttaagaaggaaccaccaaagcccccactaaataattttaaagtggggatgaaactggaagctattgacaaaaagaacccgtatctcatctgtcctgcgaccattggagatgttaaaggggatgaagttcatatcacatttgatggctggagtggagcttttgattactggtgcaagtatgattctcgagatattttcccagctgggtggtgtcgcctgacaggagatgtattacaacccccaggaactagtgttcctattgtaaagaatatagcaaaaacagagtcttctccttccgaagcaagccagcattcaatgcagtctccacagaaaactactctaatattaccaacacagcaggtcaggagatcaagtcgaattaaaccacctggacctactgcagtccccaaaaggagcagttctgttaaaaatatcacaccaaggaaaaaaggtccaaactcaggaaaaaaggaaaaacctttgcccgtgatatgttctacatctgcagcttctctaaaatcgctgaccagagaccgtggcatgttatataaagatgtcgcttctgggccatgtaaaatagtgatgtctacagtctgtgtctatgtaaacaaacatggaaactttggccctcatctggatcccaagagaatccagcagctgcctgaccacttcggcccgggcccggtgaatgtggtgcttcgccggattgtgcaggcctgtgtggattgtgcccttgaaactaaaactgtttttggatacctgaagccagataatcgtggaggagaagtgataactgcctcctttgatggggaaactcattccatccagctccctccagtgaacagtgcatcatttgctcttcgctttcttgagaacttctgccacagtctgcagtgtgataaccttttgagtagccagccttttagttcttccaggggtcatactcacagctctgcagagcatgataaaaatcagtcagcaaaagaagatgtaacagaaaggcaaagcaccaaacgatctcctcagcaaactgtaccatatgttgttcctctctctcctaagctccccaaaacaaaggagtatgcgtctgaaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaagctccaagttatatagctgtacctgatcccagtgtcctgaaacaaggcttctctaaggacccttcaacctggtctgtggatgaagtgatacagtttatgaaacatacagatcctcagatatcaggccccctcgccgacctcttcaggcaacatgaaattgatgggaaggctctgttcctactcaagagtgatgtgatgatgaagtatatggggctgaagctggggccagcattaaagctgtgttactacattgaaaagcttaaagaaggaaaatacagttaaaaaaatgtgtaagtttagattggacataattctcaggtgtactgttaacattttaatttaaaagtatttctcttagcagtttttgttttgtagacagttcccataaaaatattttatcagaattgcagaactgtagtaacagttcagtcaactttgtttttttcctggagtcaccaaccagctttgggagacacagccgccactcccccagtctacttctttaaaaagcatttaacaggttagtattggcatattcaaattggcagttctttatgtctttttaaattttcattgtacagtttacaaatatacttaatgtagttaacagagaaaaacctttgattttggttaacctttatatctagaaccaaaacagctaaatcccaaaggggaaaatatcagggattgacaacttctataattaaatccatgagaatttttcctcactagagaatttaaaggtgcacctgtagatatcatcttttctcagatattttgtgtgatactctgtggtgttctgttcatgttctatcagtatatctagaaagggaatagccatataaattattttccttttattatttctctgtatgttgtatttgatcatatttaaaggaaaaaagcaagcttataagctttcatgaagtgttcttaccagtttttgataaattttttaaattataggatagaattgtcattttatgcaggagatatttatactacgagggttgtttggatggagtcagattaaattttttcagtgaaattcctattattttaaaactttccatattttcactacgcttggacatttaactaggcattcttttcttacatctctatatgaagatacctgtgtccaaaatttttgaagatatatattgtatgtgtttattcttcatatggtactttaccatatttatatattgttttatacctgtaggtttacacacaagtaaatcttttttttcttgaatttaatctggcactttgcactgccacagaggtgacgatgaactatgtatatagttagatgttttgatttcgtaaaaaatatatgtccatcgtttgctatcaccagtacctctcagcttactcttcaggggatatgaaacaatctgtagattggtttccatacagggaagttctctgtcctatgcaatgtttctaattaatttgcttagttctgagccatttattctgctacactttgaaagatatattagttctgacttattgtttggggctttattttatttttatttttttgagatggagtttcactcttgttgcccaggctggagtgcaatagctcgatctcggctcactgcaacctcgcctccctggttcaagcaattctcctgcctcagcgattacaggaatgcaccaccacgcccagctaattttgtagagatggggtttctccatgttggtcaggctggtctcaaactcctgacctcaggtgatccgcccacctcggccttgcaaaatgctgggattacaggcatgagccaccatgcccagccatgtttggggctttattttataagttagaactttgaagaggaaatggtgctatatgtttattgttattactttgtgtaactttgatgtaatgtttataagctatgagaatcagttataaaagtattagccatttgttgtaaatgccaataaaatattcaccaggggcaagaatgtacattttctttttagaaaaccaaatgtactttagacatgaatgcaactatttaaagaatagcttcatttatgttattccttacatgtcataagattcttacttaaacttggtcttctttcaagttgtttgtatgaagatgctgtacccacttgaacagtcctcaggtgtttacataaatactatgttttacagttttcatattttaaaatattaataaagttaatcgcaacgattcaaaaaaaaaaaaaaa

SEQ ID NO: 896 - DNA, 4540 bp, Homo sapiens
gaatgcattagtctaatgagatgtttgcagctggagcgcagggctgctggagactaactgtgagctactaacacgggtggaagatagcttttgcaatactcggtttgcatgtgctgaaagtcatctgtcttctgagtcaacactcccgacctggtaaacaacctgctcagggctctggtgaacaagctgtagcacctcttctgcctgtgagcgatttgtcacctcattctgtaagactggcaccagcagaaatgcagtctcaaaggatcccggggagaaagcgaggccgaccctcacttcactccacgcctatgaagatggcagttcataacctttattctgcttcagctggctctttaccagcagtgaagatcccaaagaaaagagggcggaaacccgggtacaagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtgcctcaagcccttctcaggatgcgcaggatgccaggcggccacggagcaggaacccctccgcctggactgtggaggacgtggtgtggtttgtgaaggacgccgacccacaggctctggggcctcacgtggagctcttcagaaagcacgagattgatggcaacgctctgctgttgctgaagagtgacatggtcatgaagtacctgggcctgaagctgggacctgcactgaaactctgctaccacattgacaaactgaagcaagccaagttctgacttttttaaaaagacagaagcgaaacccaaaacaacagatcccaagattatcttctgccttaccaatatcccgccaacatcacaaactagactctcctcttaaaattaacagccacagagacgtggtctttttataaaacttgtgaatctttgccttttgaagaatttaacatggaccttttcgagaggctcctctgtgttcataatttgccaaaaaattacaaaagcctgtgatttttaacatccctgttatgctggtttctcttaaagtgggtcctatttgcataacgagagagtggggaactgaatgcttatgcccaaggagagttctggagggttcaaaggatgaaagaaggacctttgtccctgcggtctctgcagggacaaccccctcagcaccatctgcctctaactctgacctggggacctatccatgtgagccttgtttgcctcagctctggaagctgacttctgaagatgactgcctcaccttgcactgtctggaaaacttgaattattttacgccgtgaaagaaaaaggaaaaaaaaaaaaatcttttctgttcctagaaaatctgaagtactgtgtttctccgctagagggcagactgctaatgaaatttcaggaccctcactgactgcagtagcaggattgttcagtactgagtggatgggttagggtgtctgtgaacaagatctagcccacacagaaacaggggatttattccacagttagcaccacagattgcgacttgggaagaaaccatcagctagaggggtctagttcgtatccaatcattattgactgactgactgatactcaactagcaaaggcaagaatttggaagcacgctctacccagatgggactttggagttccttcccttccagagtccttattgaggtgttgaagtgttggcatgccgaagaatcttagtgacatttagccatgggtgtttctttaaaaaaggaaaagaaaatgtctcaacgaagctttgaaatgggagagtgttgatttctagttacattgctgggttatgtagttgtatctgtggctaatttttctagtcctcaacaaatacacagacatgctattatggggtttaattcaatttacaaataggttttccttcctcacagtggagtaatagaaaaaattgattttctgctcctttgcagctgtgtccagagacggacaatgaatccacaatttattaggcagaggcacaacttctccaccattcgttttatccttctcttttctctgtttccctccacctctcttcttcttctttcacactgagcagaaaacatatcttcaaaatgaattcgcctttgccatgtgcatattctcttccttaaaaggacatcaacagtgttggagatgaggagatgaacattagattttggaatttctgggagggagagggttagggatgactcagggcctcccttcgcccaaaggtgaatcagaaaaggcacccctttctctgggatacaacctgagcaggggtctcagctggcaagtggagcagggtgggggctcaacctcctcaccgcttgatcagctgccgttgtacagagcatgacctgtataaccttgagggcagccctgggtagatctgcagagtgaccctctatatagttagaatccagatgaaggccataagaaatagtccatgccatgccgttaggcccactttcatgtgcagtacttgagaaagcacatcgtagcctccttttcagacacacaaatggcggctggactgagagcatggcagagaaggggaggaggagaatgtactaaacttgctcactgaattgagcttgagttattagattgtagaagagcttgatgtctggtgattttgttacaggaagggggtcccgatccagaccccaagagagggctcttggatctcatgcaagaaagaattcagggtgagtccataaagtaaagtgaaagcaagtttattaagaaagtaaaggaaggaaagaatggctaccccatagtcaaagcagctctgagggctgctggttgcccatttttatgtttatttcttgatatgctaaacaaggggtggattattcatgcctcccccttttagatcatatagggtaacttcctgatgttgccatggcatttgtaaaccgtcatggcactggtggtagtatagcagcgaggacaaccagaggtcactctcgttgccatcttggttttggtgggttttagccaacttctttactgcaacctgttttatcagaaggtctttatgacctatatcttgtgctgacctcctgtctcatcctgtgactcagaatgctttagccatctgggaatgcagcccagtaggtctcagcctcattttacccagctcccattcaagatggagttgctctggttcaaatgcctctgacaggttcagcacctgagaaaagtaccttgaatcaggccttggggcagagtcttcaagattttaaggtgatagggcctgtctcttaagaatttattaatcgtaagtgctcactgctggtttagagttagatacatttccctcaaaacagccatgggcaggttatgtactcagaactgccagggtgaaaacaatgagatccagaaaaatcccacaacaatccaggtttttcactcctcttttttttctcaatcttccgatacttgtggtacctcttccatcaacagatacctcatgtagtgacttccagtatcaagttttcaaaacttcctacccaccctcatcagtgcctccttcactacagagtcacaaacattggtgctctcaaataaaaatcagccccaaacaatgtcaaagagatcccttgagtagttttcaggcgagagatatgttctcatttcaagtcttggagaaaactggatccatgttcacgtggaacttctctcgcggaggtgctatctcattttgcattaaactttaagcaggacagattgctgaagccatgatatttaaggtttgactttttaaaaatctcattactcttaaaataaatgctgccacatcagaaaaa

SEQ ID NO: 897 - DNA, 4446 bp, Homo sapiens
ggcactaaaggtttgcttccgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaagattgtgaaa

SEQ ID NO: 898 - DNA, 3527 bp, Homo sapiens
agtaacaaatgaagtgcgcgctgcgacacctcccagcccaccgaactccgccgccatttcctcgcttggcctaacggttcggccaatcccagcgcgcatcaagaaggactgaggctccgccaatcggaggccgccgatttcgacccttcgcctcggcccggcccaatccaggccccggccccgccgcccccggcccgcccccgcggtgccctctctcctccctctttgtgcgtctcgcgccgccgccgcccgccgcgtgagaggacgggctccgcgcgctccggcagcgcattcgggtcccctccccccgggaggcttgcgaaggagaagccgccgcagaggaaaagcaggtgccggtgcctgtccccgggggcgccatggcgaccggagcgaacgccacgccgttggacttcccaagtaagaagcggaagaggagccgctggaaccaagacacaatggaacagaagacagtgattccaggaatgcctacagttattccccctggacttactcgagaacaagaaagagcttatatagtgcaactgcagatagaagacctgactcgtaaactgcgcacaggagacctgggcatcccccctaaccctgaggacaggtccccttcccctgagcccatctacaatagcgaggggaagcggcttaacacccgagagttccgcacccgcaaaaagctggaagaggagcggcacaacctcatcacagagatggttgcactcaatccggatttcaagccacctgcagattacaaacctccagcaacacgtgtgagtgataaagtcatgattccacaagatgagtacccagaaatcaactttgtggggctgctcatcgggcccagagggaacaccctgaagaacatagagaaggagtgcaatgccaagattatgatccgggggaaagggtctgtgaaagaagggaaggttgggcgcaaagatggccagatgttgccaggagaagatgagccacttcatgccctggttactgccaatacaatggagaacgtcaaaaaggcagtggaacagataagaaacatcctgaagcagggtatcgagactccagaggaccagaatgatctacggaagatgcagcttcgggagttggctcgcttaaatgggacccttcgggaagacgataacaggatcttaagaccctggcagagctcagagacccgcagcattaccaacaccacagtgtgtaccaagtgtggaggggctggccacattgcttcagactgtaaattccaaaggcctggtgatcctcagtcagctcaggataaagcacggatggataaagaatatttgtccctcatggctgaactgggtgaagcacctgtcccagcatctgtgggctccacctctgggcctgccaccacacccctggccagcgcacctcgtcctgctgctcccgccaacaacccacctccaccgtctctcatgtctaccacccagagccgcccaccctggatgaattctggcccttcagagagtcggccctaccacggcatgcatggaggtggtcctggtgggcccggaggtggcccccacagcttcccacacccattacccagcctgacaggtgggcatggtggacatcccatgcagcacaaccccaatggacccccacccccttggatgcagccaccaccaccaccgatgaaccagggcccccaccctcctgggcaccatggccctcctccaatggatcagtacctgggaagtacgcctgtgggctctggggtctatcgcctgcatcaaggaaaaggtatgatgccgccaccacctatgggcatgatgccgccgccgccgccgcctcccagtgggcagcccccaccccctccctctggtcctcttcccccatggcaacaacagcagcagcagcctccgccaccccctccgcccagcagcagtatggcttccagtacccccttgccatggcagcaaaatacgacgactaccaccacgagcgctggcacagggtccatcccgccatggcaacagcagcaggcggctgccgcagcttctccaggagcccctcagatgcaaggcaaccccactatggtgcccctgccccccggggtccagccgcctctgccgcctggggcccctccccctccgccgcctccaccgcctggttccgccggcatgatgtatgccccgccccctcctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaataatgtatactgcgcgttctcttcactggtttatctgcagaaatttctctgggcttttttcggtgttagattcaacactgcgctaaagcggggatgttccattgaataaaagagcagtgtggttttctgggaaaaaaaaaaaaaaaaaa

SEQ ID NO: 899 - DNA, 12227 bp, Homo sapiens
tgagctgcgaggcccgagagtcagaacctgggggagagggatggtctctgcacgggggggagccggaggagccgccgccgctgccgacgccaccgccgcagccgccgccgccgccgccccggcacccgcctcccggcgctgacggtctcgtacgaagccggcgagggggagccagcagcggcggtcgccggcacgccgcccagcatggtccgggaaaccaggcatctctgggtgggcaacttacccgagaacgtgcgggaagagaagatcatcgagcatttcaaacgatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatggggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacagcagtgattccagcagtagttcaagtgatgattctccagctcgatcagttcagtctgcagcagtccctgcacccacttcccagttgctttcatctctggaaaaagatgagccccgtaaaagttttggcatcaaggtccagaatcttccagtacgctctacagatacaagccttaaagatggccttttccatgaatttaagaaatttggaaaagtaacttcagtgcagatacatggaacttcagaagagaggtatggtctggtattctttcggcagcaagaggaccaagaaaaagccttgactgcatcaaaaggaaaacttttctttggcatgcagattgaagtaacagcatggataggtccagaaacagaaagtgaaaatgaatttcgccccttggatgaaaggatagatgaatttcaccccaaagcaacaagaactctctttattggcaaccttgaaaaaaccactacttaccatgaccttcgcaacatcttccagcgctttggagaaattgtggatattgacattaagaaagtaaatggagttcctcagtatgcgtttctgcaatactgtgatattgctagcgtttgtaaagctattaagaagatggatggggaatatcttggaaataatcgcctcaagctgggttttggaaagagcatgcctacaaactgcgtgtggctagatgggctttcttcgaatgtgtcagatcagtatttaacacgacatttctgccgatatgggcctgtggtaaaggtggtgtttgaccgcttaaaaggcatggccctggttctctacaatgaaattgaatatgcacaagcagctgtaaaagagaccaaagggaggaaaatcggtgggaataaaattaaggtggattttgcaaatcgggaaagtcagctggctttttatcactgcatggagaaatctggtcaagacatcagagacttttatgaaatgttagccgaaagaagagaggaacgaagggcatcctacgactataaccaagatcgtacatattatgagagtgttcgaactccaggcacttatcctgaggattccaggcgggactatccagctcgagggagagagttttattcagaatgggaaacttaccaaggagactactatgaatcacgatactacgatgatcctcgggaatacagggattacaggaatgatccttatgaacaagatattagggaatatagttacaggcaaagggaacgagaaagagaacgtgaaagatttgagtctgaccgggacagagaccatgagaggaggccgattgaacgaagtcaaagtcctgttcacttgcgacgtccacagagtcctggagcgtctccctctcaggcagagaggttgccgagtgattctgagaggaggctttacagccgatcctcagaccggagtggaagctgtagctcactctcccctccaagatatgagaaactggacaagtctcgtttggagcgctatacaaaaaatgaaaagacagataaagaacgaacttttgatccggagagagtggagagagagagacgcttaatacggaaggaaaaagtggaaaaggacaaaactgacaagcagaaacgcaaaggaaaggttcactcccctagttctcagtcttcagaaacggaccaagaaaatgagcgagagcaaagccctgaaaagcccaggagttgtaataaactgagcagagagaaagctgacaaagagggaatagcgaaaaaccgcctggaactcatgccttgcgtggttttgactcgagtgaaagagaaagagggaaaggtcattgaccacactcctgtggaaaagttgaaagccaagcttgataatgacactgtcaaatcttctgccctggaccagaaacttcaggtctctcagacggagcctgcaaaatctgacttgtctaaactggaatcagttagaatgaaagtaccaaaggaaaaggggctttcaagccatgttgaagtggtggagaaggaaggcaggcttaaagccaggaagcacctcaagcctgagcagcctgcagatggggtaagtgctgtggatctggagaagctggaagccaggaaaaggcgctttgcagattccaatttaaaagcagaaaagcaaaaaccagaggtcaagaaaagcagtccagagatggaggatgctcgcgtgctttcaaaaaagcagcctgacgtgtcctctagagaggtcattctgctgagggaaggagaggctgaaagaaagcctgtgaggaaagaaattcttaaaagagaatctaaaaaaatcaaactggacagacttaatactgttgccagccccaaagactgtcaggagcttgccagtatttctgttgggtctggctcaaggcccagctcagacctacaagcaagactgggagaactagcaggtgaatctgtggaaaatcaagaagtccaatcaaaaaagcccattccctcaaaaccacagctcaaacagctgcaggtattagatgatcaaggaccagagagagaagacgttaggaaaaactattgcagtcttcgtgatgaaacacctgaacgtaaatcaggccaagagaaatcacattcagtaaatactgaagaaaaaattggcattgacatcgatcacacgcagagttaccgaaaacaaatggaacagagtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgattccattcaagaaccagtagttctgttccatagcagatttatggagctcacacggatgcaacagaaagaaaaagaaaaagaccagaaacccaaagaggttgagaaacaggaagatacagagaatcatcccaagaccccagaatctgctcctgagaataaagattcagaactgaaaactccaccttccgttgggcctccaagtgtcacagtcgtaactctagaatcagccccatcagcactagagaagaccactggtgacaaaacggtagaggcgcctttggtaacagaagagaagactgtggagccagctaccgtctcagaagaagcaaagcctgcatctgaacctgctcctgcccctgtggaacagctggaacaagtagacctgcccccaggagcagaccccgataaagaagctgccatgatgcctgcgggtgttgaggaaggttcatcaggtgaccagccgccttatctggatgccaagcctccaactcccggggcctcgttttcccaggcagagagcaacgtagatccagagcctgacagtacccagccactttcaaaaccagctcagaagtctgaggaagccaatgagccaaaggccgaaaagccagacgccactgcagatgctgagcctgatgcaaaccagaaagccgaagctgctcctgagtctcagcccccagcttctgaagatttagaggttgatcctccagttgctgcaaaggataaaaagccaaacaaaagcaagcgttcaaagacccctgttcaggcagctgcagtgagtatcgtggagaagcccgtcacaaggaagagtgagaggatagaccgggaaaaactcaagcggtccaattctcctcggggagaagcacagaagcttttggaattgaagatggaggcagagaagattacaaggactgcttctaaaaactctgctgcagaccttgaacatcccgaaccaagtttgcctctcagccgaacaaggcgccggaatgtaaggagcgtctatgcaaccatgggtgaccatgaaaaccgctctcctgtcaaagagcccgttgagcaaccaagagtgaccagaaagagattggagcgagagcttcaggaggctgcagcggttcccaccacccctcggaggggaaggcctccaaagacacgccggcgagccgatgaagaggaggagaacgaggccaaggaacctgcagaaacactcaagccacctgagggatggcggtcgccaaggtcccagaaaactgcagctggtggtggaccccaagggaaaaagggaaaaaatgaaccgaaggtggatgctacacgtcctgaggccaccactgaggtgggcccccaaataggcgtgaaagagagctccatggaacccaaggctgctgaggaggaggcagggagtgaacagaaacgtgacagaaaagatgctggcacagacaaaaacccccctgaaaccgcccctgttgaagttgtagagaaaaaaccggcccctgaaaaaaactccaaatcaaagagaggaagatctcgaaactccaggttagcagtggacaaatctgcaagtctgaaaaatgtggatgctgctgtcagtcccaggggggctgcagcacaggcaggggagagggaatctggggtggtggcagtctcccctgagaaaagtgagagtccccaaaaggaggatggtttatcatcccagttgaaaagtgatccagttgatccagacaaggaaccagagaaagaagacgtgtctgcctctgggccgtccccagaagccacccagttagccaagcagatggagctggagcaggccgtggaacacatcgcaaagctcgctgaggcctctgcctctgctgcctataaggcagatgcaccagagggccttgccccagaggacagggacaagcctgcacaccaagcaagtgaaacagagctggctgcggccatcggctccatcatcaatgacatttctggggagccagaaaacttcccagcacctccaccttatcctggagaatcccagacagatctgcaaccccccgcaggtgcacaggcgctgcagccttctgaggaaggaatggagacagatgaggctgtatctggcatcctggaaactgaggctgctacagaatcttctaggcctccagtcaatgctcctgacccctcagccggcccaacagataccaaggaagccagaggaaatagcagtgaaacctcacactcagtgccagaagccaaagggtctaaagaagtggaagtcactcttgttcggaaagacaaagggcgccagaaaacaacccgatcacgccgcaagcgaaacacaaacaagaaagtggtggctcctgtagagagccatgtccctgaatccaaccaagctcaaggtgagagtcctgctgcaaatgaggggacaacagtacagcaccccgaagccccacaggaagaaaagcagagtgagaaaccccattccactcctcctcagtcatgtacttctgacctaagcaagattccctccacagagaattcgtcccaagaaatcagtgttgaggaaaggactccaaccaaagcatctgtgcccccagaccttcccccacctccccagccagcaccggtggatgaggagcctcaagccaggttcagggtgcattccatcattgaaagtgacccggtgaccccacccagcgatccaagcatccccatacccacactgccttctgtaactgcagcaaagctctcacctcctgtcgcctctggggggatcccacaccagagcccccctactaaggtgacagagtggatcacaaggcaggaggagccacgggctcagtctactccatctccagctcttcccccagacacaaaggcctctgatgttgacaccagctccagcaccctgaggaagattctcatggaccccaagtatgtgtctgccacaagtgtcacttccacaagtgtcaccacagccattgcagagcctgtcagtgctgccccttgcctacatgaggccccgcccccgccagttgactctaaaaagcctttagaagaaaaaacagcacctccagtgacaaacaactctgagatacaagcctcggaggtgctggtagctgctgacaaggaaaaggtggctccagtcattgctcccaaaattacctctgttattagccggatgcctgtcagcattgacctggaaaattcacagaagataaccttggcaaaaccagctcctcaaaccctcactggtctggtgagcgcactcactggcctggtgaacgtctccctggtcccggtgaatgccctgaaaggccccgtgaagggctcagtgaccacactgaaaagtttggtgagcacccctgctgggcccgtgaacgtcctgaaagggcctgtgaatgttcttacggggccagtgaatgttctcaccactccagtgaacgccacggtgggcacagtgaatgccgccccaggcacagtcaatgccgctgcgagtgcagtgaatgccacagcaagtgcagtgaccgtcacagcgggtgcggttactgctgcatctggtggtgtaacggccacaacaggcacggtgacaatggcaggggcagtgattgcgccgtcaacaaagtgcaaacagagagcgagtgctaatgaaaacagtcggttccacccagggtccatgcctgtgatcgacgatcgtccggcagacgcgggctcaggggcggggctgcgtgtgaacacttctgaaggggttgtgctcctgagttactcagggcagaagaccgaaggcccacagcggatcagcgccaagatcagccagatccccccggccagtgcaatggacattgaatttcagcagtcagtgtccaagtcccaggtcaaacctgattctgtcacagcatcgcagcctccatccaaaggccctcaagctcctgcaggctatgcgaacgtggccacccattccacgttggtactgaccgcccagacatataatgcctctcctgtgatttcgtctgtgaaggccgataggccatccttggagaagcccgagcccattcacctctcggtgtccacgcctgtcacccagggaggcacagtgaaggttctcacccaggggatcaacacaccccctgtgctggttcacaaccagctggtcctcaccccaagcattgtcaccacaaacaagaagcttgctgaccccgtcacccttaaaatcgagaccaaggtccttcagccggccaacctggggtccacgctcacgccccaccaccctcctgctctgcccagcaaactgcctacagaagtcaaccatgtcccctcggggcccagcatcccagcagatcgaactgtctcccatttggcagctgcaaagctagatgctcattctcctcgaccaagtggacccgggccatcctcattcccaagggcaagccaccccagcagtactgcatctacggcgctctccaccaacgccacagtcatgctggctgcaggcatcccagtgccccagttcatctccagcatccacccagagcagtctgtcatcatgccaccccacagcatcacccagactgtgtccctgagccacctctcccagggcgaggtgagaatgaacactcccacgctgcccagtatcacctacagcatccggccagaagcgcttcactctcctcgggctccgctgcagccccagcaaatagaggtcagggccccacagcgtgccagcaccccgcagccagccccagctggtgtgcctgcactggcctcccagcaccctcccgaggaggaagtgcattatcaccttcctgtcgctcgagccacagcccctgtgcagtcagaggtactagtcatgcagtctgagtaccgactgcacccctatactgtgccacgggatgtgaggatcatggtgcatccacatgtgacggcagtcagcgagcagcccagggccgcggatggggtggtgaaggtgccaccagccagcaaggcccctcagcagccagggaaggaagctgccaagacaccagatgccaaagctgcccccacccccacccctgcccccgtccctgtccctgtcccccttcctgcccctgctcctgcccctcatggtgaggcccgtatcctcacagttacccccagtaaccaactccaggggctgcctctgacccctcctgtggtggtgacccatggggtgcagattgtgcactccagcggggagctgtttcaagagtaccggtacggcgacatccgcacctaccaccccccggcccagctcacacacactcagtttcccgccgcttcctctgttggcctgccttcccggaccaagacagctgctcagggccctcctcctgaaggtgagcccctgcagcctcctcagcctgtgcagtccacacagcctgcccagcctgcaccaccctgcccgccctcccagctcggtcagcccggccagccaccaagcagcaagatgcctcaagtgtcccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtggagacagattactgtctgctgctggctctgccctgtggccgtgaccaagaggatgttgtgagccagaccgagtccctcaaggctgccttcatcacttacctgcaggccaagcaggcggcagggatcatcaacgttcccaaccctggctccaatcagcctgcctacgtgctgcagatcttcccgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgtttttctcagcgcagttttgttttgtgtgtccattggattacaaactttattaaaaaatataaaacac

SEQ ID NO: 900 - DNA, 3757 bp, Homo sapiens
cgcctgcttttgcccgggtcctgagaacaggggctccccacactttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcgcgctcggggcctgcgctcagagcttggaaaactggagtttgcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacaggtccaggctcagctgcagctggaaggcgtggcccacgcgcacccgcacctgcacccgcacctggcggcgcacgcgccctacctgatgttccccccgccgcccttcgggctgcccatcgcgtcgctggccgagtccgcctcggccgccgccgtggtcgccgccgccgccaaaagcaacagcaagaattccagcatcgccgacctgcggctcaaggcgcggaagcacgcggaggccctggggctctgacccgccgcgcagccccccgcgcgcccggactcccgggctccgcgcaccccgcctgcaccgcgcgtcctgcactcaaccccgcctggagctccttccgcggccaccgtgctccgggcaccccgggagctcctgcaagaggcctgaggagggaggctcccgggaccgtccacgcacgacccagccagaccctcgcggagatggtgcagaaggcggagcgggtgagcggccgtgcgtccagcccgggcctctccaaggctgcccgtgcgtcctgggaccctggagaagggtaaacccccgcctggctgcgtcttcctctgctataccctatgcatgcggttaactacacacgtttggaagatccttagagtctattgaaactgcaaagatcccggagctggtctccgatgaaaatgccatttcttcgttgccaacgattttctttactaccatgctccttccttcatcccgagaggctgcggaacgggtgtggatttgaatgtggacttcggaatcccaggaggcaggggccgggctctcctccaccgctcccccggagcctcccaggcagcaataaggaaatagttctctggctgaggctgaggacgtgaaccgcgggctttggaaagggaggggagggagacccgaacctcccacgttgggactcccacgttccggggacctgaatgaggaccgactttataacttttccagtgtttgattcccaaattgggtctggttttgttttggattggtatttttttttttttttttttttttttttttttttgctgtgttacaggattcagacgcaaaagacttgcataagagacggacgcgtggttgcaaggtgtcatactgatatgcagcattaactttactgacatggagtgaagtgcaatattataaatattatagattaaaaaaaaaatagccgtgcactcttgaccccgtcagcgtccaacgtggaaaaggcgttacctcttctcccagcgctggccgcctggccactgagggccctttgcaaaaatcacgggtgtagagatggccctgggcgcgctgggagtgtggttgtgtttctgaaggggataaaagagggcacggtggtgccaagatatcagtttggtacctgagctgtttctggttgggaagcgtaaaagccagggagagatccagagagttttcaagtttttgcagatgtaggtggttccagcttttctttctcccctactccatcttctgcgttcccccagttcttttatttctttgttttttatttttgagacagagacttgctttgtcgcccaggctggagtgcagtggcgcaatgtcagctcactgccacctccgcctcccgggttcaagcgatgctcctgcctcagcctcccgagtagctgggactacaggcacctgccaccacccccggctaattttttgtatttatagtagagacggggtttcaccgtgttggccaggctcgtctcgaactcctgacctcaggtgatctgcccgcctcggcctcccaacgtgcccccagttttataaacagcagatagcaacttgtcgtcacagctggcatgggctggacagttgcttgaaatgacctaaccaaaaacattcaagggttctgcccccagatttcgggagatccacgttccatgttctgattggttttctgggaacacagcaaggggtttggtgacctccgagaagatccatctgcatgattggcattagttaccacagcctgcccagagagaaactatcttctcccaacatttactaacatccactggtcaactctcttatttccataacacatttgcatctttctggattcaagcttggtggttttctttcctaacttctgatttagatacttctccctgaggtggggataaaagaaaaaaaaaaacaacttctttttttcttccgcataacactttctatcttgtcactgagctgaactgtagatccatttggacccgtctcatttgtatcttctgatattctttatacaaaccaaaagtccccttcaacattttttatgtcaaaatgttacaaccgctgtaaaatgacggagagagagagaaagaatcccagacattaacggtattagagagtttgcctcattcatccatttttcttaaaagctggaaattaaaaaaaaaaaagagagagagaggcttt

SEQ ID NO: 901 - DNA, 3233 bp, Homo sapiens
cctcctccctctcctcccccacctcctgtcccattgatgtgttattattgggggggctggagcagtaaaaaaagaagaaggaaaaaaagagcggggctctgctggcagaggttgagcgccgggctgacgtgcggcggcgatggaagaacttacggcgttcgtctccaagtcttttgaccagaaagtgaaggagaagaaggaggcgatcacgtaccgggaggtgctggagagcgggccgctgcgcggggccaaggagccgaccggctgcaccgaggcgggccgcgacgaccgcagcagcccggcagtccgggcggccggcggaggcggcggcggaggaggcggaggcggcggcggaggaggcggaggaggtgtaggaggaggaggagcaggcggaggagctggaggagggcgctctcccgtccgggagctggacatgggcgccgccgagagaagcagggagccgggcagcccgcgactgacggagggtagaaggaagccaacgaaagctgaggtccaggctacgctgcttctcccgggcgaggcgtttcggtttcttgtgtccccggagctgaaagatcgcaaagaggatgcgaaagggatggaggacgaaggccagaccaaaatcaagcagaggcgaagtcggaccaatttcaccctggaacaactcaatgagctggagaggctttttgacgagacccactatcccgacgccttcatgcgagaggaactgagccagcgactgggcctgtcggaggcccgagtgcaggtttggtttcaaaatcgaagagctaaatgtagaaaacaagaaaatcaactccataaaggtgttctcataggggccgccagccagtttgaagcttgtagagtcgcaccttatgtcaacgtaggtgctttaaggatgccatttcagcaggatagtcattgcaacgtgacgcccttgtcctttcaggttcaggcgcagctgcagctggacagcgctgtggcgcacgcgcaccaccacctgcatccgcacctggccgcgcacgcgccctacatgatgttcccagcaccgcccttcggactgccgctcgccacgctggccgcggattcggcttccgccgcctcggtagtggcggccgcagcagccgccaagaccaccagcaagaactccagcatcgccgatctcagactgaaagccaaaaagcacgccgcagccctgggtctgtgacgccaacgccagcaccaatgtcgcgcctgtcccgcggcactcagcctgcacgccctccgcgccccgctgcttctccgttacccctttgagacctcgggagccggccctcttcccgcctcactgaccatccctcgtcccctatcgcatcttggactcggaaagccagactccacgcaggaccagggatctcacgaggcacgcaggctccgtggctcctgcccgttttcctactcgagggcctagaattgggttttgtaggagcgggtttgggggagtctggagagagactggacaggggagtgctggaaccgcggagtttggctcaccgcaaagctgcaacgatggactcttgcatagaaaaaaaaatcttgttaacaatgaaaaaatgagcaaacaaaaaaatcgaaagacaaacgggagagaaaaagaggaagggaacttatttcttaactgctatttggcagaagctgaaattggagaaccaaggagcaaaaacaaattttaaaattaaagtattttatacatttaaaaatatggaaaaacaacccagacgattctcgagagactggggggagttaccaacttaaatgtgtgtttttaaaaatgcgctaagaaggcaaagcagaaagaagaggtatacttatttaaaaaactaagatgaaaaaagtgcgcagctgggaagttcacaggttttgaaactgacctttttctgcgaagttcacgttaacacgagaaatttgatgagagaggcgggcctccttttacgttgaatcagatgctttgagtttaaacccaccatgtatggaagagcaagaaaagagaaaatattaaaacgaggagagagaaaaataatattaacacaaaaaaatgccacagacaatgatttctctgagaaattattatggcaaaactgtctggactgctgacagtaaattccggtttgcatgttacttgtattccattgatggtgtgtctcctcccacccccttatctcccatgcactcactccattttcatcttcactatgaaaaacaataccaaaagtatctggaaattgatatatatatatccatatatatatatcatatatttgccatatatatatatatatatatatatatatatatatatatatatttgccctgtctttgatcctggggaacaaaagaaaaaagtcagaaagggaaaaaattacactcattgtcctaagaagacagaggtgggcagaatatgtggggaaaggaaaaagaaaacaagaccaccaaatgaaataatgaaggtacagcgcctcgctgtgccagacacagtaggcgctcaatcagtattagttcccaccattccccttttcttgtgttccttcttgttggtttcctgaagtcctatttgaagacagtggtttatttccccctctctatcccgtcaaattcaccttaaataacacccagctagatacaggcactaggtttgtgtaagatatgttgatacacacgaacaaagtttattttgactataatgtgtggactgactttcaacatttgcattttatctcacaaaggtgtatctattcaagtaaccttttttttttgtttgtttgtttcttttttgtttttttttttcttttggttgtttgtttcaattcatgtagctatttaaactgggataccttggactaagccagtctgtatcccaattcgctagcaagcctaagtttgtggggttttgtttttgtttttgttttaccttctaatttacaagaaagaggaaaagctcttctaactgaactttggtatgcggttgagctttgtaactatttgttctccatgaaaacaaaattatttatatttgacatatttttttctagtgtattaagttattttaaacaaaagatgttatctcatgacgtgttgtcagtacaaaatgtgtcgcctccaattctgttaaaccttttaaataagtgccaagttattaattgaagacactttgcgatcaattgaatgaaaatatcgtttcatttgaaaaaaaaaaa

SEQ ID NO: 902 - DNA, 2003 bp, Homo sapiens
gtcccgtcggtctcggcgccgggaagaggcggtggcgctgcccgcggtggcgggggttggcgacggagcgcgttggtgccaggaccggggtccgaggcgcgctctccgcccacagaaatgagccgtcagactgctacagcattacctaccggtacctcgaagtgtccaccatcccagagggtgcctgccctgactggcacaactgcatccaacaatgacttggcgagtctttttgagtgtccagtctgctttgactatgtgttaccgcccattcttcaatgtcagagtggccatcttgtttgtagcaactgtcgcccaaagctcacatgttgtccaacttgccggggccctttgggatccattcgcaacttggctatggagaaagtggctaattcagtacttttcccctgtaaatatgcgtcttctggatgtgaaataactctgccacacacagaaaaagcagaccatgaagagctctgtgagtttaggccttattcctgtccgtgccctggtgcttcctgtaaatggcaaggctctctggatgctgtaatgccccatctgatgcatcagcataagtccattacaaccctacagggagaggatatagtttttcttgctacagacattaatcttcctggtgctgttgactgggtgatgatgcagtcctgttttggctttcacttcatgttagtcttagagaaacaggaaaaatacgatggtcaccagcagttcttcgcaatcgtacagctgataggaacacgcaagcaagctgaaaattttgcttaccgacttgagctaaatggtcataggcgacgattgacttgggaagcgactcctcgatctattcatgaaggaattgcaacagccattatgaatagcgactgtctagtctttgacaccagcattgcacagctttttgcagaaaatggcaatttaggcatcaatgtaactatttccatgtgttgaaatggcaatcaaacattttctggccagtgtttaaaacttcagtttcacagaaaataaggcacccatctgtctgccaacctaaaactctttcggtaggtggaagctagacacatgaaggtaaataaaaagaaaggctgttaaatacaggaaacagttgcatgtagtaacactaatatatttaaaaataagtcaacagtaaaccactgaaaaaatatatgtatatacacccaagatgggcatcttttgtattaagaaaggaagcattgtaaaataattctgagttttgtgtttgttgtagattgattgtattgttgaaaaagtttgtttttgcgtgggagtgtgtgcctgcgtgggtgtgtgcgtgtttgggtttttttcctttaactgacaagccatcttgagtggtcatgggccactgcttttccctttgtgagtcaatacatagtgctgctgtgtgctttttttgtgtgtatttgctaatttttattaattttagtttttcattaaataaatttgacttttctgtaattcaggtttttcctttttttgtaccattttaaagttagtatcttttgatatgcatatttgtttatggtaaaaaatttataacgtgttcaatattttcttttcccccattaatcagttcattagaaatattttaaaatcagctattttgtgaagccatgagttccagaaagtaaaggtgacatcggaaaaataatcaaaagctatttaaagcatctataaggtgctctctttctgtcttctacagatgagtcacacctttgagcttaatctttgaaaggttagagaataaattgatttttataaatactgcaaatcaggcttttgtttcctttttcagatatcttggacaaatcacatattttaaaatttgttcttgtatttattggttttgcagaagaaggcatcgtcatgcacagtatttgtaattaaaagcaaatcatttgtttaaaaaggcagtttgcaaaaaatgtttttggtcttttataattctcattaaaagaatatctggc

SEQ ID NO: 903 - DNA, 2632 bp, Homo sapiens
agctgagggacgcgtcagccaggcaccccggggtgtggccagaggacttcggcgacgcttccccgagagtagcccccctcctcaacccagaaaagacaaccccgcggggctgcagcgagccaggcatgctcactggcgcaggcccggcccgcagcccgagcaggaagcgccggcgctaggcggccccctgcgctgccagctggagccgggcggagccagcgccccggcgcagggtggctctgccagtccccgcgcgcctgggcggccgcacacgtgtccaggcgtcacgtccgcgcgcgcccccggggcttgcgtcagcggctgttccagaagcgggtgggccagggctctgcgcaccgctggggttcggggcccgggacgccgccgggaggagggcaccgcgcggggtccgacgcggaggcgtgctcggaacgccgggggctgcggagtgcatcagcgcggtccagccctccgcctgccgggcgccgagcgtctccgccgcccggacctgggctgggcgccgtggcgttgcctcggagctcgctgcccgcggggcgcgcaccgccttgacccgggcggccccgcggcaggcaggcgcccgcagttccatggttggttcggagcgcgatgagccgcccgtcctccaccggccccagcgctaataaaccctgcagcaagcagccgccgccgcagccccagcacactccgtccccggctgcgcccccggccgccgccaccatctcggctgcgggccccggctcgtccgcggtgcccgccgcggcggcggtgatctcgggccccggcggcggcggcggggccggcccggtgtccccgcagcaccacgagctgacctcgctcttcgagtgtccggtctgctttgactatgtcctgcctcctattctgcagtgccaggccgggcacctggtgtgtaaccaatgccgccagaagttgagctgctgcccgacgtgcaggggcgccctgacgcccagcatcaggaacctggctatggagaaggtggcctcggcagtcctgtttccctgtaagtatgccaccacgggctgttccctgaccctgcaccatacggagaaaccagaacatgaagacatatgtgaataccgtccctactcctgcccatgtcctggtgcttcctgcaagtggcaggggtccctggaagctgtgatgtcccatctcatgcacgcccacaagagcattaccacccttcagggagaagacatcgtctttctagctacagacattaacttgccaggggctgtcgactgggtgatgatgcagtcatgttttggccatcacttcatgctggtgctggagaaacaagagaagtacgaaggccaccagcagttttttgccatcgtcctgctcattggcacccgcaagcaagccgagaactttgcctacagactggagttgaatgggaaccggcggagattgacctgggaggccacgccccgttcgattcatgacggtgtggctgcggccatcatgaacagcgactgccttgttttcgacacagccatagcacatctttttgcagataatgggaaccttggaatcaatgttactatttctacatgttgtccatgatgtgactttcgtaaaccttcaaaattatttgggcatagtgctctatgtttaataaaggtttttatagatgttttattccatatgtcttcacaagtcaggacccacaattacccgtgttttgtttgaacagcagtgtcccatctggcttcgacccaacaaagttcattaacctgggatgaatggggttggcctgttggtgatttggatgctgttctgtgatctaaaacaactcttattgaattgtatttactccctaaacaacacttgacaggctgttgcacagggcttctatagatcagtgtgttaggaatgggaggccccttcctgcctgccttcccatattggtcccttgacattgacaaaagcacagtgactgtcagcagattcctttacttttgtttgtgggaggtaggaattgttttaatgcattttaaacagtgtttctgaaattggatggctggctaatagacactgaatcacccggagtgcttatcttaaaattgcagatttagggagcctgccaatttaacagtctcatcaggtgattcttttcaacagtaatgtttgagaattactgggttaaattgtgggaaagggtccagattttaaaggtgctttaaggttgccctctgccgatactgtttgtctttctactgtttcatcccctaacttcccccaaccctcaaattaaaactagaactatagatccacatgaacgcacgcctgagatttggccactcacctatgttttgggtggattgcctaggaaagcaagtcatatggccattgatagttctcatgtaattagttttgctcaccactagtacagatgacccgtttacacgtggcttccctcggaagccctcctcaacagtagctggtgtgaaagactaaatcagtagagttggaaaagctttataaccggtgtgtcatatgcttgctatttaaagctgtgtgttggttttgtttttctgccacattcactagttttttaataaatattttccaaaaatggataaaaaaaaaaaaa

SEQ ID NO: 904 - DNA, 3995 bp, Homo sapiens
cgaattttcaaagaacatattttccgttcacccccgctggtcttttactgccatcaatacactgttcttggtgcaaatacttcagcctctttattcaaagtatgttttatgtttttgccaaatatgatctctaattgaaagtttatttttggttttggatgaatctgcggagcttaagttgtgagaagaaagggggaacaagacacaatgaaagaaaagtccaaaaatgctgcgcggactaggagggagaaggaaaacagtgaattttatgaactggctaaattactgcctttgccctcggctatcacctcgcagctggacaaagcatccataatcagactcacgaccagctatctcaaaatgagagtggtgttcccagaagggctcggcgaggcgtggggccactcaagtcggaccagccccctggacaacgttggccgagaactgggctcccatctgctccagaccctggatggcttcatcttcgtggtagccccagatgggaagatcatgtacatctcagagacagcctcagtccacttgggtctttctcaggtagagctgaccggaaacagcatttatgaatacattcacccggcagaccacgacgagatgacggcggtgctcaccgcccatcaaccctaccactctcacttcgtgcaggagtatgagatcgagcgctccttcttcctgaggatgaagtgcgtcttggccaagcgtaacgccggcctcacctgtggcggctacaaggtcatccactgcagcggctacttgaagatccgccagtacagcctggacatgtcccccttcgacggctgctaccaaaacgtgggcctggtggccgtgggccactcgctgcctcccagcgccgtcacggagatcaagctacacagcaatatgtttatgttccgcgccagcctggacatgaagctcatctttctggactccagggtggcggagctgacggggtacgaacctcaggacctgattgagaagactctgtaccaccatgtgcacggctgcgacaccttccacctgcgctgcgcgcaccatttgctgctggtgaagggacaggtgaccaccaagtactacaggttcctggcgaaacacggcggctgggtatgggtgcagagctacgcgaccatcgtgcacaacagtcgctcctccaggccacactgtatcgtcagcgtcaactatgtcctcacagacacagaatacaaagggctgcagctctccctggatcagatctcagcctccaaaccagccttctcctataccagcagctccacccccaccatgactgacaacagaaagggggccaaatcccggctctccagctcaaagtcaaaatccaggacttccccataccctcagtattcgggatttcacacagaaagatcggaatctgatcatgacagccagtggggcggaagtcccttgaccgacacggcctctccgcagcttctggaccccgccgataggcctggctcccagcacgacgcatcgtgcgcctacagacagttttcggaccgcagctctctctgctatggctttgcgcttgaccactcgaggctggtggaagagaggcatttccatacccaggcctgtgaaggaggccgatgtgaggcaggcaggtacttcctgggaacgccgcaggccgggagggagccctggtggggctctcgcgcagccttgcccctgacaaaggcctccccagaaagcagagaagcctatgaaaacagcatgcctcacatcgcttcagtccacaggatccatgggcgaggtcattgggatgaagatagtgtggtcagttctccagaccctgggtcggccagtgaatcaggtgaccgatatcgtactgagcagtatcaaagtagcccacatgaacccagcaaaattgaaactcttataagagccactcagcaaatgattaaagaagaagagaacagattacagctaaggaaagccccctcagaccaactggcttccattaatggggctgggaaaaaacactccctgtgttttgcaaactaccaacagcccccaccaacaggtgaagtctgccatggctctgctcttgccaacacttcaccatgtgaccatatccagcagagagagggaaaaatgttgagcccccatgaaaatgactatgacaacagtcccaccgcactatctcggataagtagtcccaattcggatcgcatttcaaaatccagtttgatcctagctaaagactatctgcattcggatatatctcctcatcagacagcaggagaccaccctactgtctctccaaactgctttggctctcaccggcagtattttgacaagcatgcttacacattaactggatatgccctggagcacttatatgacagcgaaaccattagaaactattccttgggctgtaatggctcacactttgatgtaacttcccatctgaggatgcaaccagacccagcacaaggacacaagggaacatctgttataataaccaacggaagctgatgttttgctgaaatattttgttctttaaggatctctgaaacatatttatagtttaataccccattaccagcatttactatgccacagattgttagagagtataacttaagttactgggtatttgatacgtgttcctataaaatcaaagaaaacatagcactagcattcagggttatacacagaaaagggagctaaattgaatacacaaatttcccctctaattatatgggaaccagaatagataaattttgacttgaaaaatattcatgtagatcaagtgtgcatatatactacatgagaggactgatgaatgacaacattgcattgtgactatccagtgatcctcaaacacacaaactattacttacaaactgcggtatacattttacatatggaaatataggctatgtaatgtaaatacatcaaaaatgggtaattttctttgactctgtcacactaaacttcttaacgaaatttccattcccaaaataactgagaaagagagagatacatcttataaactgacttctttgtggtttcaaatcagccagctcatttggttcaggcataaattagagaaatggttctggatatggtgcaaaaatgagttttcacctggtatccattataaacaatcaggaagaggtaatttttcaccttgcttttcagttagacaaggaccaggattgcactgacatggcgctgagggtttttctaagtaagaacactgagatattgggacacacatcaaaaacctggagtgctcaattggaagtagttctatgaatatggaaaggccagaggcagagtgaaataaaatgctatctcaaagtttaacacaatttaagggctcagcataagtaaacaacatatttggggtttgcttgtaaaaccaactaaataaaaaattcaaaccaattcacccagaaaaaagaccaataggtgcaaaaataaaaggaaaaccagtgaagtgccacatgacagcagtgttaagtgtttgaaaacgtttcaaagcacatatgtgccaatgtgacaacatgtggaaagcctcaggagagagtctaagataaaagcttaggctgatagacaagtagttaagagctaagagcagtactctgaaggaataggcaaaatgtttattttccttattgtttgtaaacaacaaacttggtcttacatctgtgtggtatagtagaaaggccagctgactagatctctggattctaattttggccctacctgtaacttaattttgtgaccacagttgtaccattcaccgtgcctgggctctagtttcctggtttgtaaggcagccccagcgttcatgttctgtgatagagcagaactgaacttattacctaattaactctctgctatgagttgtcaagactgatcattctgttttttctgtacacagaagtttagatgctttgtgacttaagcaggtgtgtgggctcctttaggcaggttacagttaactttctaga

SEQ ID NO: 905 - DNA, 4177 bp, Homo sapiens
ggggctccgcgggcctggagcacggccgggtctaatatgcccggagccgaggcgcgatgaaggagaagtccaagaatgcggccaagaccaggagggagaaggaaaatggcgagttttacgagcttgccaagctgctcccgctgccgtcggccatcacttcgcagctggacaaagcgtccatcatccgcctcaccacgagctacctgaagatgcgcgccgtcttccccgaaggtttaggagacgcgtggggacagccgagccgcgccgggcccctggacggcgtcgccaaggagctgggatcgcacttgctgcagactttggatggatttgtttttgtggtagcatctgatggcaaaatcatgtatatatccgagaccgcttctgtccatttaggcttatcccaggtggagctcacgggcaacagtatttatgaatacatccatccttctgaccacgatgagatgaccgctgtcctcacggcccaccagccgctgcaccaccacctgctccaagagtatgagatagagaggtcgttctttcttcgaatgaaatgtgtcttggcgaaaaggaacgcgggcctgacctgcagcggatacaaggtcatccactgcagtggctacttgaagatcaggcagtatatgctggacatgtccctgtacgactcctgctaccagattgtggggctggtggccgtgggccagtcgctgccacccagtgccatcaccgagatcaagctgtacagtaacatgttcatgttcagggccagccttgacctgaagctgatattcctggattccagggtgaccgaggtgacggggtacgagccgcaggacctgatcgagaagaccctataccatcacgtgcacggctgcgacgtgttccacctccgctacgcacaccacctcctgttggtgaagggccaggtcaccaccaagtactaccggctgctgtccaagcggggcggctgggtgtgggtgcagagctacgccaccgtggtgcacaacagccgctcgtcccggccccactgcatcgtgagtgtcaattatgtactcacggagattgaatacaaggaacttcagctgtccctggagcaggtgtccactgccaagtcccaggactcctggaggaccgccttgtctacctcacaagaaactaggaaattagtgaaacccaaaaataccaagatgaagacaaagctgagaacaaacccttaccccccacagcaatacagctcgttccaaatggacaaactggaatgcggccagctcggaaactggagagccagtccccctgcaagcgctgctgctcctccagaactgcagccccactcagaaagcagtgaccttctgtacacgccatcctacagcctgcccttctcctaccattacggacacttccctctggactctcacgtcttcagcagcaaaaagccaatgttgccggccaagttcgggcagccccaaggatccccttgtgaggtggcacgctttttcctgagcacactgccagccagcggtgaatgccagtggcattatgccaaccccctagtgcctagcagctcgtctccagctaaaaatcctccagagccaccggcgaacactgctaggcacagcctggtgccaagctacgaagcgcccgccgccgccgtgcgcaggttcggcgaggacaccgcgcccccgagcttcccgagctgcggccactaccgcgaggagcccgcgctgggcccggccaaagccgcccgccaggccgcccgggacggggcgcggctggcgctggcccgcgcggcacccgagtgctgcgcgcccccgacccccgaggccccgggcgcgccggcgcagctgcccttcgtgctgctcaactaccaccgcgtgctggcccggcgcggaccgctggggggcgccgcacccgccgcctccggcctggcctgcgctcccggcggccccgaggcggcgaccggcgcgctgcggctccggcacccgagccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccaccgcggaggccccgcgcgccggtgccgagggccgaggagcgcccgggtccgggcaggtgaccgcccgcctctgtcctgcgagggccggtgcgacccagttgctgggggcttggtttcctcaccttgaaatcgggcttcacgcgtcttgccttgtccccaacgttccacaacagtcccgctgggggattgaagcggtttcactccgcaaatatcctccactttcaggagggaaaacccaccctaccacagtccgctcttccaagtggacggcagacctgggaggggacgcctgtgtcacgagcccttttagatgcttaggtgaaggcagaagtgatgattgtaagtcccatgaatacacaactccactgtctttaaaagtcattcaagagtctcattatttttgtttttatttaaccctttcttcaatacaaaaagccaacaaaccaagactaagggggtgaccatgcaattccattttgtgtctgtgaacataggtgtgcttcccaaatacattaacaagctcttacttccccctaacccctatgaactcttgataacaccaagagtagcaccttcagaatatattgaataggcattaaatgcaaaaatatatatgtagccagacagtttatgagaatgaccctgtcaagcttcattattacgtggcaaaatccctctggcccacacagatctgtaattcactaggctcgtgtttgctacaaatagtgctaataaagttaaattgcacgtgcaatacggaacactgtcaatggactgcaccttgtgaaggaaaaacatgcttaagggggtgtaatgaaaatgatgtagacattttaagcattttctacacagcgagaaaacttcgtaagaacatgttacgtgtgcaacaggtaaacagaaatcctttcataaagcaccagcagtgtttaaaaaatgagcttccattaatttttactttttatgggttttgcttaaagatctcaacatggaaaaatcctgtcatggctctgaactgcacaatgcattgaaccgccgtccttcaattttcttcacactatcaacactgcagcattttgctgctttatcaaaatggtttattttaggaaactttttccacctttctgaatggaaagaggttttcacaaatgttttaaactcatcgttctaaaatcaagtgcacctacaccaactgctctcaaaatgtgaactgacttttttttttttttttttgccaaccctgtgtcacttagtgaggacctgacacaatccctacagggtgtctgtcagtgggcctcatggtaagagtcacaatttgcaaatttaggaccgtgggtcatgcagcgaaggggctggatggtaggaagggatgtgcccgcctctccacgcactcagctatacctcattcacagctccttgtgagtgtgtgcacaggaaataagccgagggtattatttttttatgttcatgagtcttgtaattaaaccgtgattcttgaaaggtgtaggtttgattactaggagataccaccgacatttttcaataaagtactgcaaaatgcttttgtgtctaccttgttattaacttttggggctgtatttagtaaaaataaatcaaggctatcggagcagttcaataacaaaggttactgttgagaaaaaagaccctatcatagatttacaagtgacaacgtggacaggcgtaacagagtgtgtatgtacttgaaaatgtgtactagtgaaaacgtccttgtctaaacaaacttcgttttcataacctagaacatgaaggaagattcttacacgagctggcttcaggacggccagggctgagtgtgaagtcagcagagctgttactgtggcaacctaatattgtgacctccatcttgaagagtctgcacatttaagctggggatagcgtttcttgacttctgtgaggctccggcaggggaagaggaagcattttaatacatatgc

SEQ ID NO: 906 - DNA, 5037 bp, Homo sapiens
ggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcgatactcctggagtcatcagacgtgtctcgcagctcttccacgagcaccctgacctcattgttggattcaacgcttttcttcccctcggatatagaatagacattcccaagaatggcaagttaaacatacagtcgcctctgacaagccaggagaattcgcacaaccacggggacggtgcagaggacttcaagcagcaggtgccgtataaagaggacaaaccccaggtgcccctggagtccgattccgtggaattcaacaacgccatcagctatgtgaataagattaaaacccgcttcctagaccacccagaaatctacaggtcattcctggagatcctgcacacgtaccagaaggagcagctgaacacgaggggccggccattccgaggcatgtctgaagaggaggtgttcaccgaggtggccaacctcttccggggccaggaggacctgctctcagagtttggacagttcctgcccgaagccaagcggtctctgttcacaggaaacgggccgtgcgagatgcacagcgtgcagaagaacgagcacgacaagaccccggagcacagcaggaagcgctcccggccctcgctcctccgccccgtgtctgcacccgccaagaaaaaaatgaaacttcgtggtaccaaagacctgtccatcgctgcagtggggaagtacgggactctgcaggaattttctttctttgacaaggtccgccgggtgctgaagagccaggaggtgtatgaaaacttcctccgctgcatcgcactcttcaaccaggagctggtgtctggctctgagctcctgcagctcgtcagcccatttctggggaaatttccagaactctttgcacagttcaagtccttcctgggggtaaaagagctgtccttcgcgccacccatgagcgacagatccggggacgggataagccgggaaattgattatgcatcctgcaagcgcataggatccagctaccgggcactccccaaaacctaccagcagcccaagtgcagtgggaggacagccatctgcaaggaggtactgaacgacacctgggtctccttcccttcctggtctgaggactccacgttcgtcagctccaagaagacaccgtacgaggagcagcttcaccgctgtgaggacgagcgcttcgagttagacgttgtcctggagacgaacctggccacaatccgtgtgttggaaagtgtgcagaagaagctgtctcggatggcgccggaagaccaggagaagttccggctggacgactccctgggaggcacgtcggaggtgatccagcgccgtgccatttatcgcatctatggcgacaaggccccggagatcatcgagagcctcaagaagaaccctgtcaccgctgtccccgttgtcctgaaaagactgaaggccaaggaagaggagtggcgggaggcccagcagggcttcaacaagatctggcgggagcagtatgagaaggcgtacctcaagtcccttgaccaccaggctgtgaacttcaagcagaacgacaccaaggccctgcgctccaagagcttgctcaacgagatcgagagcgtctacgacgagcaccaggagcagcactcggagggccgcagtgccccctctagcgagccgcacctcatctttgtgtacgaggaccggcagatcctggaggacgcagcagcgctcatcagctactacgtgaagcggcagccggccatccagaaggaggaccagggcaccatccaccagctgctgcaccagttcgtgcccagcctcttcttctctcagcagctggacctgggcgcctccgaggagtcagctgatgaggaccgggacagcccccaggggcagaccacagaccccagtgagcggaagaagccggcgccaggaccccacagtagccccccagaggagaagggggccttcggggatgccccggccactgagcagccacccctgccgcccccagccccgcacaagcccctggacgatgtctacagcctattttttgccaacaacaactggtacttcttcctgcgcctgcaccagaccctgtgctccaggctgctgaagatctaccgccaggcgcagaagcagcttctggagtatcggaccgagaaggagcgggagaagctgctgtgtgagggccgcagggagaagggcagcgaccccgccatggagctgcggctgaagcagcccagtgaagtggagctggaggagtactacccggccttcctggacatggtgcggagcctgctggagggcagcatcgaccccacgcagtacgaggacaccctacgcgagatgttcaccatccatgcctacgtgggcttcaccatggacaagctggtgcagaacattgcgcggcagctgcaccacctcgtgagcgatgacgtctgcctgaaggtggtggagctctacctgaacgagaagaagcggggtgccgctggtgggaacctgtcctcccgctgcgtccgcgctgctagggagaccagctaccagtggaaggctgagcgctgcatggccgacgagaactgcttcaaggtgatgttcctgcagcgcaaagggcaggtgatcatgaccatcgagctcctggacaccgaggaggcccagacggaggaccctgtggaggtccagcacctggctcggtacgtggagcagtatgtggggaccgagggcgcgtccagctcgcccactgagggcttcctcctgaaacctgtgttcctgcagaggaacctcaagaagttccgccgccggtggcagagcgagcaggcgcgggccctgcgcggtgaggccaggagctcctggaagcggctggtgggcgtggagagcgcctgcgacgtggactgccgcttcaagctcagcactcacaagatggtgttcatcgtgaactccgaggactacatgtaccgtcgcgggaccctctgccgggccaagcaggtgcagcccctggtcctgctccgccaccaccagcactttgaggagtggcacagccgctggctggaggacaatgtgacggtggaggcggctagcctggtgcaggactggctgatgggtgaggaggacgaggacatggtaccctgcaagacgctgtgtgagacagtgcacgtgcacggcctgcccgtgacccgctaccgcgtgcagtacagccgccgcccggcctcgccctgacccgccctcatgggcaccgggcaggcgcctcacagagcacagacgtgccctcggccttggtcgtgtcggggccgttttcttgaacgacgtgagaggcatctcccagcccctctgctgccggacagcgcactccagggcaggacgccgcccccgtggctcccggtctcctgtgggcctgctgtgtgccaaacctgagctacctgcacccgagccctggggctcagccccaccacaggggcgggtggacgtgctggccgaggaacaagcaatcatgtttgcgtccccgtccgtcacatgtgccaaatccctggcaggcagatggctcctgccccatattcttgccgtgtcttggaaaagtcacaggtgacagccctcctgaggcccacactttggagggggtccatgtccaagagaccctgacaaggaaggagttgagccctgggtaggcttgcttgaaaagtgagtccttccagaatattctcagagctgccagaaacatcatctgagggtttgggcatcagctctgcctggctggtgttcaggccctcagtcactttggaagtgagaagaacccttcagccaaacctttgggatcccattttgaagtccagagctggagcaggcgggcagtgccctgggagaccccgctctggataagacacccaaccccaactccagcagctggactctgggcccacaaggggagggaccccagccagtattccctcagagccggcacgaccctgctgtggggcggcgggcccagtcgtgttcctgcagtgggcaccctaggcgtatgtgtatacacgcacagatatttattcctttcgcttttagtggttgttatttctgtagcagccaagtcctgcgactccctggggctgagatctccctttgtggaactccgagagccgccctgacagtcccagccgccacccaaggagccccatccgcccacccaccctgggacccacgcggccactccagggatcattgttgtccttttgtgaggggctgaggcgactgtcccatggaggcatccaaggctttctgtgccaagaatcccaagtgactggggctggggaccacttctccaggcctctctccccgaccatgagagcccctggccctggcccctgcacaccagtaggcccagaataaccgccacccttgccatcctgcaacagctggactcaagtttccaggaagtggagatgtgtttctagaagtttcctgtggaacctggaggctcctgatgcctttgactccaggctgggcgattccgatgctgacccgtcctcctgggctccccacccccgctccccaagtgtcacacaggcactttgtacacatcctggttttctaagaagggaacttgccatcaagattcctgtaccaggcccacggccgtctcgggcagagccacctgggccccgggtgcagccggagaccccgccgagcccctcctcccagtattcccatccccgcatgcttctagggagcgcctcttttccgttcttgaggaatttctgttctggggcttgtccttcctttgcagctgttttgaatgtagttttccttttctatttatttgcacattaaagttaataattgaatattgac

SEQ ID NO: 907 - DNA, 2687 bp, Homo sapiens
cggaggcagcaaggccttaaaggctactgagtgcgccggccgttccgtgtccagaacctcccctactcctccgccttctcttccttggccgcccaccgccaagttccgactccggttttcgcctttgcaaagcctaaggaggaggttaggaacagccgcgcccccctccctgcggccgccgccccctgcctctcggctctgctccctgccgcgtgcgcctgggccgtgcgccccggcaggccccagccatgtcgatgctgccgtcgtttggctttacgcaggagcaagtggcgtgcgtgtgcgaggttctgcagcaaggcggaaacctggagcgcctgggcaggttcctgtggtcactgcccgcctgcgaccacctgcacaagaacgagagcgtactcaaggccaaggcggtggtcgccttccaccgcggcaacttccgtgagctctacaagatcctggagagccaccagttctcgcctcacaaccaccccaaactgcagcaactgtggctgaaggcgcattacgtggaggccgagaagctgcgcggccgacccctgggcgccgtgggcaaatatcgggtgcgccgaaaatttccactgccgcgcaccatctgggacggcgaggagaccagctactgcttcaaggagaagtcgaggggtgtcctgcgggagtggtacgcgcacaatccctacccatcgccgcgtgagaagcgggagctggccgaggccaccggcctcaccaccacccaggtcagcaactggtttaagaaccggaggcaaagagaccgggccgcggaggccaaggaaagggagaacaccgaaaacaataactcctcctccaacaagcagaaccaactctctcctctggaagggggcaagccgctcatgtccagctcagaagaggaattctcacctccccaaagtccagaccagaactcggtccttctgctgcagggcaatatgggccacgccaggagctcaaactattctctcccgggcttaacagcctcgcagcccagtcacggcctgcagacccaccagcatcagctccaagactctctgctcggccccctcacctccagtctggtggacttggggtcctaagtggggagggactggggcctcgaagggattcctggagcagcaaccactgcagcgactagggacacttgtaaatagaaatcaggaacatttttgcagcttgtttctggagttgtttgcgcataaaggaatggtggactttcacaaatatctttttaaaaatcaaaaccaacagcgatctcaagcttaatctcctcttctctccaactctttccacttttgcattttccttcccaatgcagagatcagggaaaaaaaaaaaaaaaaacccaaacaaacaaaagcacccaggcacccagtctgagttctgggcaactgatacgcctgtttcagcagcctttcttttttttcaatgaatgggaattgcaaatcaactggattttcattatttccttttaatttatatatggagaaatgtgaagagggaaaggaaatggaaagagaaagagaaagggagataaaaatagtgaaaataagagcctccaggctcagaagaactgattacattcttaaggtgaacaggaaaaatacaatctataactttctttgatgaggaaaaattaagtttacatttttcatatttagtgttaaacaatttaatgtagattaaaataaaagaccagtattaggaggaaaaaacaagtgcctaaatgtcttaatgctctctatgtgagacagaaatagacgtgaccattagtaatgcaactatttttgtcaaatttagtgggattttttggttgttgtttgttttcttgggttttttttttttaaatgacaaactctaaaaatgtaccaatgtgaaaaaacactttcctgaatgccattactcatgccctcaaagctttcatatctgtagcctactcctgtaaagggtttctcctgtttctagtttctagtttgcaaaggtatgccaacgaatctggcaacctggtatttgttactaaaacagcatgtgttttcaggtttcttttctattgtacctaaagcagtctaaattaaaacttagtagaacaccaggagtatgattctgtttctgaaaggtgagtggtgtattgctgtcattgggccctatttttttttttaaatatatttttctttcttacttaatggtggctgtgaattgcagggtactttgaaggccatcatctgaaccaagagtagtaactagattaattatatgacagaaagagtgaatttagccttggggtatttattaacttctattatttagatatgcaattttgtttaccactatctcttcacagcattcatatgttaactaagctcttttgtgttaacaagtttatgacaagactgtgaaagtaaaaataatttatctgcttgaagacaaaaaagggaaggagaacaaggatagaaacattgtgaattaatttgtacaaatagaaagcagaccagcaggacaggagctcttttgcagtgctgccggatggtgtctagaaaaatcccagtaatcatgtaggctccatattatttttgcctggggcaaaatgatgtatcttctgtatttagcttttaaaattagtgaaacaaatggcattatttattaaaattctactcaggataaca

SEQ ID NO: 908 - DNA, 2178 bp, Homo sapiens
gcgagggaacggcgggcgggcgcggagcatgcggagcggcgccccgggcggcccccgggcttgggcgagggcttgggccaggcgcgcgggccgttggggttcggagcttcgtgggacccgcggccggcgcggggacgtacggcagtgactcggggctcaccgggggccagtgccgggccagggggccagccccgcccgcgtctcggcccggacggcccggcgaggaagctcccatgcgggaccgcgcggcccggtgagggcgcgcgcgggcgggcggggacgcagccggcaccatgtccatgctgcccaccttcggcttcacgcaggagcaagtggcgtgcgtgtgcgaggtgctgcagcagggcggcaacatcgagcggctgggccgcttcctgtggtcgctgcccgcctgcgagcaccttcacaagaatgaaagcgtgctcaaggccaaggccgtggtggccttccaccgcggcaacttccgcgagctctacaagatcctggagagccaccagttctcgccgcacaaccacgccaagctgcagcagctgtggctcaaggcacactacatcgaggcggagaagctgcgcggccgacccctgggcgccgtgggcaaataccgcgtgcgccgcaaattcccgctgccgcgctccatctgggacggcgaggagaccagctactgcttcaaggaaaagagtcgcagcgtgctgcgcgagtggtacgcgcacaacccctacccttcaccccgcgagaagcgtgagctggcggaggccacgggcctcaccaccacacaggtcagcaactggttcaagaaccggcggcagcgcgaccgggcggccgaggccaaggaaagggagaacaacgagaactccaattctaacagccacaacccgctgaatggcagcggcaagtcggtgttaggcagctcggaggatgagaagactccatcggggacgccagaccactcatcatccagccccgcactgctcctcagcccgccgccccctgggctgccgtccctgcacagcctgggccaccctccgggccccagcgcagtgccagtgccggtgccaggcggaggtggagcggacccactgcaacaccaccatggcctgcaggactccatcctcaaccccatgtcagccaacctcgtggacctgggctcctagaacccatttgccttgatgagcttgccttttgtgacttgacactggggacgtggagtggcggtgtccaggggcgccccgcccctgcggccccaccaggtactgaaagacccgcaggctgagcgggtagaacagccgggtagggcagatagctgtctatgttggttcttgtttgggatttattttcaacaagttacttttaggatccttttggggctggagactgagtcttgaaccacagaagggaataaattatacaccactgtcattctctctctccctctgtctcttccttttaccctctcttgtcttgccttttccccctttcctcttcctttcccttccttctcttttcttttttctgctttctgtctttctccctctccttgtattgctttccttctagatttctagcttgccaccgttcattctctccttctgtctctccctttctctctccttctctgtttctcctctcttctctcctgccagtctcttgtactctgtgtcctggtccctccgtatgtacccctgtctttctcctcctgactggtggtctatctgcccctacctctggccctcgctttaccggagtagggggtgggagagggaagaggagagaaaatacagggactttgaacctaggccatctcctgaggccttttccctcgcccatgtgggtcagtgggagctgcaggtgtcagcttttcgtctagtaacttaagtgagagagaaagggcagcgccacagaagcccctaaacgccgcctcgtcatacgcccctcctccttctctcttggcgaggccccgccacaccgcgctcttcctcccgggactgtgactacagcgctcccggctgagcgcgccccccgagccgccgacttgccgtctccccgtaatgccctcatgtgaatgttcttcgggaaatatttctgcttttattttataataaaattagaaatcataaatatataaatggttatatgccaaaaaaaaaaaaaaaaaaaaaaaaa

SEQ ID NO: 909 - DNA, 2533 bp, Homo sapiens
gcgggtgtgtgtgtgtgtggatgtgtgtggggtgtgggtgtcccttacgcccttcctcctctccctcctcctcctgctcccccctcctttccttctcctcctcccccctctcctctccctcctcctggtcctcatcgcccctctcctcctcttcctcccctctctcttcctctccctgaattttctcctctcctctcaggtcagtccatggtattccgctcccccctagacctctattcctcccacttcttgttgccaaacttcgccgattctcaccaccgctccatacttctggcgagtagcggcggcgggaacggtgcgggaggcggcggcggcgcgggaggcggcagcggcggcgggaacggtgcgggaggcggcggtgctggcggagcaggcggcggcggcggcggcggctccagggcccccccggaagagttgtccatgttccagctgcccaccctcaacttctcgccggagcaggtggccagcgtctgtgagacgctggaggagacgggcgacatcgagcggctgggccgcttcctctggtcgctgcccgtggcccccggggcgtgcgaggccatcaacaaacacgagtcgatcctgcgcgcgcgcgccgtggtcgccttccacacgggcaacttccgcgacctctaccacatccttgagaaccacaagttcaccaaggagtctcacggcaagctgcaggccatgtggctcgaggcgcactaccaggaggccgagaagctgcgcggccgcccactcggcccggtggacaagtaccgcgtgcgcaagaagttcccgctgccacgcaccatctgggacggcgagcagaagacgcattgcttcaaggagcggactcggagcctgttgcgggagtggtacctacaggacccctaccccaaccccagcaagaaacgcgaactggcgcaggccaccggcctcactcccacacaagtaggcaactggtttaagaaccggcggcagcgcgaccgcgccgcggcggccaagaacaggctccagcaccaggccattggaccgagcggcatgcgctcgctggccgagcccggctgccccacgcacggctcggcagagtcgccgtccacggcggccagcccgaccaccagcgtgtccagcctgacggagcgcgcagacaccggcacctccatcctctcggtaacctccagcgactcggaatgtgatgtatgatagccaaggccgccctcctccctctccttcccctcctcccccactccttcccctccgcctcctagccctcctcctcttcctcctcttccttctcctcctccatccccagaacaaaccgaaatcaggatacccaaccatacacacatacaagtccacacacactcccaccccagccaaaaatatataaaaaacaagaaaataacaaattaaccgcaaactatcaacaacccccaaccaccatctaccactacggccaccccaaaggaccccgacgccaacagacagtcaaacgctgatgttgcgggcagaaaacataaaagaggtgacaattgtatactttctaggacaagcacggcttctcctttcggttcccatggacccggcaccccacctgcatgacgatttatttgtatctgggaaaatattctctctagttaaaaatgatttaaagagtcgactatacaaaaatcaatcaccaccacgaggacaagagggcaaaagcaaaacagacaaaaagaaaaaaaatcgccgtctccgttccgaatttgttaaaaaaaaaaaaaaaaaaaaaaaaaaggacagggggaaaaaaaaaaaaaaagaactcctggagagggaaatagcaaatgtgtcttgccttttgttgctctctctctctttttttttctctcgctctctttctttctcttcttctctctgtttttaagtcaagtattggtcaaaaaaatgcaatcttctgttttttgttcagcagacaatcattttcttcgtaagcacctttttctctccactctgtcactgcctgtgtgggtactggttataaatgtggaaaaagaatagttatgactgtaacagatttttatttttatttcaaaattttatatgaattatgtatatcttaatgatcggtcattttcccagtttgtaatatatgtgtagaaattgcctgtatatgatattgctttttctcctctccctttctctttctctcctctccctctctctgtctttctccccgctcaactgtctcttttctttttggggttctcctcccactcggtgctcctggtgtcgacttggcagtcaaggagaggcatggtggcctgggttaggaagagggaccctgtcgctagcaaaagcggagagtgagattgtagtattcttatgcaaaagctatttccagtatttcttagcagcttcagaggtatctctcactccctgtagggcgcttttactgttatcttaaactgcgtgtttatctatatgtaaaaactttctaaagcaaatacagtattctccattttcttatcactcccaaaaaaaaaaa

SEQ ID NO: 910 - DNA, 6217 bp, Homo sapiens
atgtcctcttcctcccccaccgggcagatcgcaagtgcggcggacatcaagcaagagaatgggatggaaagcgcctcggaagggcaggaggcgcaccgagaagtggcggggggcgcggcggtagggctgagccccccggctccagccccttttcccctggagccgggggacgccgcgaccgctgccgccagggtgagcggagaggaaggggcagtggcggcggcggcggccggagcggcggcggatcaggtacaactccactcggaacttctgggcaggcaccaccacgccgccgccgccgccgcgcagaccccgctggccttctcgcccgaccacgtcgcctgcgtgtgcgaggcactgcagcaggggggcaacctggaccgcctggcccggttcctgtggtccctgccccagagcgacctgctacgtggcaacgagagcctgctgaaggcgcgggcgctcgtggccttccaccagggcatctaccccgagctctacagcatcctcgagagccacagcttcgagtcggccaaccacccgctgctgcagcagctctggtacaaggcgcgctacaccgaggccgagcgagcccgcggccggccgctgggagccgtagacaagtaccggctgcgcaggaaattccccctgccccgcaccatctgggacggcgaggagacggtgtattgtttcaaggagaagtcgcgcaacgcgctcaaggagctctacaagcagaatcgctacccttcgcccgccgagaagcggcacctggccaagatcaccggcctctccctcacccaggtcagcaactggttcaagaaccgccggcagcgcgacaggaacccctccgagacccagtccaaaagtgagtcagatggcaaccccagcactgaagatgaatccagcaagggacatgaggatttatctcctcacccactctccagttcatctgatggcatcaccaacctcagcctttccagtcatatggagccagtatatatgcaacaaattggaaatgctaagatatcattaagctcttctggagttctgttgaatggaagcttggtacctgcaagtacttcacctgtcttccttaatggaaattcttttattcagggacccagtggagttatccttaatggattaaatgtgggaaatacacaggcagtggcattgaacccaccaaaaatgtcatcaaacattgtgagcaatggtatatccatgactgacatactggggtctacttcccaggacgtgaaggaattcaaagtcctccagagttctgctaactcagcaaccaccacgtcctacagccccagtgtccctgtctcattcccaggcctgatacccagcactgaggtgaaaagagaaggcattcaaacagtggcttcccaagatggagggtctgtagtgacttttactacaccagtgcaaattaaccagtatggcattgtccagatccccaattccggagcaaacagccagttccttaatgggagcattggattctctccactgcagctgccccctgtgtcagtggcagcttcacaaggtaatatctcagtaagctcaagcacttcagatggaagcacatttacaagtgagtctaccacagtccagcaaggaaaggttttcttgagctctcttgctcccagtgcagtggtatacacggttcctaatacaggccagactataggatctgtgaaacaggaaggcttggaaaggagcctggtattttctcagttgatgcctgtcaatcagaatgcacaagtaaatgcaaacctgtcttctgaaaacatctcggggagtggcctgcatccactggcctcctcattagttaatgtatctccaactcacaatttttctctcagtccctctacactactaaatcccactgagctaaaccgcgacattgccgatagccaaccaatgtctgcaccggtggcaagcaaatctactgtgacatctgtcagcaacactaactatgcaactcttcagaactgctcccttattactggtcaagacctattgtcagtccctatgactcaggctgcccttggggaaatagttcctacagctgaagatcaggtaggtcacccctccccagcagtacatcaggattttgtccaagaacatcgtttggttctgcaatcggtagctaacatgaaagagaatttcttatcaaattctgagagcaaagcaacaagtagcttaatgatgctggactctaaatccaagtatgtcttagatggcatggttgatactgtctgtgaagacctggaaacagacaaaaaagagcttgccaagctccagactgtccagctggatgaagatatgcaagacttatgaactttatttcctcctcacctctttttggcatcagcggcaaatcttttcatgaagccccaaggacacaaaacattttcccatttaaaggaaaacactctagttttgcaagtatatgcatacaagagactttagattgatctgcatgaagatcacagttaagtatacaggagtagaactgcattattgcagcctttttgttcacttataaatttctcttttaaatagatggagacaaaggacaaggtgaaatgtatcaagtcaaagtgaatcatttagttgactctataattctaaggtcaaaatggaacttgatagttttttaaattaaaaaatgtatacacctaacatagaaaattaaagatagctgcagaccattagaaataatacaattgtttttgtttacttttactccatgggcattgaaaaggttaagaaacataaatggtacatatttttaaagttaagtagcatgcatatatatatgcacacacacctctttttcagcattttttgagaaagtcttgggtctcaaacacatttgtctcaacacatttccaaatgtgatttctaatagctcagtgtggctgagaaagtgcggaactccactaaaaactctgaaacttcagtataaatgtaaatatatcagttctataagcaggatttgagtaattacagtgaattttatttttaatgtatatgtttctcttcaggcgctatgaactgaaaaatatgttttcttactgtttaatttatttttattgtttgaacaggaagtgaacatagtcgtttccaacaaagttttactttttgtaggattttaaaaataatgatttttaccaggaatctattaaggtcaatattaataacactgaaacaggaaatctaactcccaatattggaattttggtactttttttcacatccttgttctttatttagcaactctgattcatttaaatatgttttttatagaattctatgtgcctttttacctcgtggcctttttattggtagtaaggtacagaagtgtcaacagaagcactgatggttcttttctactatctaacagggttaatttcaccacaaaattgctttaaatctgaagaacttaagtttcactaaataatatatatgacatttatcacacaaatggataaacaactaattattgttgatacttttcattacaaggaaaataagttataaataccatgtcaaattgattatacaggctatgaaaaccattttaaaggaaagaaaatatgtaaattctattgagcaaaattctgtcctgttgaaacttagttctaaaggttttgaatcagttgttacactctgacacatgactgttgtttgcactatattatcatgtcttctttaaaagtaaatatttttggtttctgtaagaagcttgtttaataatgttgtaagccgtggctatagttttatcaagactctgaacacaagatgtaacaatgcaaataaatttatgtagtgagtaaagttgctctctagtctctgaaaagcaaaaaaagtgagaaaataatttcttcagagataacttcaagttgttgaacataaaggtgttagatgttagcacatcttgctttttttttttttttgagatggagtctcgctctgttgcccaggctggagtgcagtggcacgatcttggctcactgcaagctctgcctcctgggttcacgccattctcctgcctcagcctcccgagtagctgggactacaggcacctgccaccatgcccggctaaatttttgtatttttagtagagacggggtttcaccgtgttagccaggatggtcttgatctcctgacctcgtgatctgcccgcctcggcctcccaaagtgctgggattataggcatgagccactgtgcctggccacatcttgcttttttttttatgatcagaacaaagggcccactctagttctctacatgtcaatcaatcaagcatgttgaataagggacatagaggatttaacttttgttatcataaatggaacttgcaggcatatatcaagaaccctatgaagaattcctctcccatcattttgataaagaactacatcatttttgatagaattggtgaatgttcctaaactgctgaagctacatgttttttgttttgttttacaaagtcaggtgtttgagagttcttttccactctactactactcatagagcttgttttttctttgggtgtgtgctgatcctgttactgagattaattacatggctctgcagtgtagtttacataaaaatgatgttttccacttgattgctgcagatatcaagagtttgttattttcaaatacccatccaacaagagagatggggaggtttttagttatatatgctatatatatatatataactggaaatgttttatatgttttccgaaaatacaataagcctctcttttattcagtgttcttcctcttttctcccttatgaaaaagaaaagatagcacaaaacttaagacttacctaggaaacccattcatattcccaccatgatgtaattataaccctacaattacttcaggtagctacacaatataccaggtaagaatcaatgcacagtataaagaacttattgttcttttctattctttcagttgaataagggccagttggtatgcagcccatgtatatgtgaatggagtaagataaaccccatgatctccttgcacagaattgcaaatgtcttttgccataccaagggccagactcagaacccttggagtcatgtggcagaatttccctcttacataaaccaatgcttgaaaatgctgcaaatgaccctctaatgatccctgaagatcaaaacaggggtaaatgactccctgcaaaacccaacccatgctgctggctgtgggatttttggtgtaagcctatctatgcactctatcagccagaatttggcatttagctcttagttaaatctagtaaaggacagtctattgtttaaagagaaggtgcatttgttcctcaatcaagcaagagcacctgtgttgtactgctttatatctcatgtatatttatagtaatgaaaagactttttaaattgtacacgtttcagtgcctttcttgtgttatgaaaggcaggtagatattatagccataggtaaaaatccatagttaaattgcacactgaccttaaatctctctgtgtatgcccttgtatcttgcatgttaaaagttggattattgggcatgtgtggcagcctgccctgctacatgctagacaagtgtgctttagtacatagccacaagttcttcattctttaaaatgttttgacagatcatctcataataaaaataattcaggaaaactatggggaaatagttacatttcacaaaagatattttaaactctttgtaaaacttagataatagagcctagcagttactttgtatctaattgatacattttatgttaatttaccaccatacattttattaatcaaaattgtatagcatgtgactcttttggctttcagagttctcaaaaatattattttgttgcatgtactgtatgtttagaggcaaccaattatatactcaatatggttttactgtgccttacacaaagagaaactctatacagaatgtatatcatggggtggggtaacagagtctttactgcactgttaggtgatggcacacagagcatgtcccagaacatttctgtgcttaattacccaaccaaagagatctgaagtatgtatgtcgtactgtaatgggggtttatgcctggacaattaagtgttttatttgttttctgaaatgatgtgaacttatttttctaaacactatgctaaataaactttatatttatacatacaa

SEQ ID NO: 911 - DNA, 5800 bp, Homo sapiens
ggatcccgcgcccccctcctcacttgcgctgctctcggagccccagccggctccgcccgcttcggcggtttggatatttattgacctcgtcctccgactcgctgacaggctacaggacccccaacaaccccaatccacgttttggatgcactgagaccccgacattcctcggtatttattgtctgtccccacctaggacccccacccccgaccctcgcgaataaaaggccctccatctgcccaaagctctggactccacagtgtccgcggtttgcgttgtgggccggaggctccgcagcgggccaatccggaggcgtgtggaggcggccgaaggtctgggaggagctagcgggatgcgaagcggccgaatcagggttgggggaggaaaagccacggggcggggctttggcgtccggccaataggagggcgagcgggccacccggaggcaccgcccccgcccagctgtggcccagctgtgccaccgagcgtcgagaagagggggctgggctggcagcgcgcgcggccatcctccttccactgcgcctgcgcacgccacgcgcatccgctcctgggacgcaagctcgagaaaagttgctgcaaactttctagcccgttcgccgcccctcctcccggccagacccgccccccctgcggagccgggaattccgaggggcggagcgcaggccgagatggggaatgtgggggcctgcagaggaccctggagacggaggcgtgcagaagctcagtctcggggcggaggcttcgcgcccttagtcctcctggacggcccgttaccttctgcgttgtcccgatggggaaactgaggccctgagccagaagcacacgctggggggaggcagaaagcgcggccagaggcggagggaaaacaaagggagaatcacagacagacgggagggggacggacacacacaaggggacagagacccgagtggagagctggatctcgccttcccggcgtggggcgcagggtcggccagaaagaagatcgagaagagcggggagtgggggcgaaaaggggggacaggtgggggaggaggctggggaaagcccgagggaggaagagagggagggaggaacttcccaaagttgcaaaacatggctaccttgcctgcggagccgagcgcggggccggcggctgggggggaggcggtggcggcggcggcggcgaccgaagaggaggaggaggaagcgcgccagctcttgcagactttgcaggcggccgagggtgaggcggcggcggcggccggggccggggcgggcgcagcggctgcgggagctgagggcccgggatccccgggcgtccccgggtcgccccccgaggccgcttccgaaccgcccacgggcctccgcttctcgcccgagcaggtggcgtgcgtctgcgaggcgctgctccaggcgggccacgccggccgcttgagccgcttcctgggcgcactgcccccggccgagcgcctacgtggcagcgacccggtgttgcgcgcgcgggccctggtggccttccagcggggcgagtacgccgagctctaccggctactcgagagccgccccttccccgccgcccaccacgccttcctgcaggacctctacctgcgcgcgcgctaccatgaggccgagcgggcccgcggccgcgcgcttggcgcagtggacaagtatcgactgcgcaagaagttcccgctgcccaagaccatctgggacggcgaggagacagtctactgcttcaaggagcgctcccgcgcagcgctcaaggcctgctaccgcggcaaccgctaccccacgccggacgagaagcgccgcctggccacactcaccggcctgtcgctcacgcaggtcagcaactggttcaagaaccggcgacagcgcgaccggaccggggccggaggcggcgcgccctgcaagaggtgaggggcctcgggcggcgcaagtccagttctcccggggacatcccgtccaccagccctcttcccccgtgcccactgctggggccggcgcgccgaggtcctcggacatctcccgggacagctcacaatctcaggcgcccgcggggcgcggggactaagtgtggacgggacaggcacccgcccgggccctctccccgcacgcgtctcctcttccagcggctccattccgagctccttcccaaatcccatcggtgttggggaatcacactgcggggggcactagagggactgaggaaaaaggacagggcctgtggccactccactccgcgtaggggctgcctcccagccccctttcttcactgaccgttactcttacccacccgcccccacactccctccgggcccggacggcgtggtccgtcttctgcctttgttgtgaaacgtgaacctttcccagctccggtttccctgtaacccaaacccttctcctcccaccctgagcgccggcctctcccttctctgacgccccgcggggagggcaccgggaactgggctggcggctgctgctccctctctccaggccactcgcccgctttccgcccaaccaaggaacttttagggcaacctgggagctcagcctctggggacccgaggccgaggtgggggagagcaagggcctcttccctccccagcgcttctctgcagtggtgtccacgcagggcttgcaaaaggccctggagtttggagtggtctcagagaggcgtcataacccctggaatgatccaccgaaacttgggccagggaaaggtgggggagcagctggctggctatgcgggaggccccacaggctaagggaccccagctgacagccatttctccggccagcgagtctgatgggaatcccacgactgaggacgagtccagccgaagtcctgaggacctggagagaggggcggccccagtgtccgccgaggccgctgcccagggctccatattcctggcagggaccggccctcccgcgccttgcccggcttcctcctccatcctggtgaacgggagcttcctggcagccagcggctccccagcagtgctcctcaacgggggccccgtcatcatcaacggcctggccctgggcgaggcctccagcctgggcccgctgctgctcactgggggcgggggtgcccctccaccgcagcccagccctcagggggccagcgagaccaagacctctctggtcctggaccctcagacaggggaggtgcggctggaggaggctcagtcggaggcccctgagaccaaaggggcccaggtggctgctccgggaccagcccttggagaggaggtcctggggcccctggcccaagtggtgcctggccccccgacggctgccacctttcctctgcccccggggccagtgcctgctgtggctgccccacaagtggtaccgctctccccacccccggggtatcccacgggcctgagccccacctccccactattgaacctgccccaggtagtacccacctcacaggtggtgaccctgccccaggctgtggggcccctgcagctgttggcagccgggccaggcagccctgtgaaggtggcagctgcagcaggccctgccaatgtgcacctcatcaactccggggtgggcgtgactgccctgcagctgccttcggccactgccccaggtacccccatctccctccctcaggcctaggtgagagccggggaggggtgcagtcatctcggagagggaggggctgtccctgggctcctggagggcatctcatccctggcaagtcccagtgccccaaggcccaccacaaggctccctccgcccgccctccagctgcacagtctccacttctctctggcttggcctgctctcctggctctcacctgcgctcggtccctctctccccacaggaaacttcctcctggccaaccctgtgtctggcagccccatcgtgacgggtgtggccctgcagcagggcaagatcatcctcaccgccaccttccccaccagcatgctcgtctcccaggtcctgccgccagcccccggcctggccctgccactgaagccagagacggccatctccgtgcctgagggaggcctcccggtggcccccagccctgctctcccagaggctcacgccctaggcaccctttctgcacagcagccaccccccgccgctgccaccacctccagcaccagcctgcccttctcccctgactcccctggcctcctgcccaacttcccggcgcccccaccagaggggctgatgttgtcacccgcggccgtgcctgtctggtcagcagggctggaactaagcgcaggaacagaggggctgctggaagcggaaaaggggctggggacacaggccccccacaccgtgctgaggctgccagaccccgaccctgaggggctgctcctgggggccaccgcagggggtgaggttgacgaggggttggaagctgaggccaaggttctgacccagctccagtcggtgcctgtggaggagcccttggaactgtgaccagtgtggccccgtggcctctcccgacattggtgctgaagacgcagggacaggaatgggaggggggagccccagaaatgcggttgctgaagaccccagtcaccacatccttctgctctgggtggcctctccaagccctggtggtgctgggggttgtatccccggccacctcctgtccaggtctccatccccctttggatgggaggcctctctgttacagccctccccatgctgtgccctgccatatacgtgggggactcagggtcctgactcaggggccctgccccctccacttggtactagctgtaagcggaacaccctgccccagggccggacttccagcccccagagccctctccctgtcactccctgaaacactattaatagctctgccgatagctggtgttgtcacaactgcctggaatccgaaggtggaggacaggcagccccgcgcccctgagactggagaccctccccagtgtggcatttcctgccaggggcggggggtggggcagctgtggggagacgggggtcttccttcaccagctcccctcgactcaagcccttgtcctcattatccggcccagaccaaagattccctcatccctgggggcagccctgccgctgtgtctcctttgtatcctaaatctttatttttctaggacatgttatgcctccattttcaattaaaataaagttatcggattacaccaccaccaggggtctggggtgccttccagtgtctgtccaaagcagcgctgaacacagagcccacctcgagacctggccttcccattgctgcctcccgaggggaagaggggtttgcattcagatgcacagagtggctggggagggggtggcactgaggcctcttgcaagccacaggcctccagatgagggtggacggagcaccccagtggggcagcagggggacgcaggagggcctgcccttgtctctcttgctggtaacaaaggttccacttgctttattttatttaaaacaataaatagtctaaaaatagaacaggagagggaggagtagggtgaggtgagcatgaacagggttgcaaccgagtggctctggggtggggaagggaaggggagaggggtgggtaaacttcaccttccgacaccccgcatttcattttgggtttccttcctaagcctgggggagaatcaaggcagctgtgggtgactctggtgctccaggcaaatgtgcccagcggttggggctaatcagtgcccccctccccagtcccatgggacctgcattctcaggggctggaggcccaggagggacaagttcatcgatgggtcctggcttccagcaagagccgcgg

SEQ ID NO: 912 - DNA, 1500 bp, Homo sapiens
ctcctccagtcggggtcgtccgctcccggccgttgagccaccgccgccacccggtagtgtgtcccgctgccccaatccgcctcatcaacaagcgcctggcacactcagccaggcccgcgggcatctgctgcgtgtcccgctccgggctcagtgccctcgccgccgccggcactgcctcgatgttccagctgcccatcttgaatttcagcccccagcaagtggccggggtatgtgagaccctggaagagagcggcgatgtggagcgcctgggtcgcttcctctggtcgctgcccgtggcccctgcggcctgcgaggccctcaacaagaatgagtcggtgctacgcgcacgagccatcgtggcctttcacggtggcaactaccgcgagctctatcatatcctggaaaaccacaagttcaccaaggagtcgcacgccaagctgcaggcgctgtggcttgaagcacactaccaggaggctgagaagctgcgtggaagacccctgggacctgtggacaagtaccgagtaaggaagaagttcccgctgccgcgcaccatttgggacggcgaacagaagacacactgcttcaaggagcgcacgcggcacctgctacgcgagtggtacctgcaggatccataccctaaccccagcaaaaaacgtgagctcgcccaggcaaccggactgacccctacgcaggtgggcaactggttcaaaaaccgccgacaaagggaccgagcggctgcagccaagaacagactccagcagcaggtcctgtcacagggttccgggcgggcactacgggcggagggcgacggcacgccagaggtgctgggcgtcgccaccagcccggccgccagtctatccagcaaggcggccacttcagccatctccatcacgtccagcgacagcgagtgcgacatctgagttgcccatccaggatgctcagaagcagattccagtgtaaaaacgagaaaaacaaaatgaaagaggggaagaagatgagagacctgcaaatccagcgccacagaagccaggtgaccagggacccgcgggctcgggttgccgtttcccgccccaccccgcggccggcctggcttcactggcgccctttggccgcgaccacgggaaccagcggtgaggcctgacccagcaccacgttcttcttgctttgctttttcctaaggattttgctgcaaagtctccttcggaacccgaactgcaagctgagcgcctgcccagattctcccatgggtatttcacgtcgaaaggacgctgttacatatgtataactttcgctttaaagtttttttttaacaaaacatatatatgctgtttatttacttatttaagagaccgccatggtaggtttctctgtagcttggggaacttgctgtttctaaacatgcaggctggtggtgatgggttctgtgtggagaagccaaacaataaaacaacctagtgggcaaccttcttaattaaaaaaaaaaaaaaaaaaaaaaaaaaa

SEQ ID NO: 913 - DNA, 5084 bp, Homo sapiens
gagaagattggggtgacaagaaagtcatctgcaacaagttcatccagacgagtgctgtcacttgtctgcaatggccggcagaatacatcattgtctttggactggctgaagggaaggttcgtttagcaaacaccaaaactaataaatcatctaccatctatgggacagagtcttacgtggtgtccctgacaacaaattgctctgggaaaggaattctctctggtcatgcagatggtaccatcgttaggtatttctttgatgatgaaggctctggagagtcacaggggaagttggttaaccacccgtgtccaccctatgccttggcatgggcaaccaatagcatcgtggctgcaggctgtgatcggaaaattgtagcctatggaaaagaaggtcacatgctacaaacttttgattatagccgtgaccctcaggagcgggagttcaccacagctgtatcaagtcctgggggccagtctgttgtgctaggaagttatgacaggcttcgggtgttcaactggatccctcgaagaagcatctgggaagaggcaaagcccaaggagattaccaatttatacaccatcactgccttggcctggaagcgggatggctcacggctctgtgtgggcacactatgtggtggggtggaacagtttgactgctgcctccgaaggagtatttacaagaacaagtttgagttgacgtatgtgggacctagccaggtgattgtgaagaacctgtcatcaggaacccgagtggtgctcaagtcacactatggctatgaggtggaagaggtgaaaatcctaggaaaggaacgttacttggtggctcacacatcagaaacactgctgctgggggacctgaacactaatcggcttagtgagatagcctggcaaggatctggtggcaatgagaagtatttctttgaaaatgagaatgtatgcatgatcttcaatgccggagagctaaccctggtggaatatgggaataatgacaccctgggttctgtacgcactgaattcatgaacccccacctcatcagtgttcgtattaatgagaggtgtcagcgaggaacagaagataataagaaattggcttatcttattgatattaagactattgctatagtggatctgattggtggctacaacattggcaccgtcagccatgagagccgtgtggattggctggaacttaatgagactggacacaagctcctcttcagggaccggaaacttcgtttgcatctgtatgatattgaaagctgctctaagacaatgatcctcaacttctgctcctatatgcagtgggtcccaggaagtgacgtgctggtagctcagaaccgaaacagtctgtgtgtatggtacaacattgaggcacctgagagagtcaccatgttcactattaggggtgatgttataggtctggagcggggcgggggaaagaccgaggtgatggtgatggaaggtgtgactactgttgcctacacattggatgagggcctcatcgagtttggaacagccattgatgatggcaactacatccgggcaacagccttcttagagactctggaaatgaccccagaaacagaggcaatgtggaaaaccttgagtaaactggcactagaggcaaggcaactacacattgcggagaggtgcttttctgctttgggccaagtagcaaaagctcgattcctgcatgagaccaatgagattgcagatcaagtatcccgggaatatggcggagaaggaacagacttttatcaggtccgagcacgtctagccatgctggaaaagaactacaaactggctgaaatgatctttttggaacagaatgctgtggaggaggccatgggcatgtaccaggagctacaccgttgggatgagtgtatcgctgtggctgaagccaaggggcacccagccctggagaagctacgtcgtagttactaccagtggctgatggacacacagcaagaggagcgagcaggtgaactacaggagagccaaggggatgggctagcagccatcagcctctacctcaaagctgggctccctgccaaagctgctcggctggtgctgacccgagaggaactgctagccaacacagagctggtagaacacatcactgcagcccttatcaagggggaactctacgaaagggcaggtgatctctttgagaagattcacaatccacagaaggccctggagtgctaccgtaaaggcaacgcattcatgaaagcggtagagctggctcgattggccttcccagtggaggtggtgaaactagaggaggcatggggggaccacctggtgcagcagaagcagcttgatgcagccattaatcactacatcgaagccaggtgctccattaaggcaattgaggccgccctgggtgcccgccagtggaagaaggcaatttatatattagatctacaggaccggaacactgcatccaaatactatcctctcgtggcccaacactatgcatccctgcaggagtatgagattgctgaggagctctatactaagggagatcggacaaaagatgccatagacatgtacacccaggctggtcgttgggaacaagcccacaagctggcgatgaaatgcatgagaccagaagatgtgtcagtgctatacatcactcaggcccaggaaatggagaagcagggcaagtaccgtgaggctgaaaggctatatgtgacagtacaagagcctgatcttgccatcaccatgtacaaaaagcacaagttgtatgatgacatgatccgcctggtagggaagcaccatccagatctcctcagtgatacacacctacatctgggcaaggagctggaggctgaaggccgactacaggaggctgagtaccactacctcgaggcccaggaatggaaggcaacagtgaacatgtaccgggccagtgggctttgggaagaggcctacagggtggccagaactcaaggaggggctaatgcccacaaacacgtggcctatctgtgggcaaagagcctgggaggagaggctgcagttagactgcttaataagctgggactcctggaagctgctgttgaccacgctgcagacaattgctcctttgaatttgcgtttgaactctctcggctggccctcaagcacaaaacccccgaggttcatctcaaatatgctatgttcctggaggatgagggtaaattcgaagaggctgaagctgaattcatcagagctggtaaacccaaggaggcagtcctcatgtttgtccataaccaggattgggaggcagctcagcgtgtggctgaggctcacgaccctgacagtgtcgccgaggtgcttgtgggacaggcccggggggccttggaggagaaggactttcagaaagcagaagggctgctgctccgggcccagagaccaggcctggccctcaattattataaggaggctggattatggagtgacgctctgcgcatctgcaaggactatgtgcccagccagctggaggctctgcaggaagaatatgagcgggaagctactaagaagggggccaggggtgtggagggatttgtggaacaagctcgacactgggagcaggctggagagtacagccgtgccgtggactgctacctcaaagtgcgagactctggaaacagcggcctggcggagaagtgctggatgaaggcagctgaactctccatcaagtttctgcctccccaacgtaatatggaagtcgttctggctgtaggaccccagctgattggaattggaaagcacagtgcagctgcagagctctatctgaatctggaccttgtcaaggaagcaatcgatgctttcatcgagggtgaggagtggaacaaggcgaagcgtgtagctaaggagttagatcccaggtatgaagactatgtggaccagcattataaagagttcctcaagaatcagggcaaagtggactcgctggtgggtgtggatgtgatagctgctttggacctgtatgtggagcagggccagtgggacaagtgcattgaaacagctaccaagcagaactacaagattctgcacaagtatgtggctttgtatgcaactcacttgatccgggagggtagctctgcccaggcattggccctgtatgtacagcacggagcccctgctaacccacagaacttcaatatctacaaaaggatcttcactgacatggtgagctctcctggaaccaactgtgccgaggcctatcatagctgggctgatcttcgagatgtcctcttcaacctgtgtgaaaacctggtgaagtccagtgaggcaaactctccagcccatgaggagttcaagacgatgctgctgatcgctcattactatgccacgcgctctgcagcccagagtgtcaaacagctggaaaccgtggctgccaggctttctgtttcactcttgcgtcacacccagctactacctgtagacaaagccttctatgaagcaggcattgctgccaaggcagttggctgggataacatggcattcatcttcctcaatcgctttttggacctgaccgatgcaatcgaggaagggactctagatggccttgaccactctgattttcaggatacagacattccctttgaggtgccactcccagctaagcagcatgtaccggaggctgagagagaagaggttcgagactgggtgcttacagtctccatggaccagcggctggagcaggttctgcctcgggatgagcgtggcgcctacgaggcctccctagtggcagcgagcactggtgttcgagccctgccctgccttattacaggataccccattctgaggaacaaaattgaatttaagcggccagggaaggctgctaacaaggacaactggaataaattccttatggccatcaagacctcccacagcccagtgtgccaggacgtgctgaaattcatcagtcagtggtgtggagggctccccagcaccagcttttcctttcagtagttggtagagctgaggaagagttagggcctctccctcattaaagttttataaataaaaaaaaaaaaaaaaaaaaaaaaaaaaaaaaaaaaaaaaaaaaaaaaaaaaaaaaaaaaaaaaaaa

SEQ ID NO: 914 - DNA, 2296 bp, Homo sapiens
cgcgtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagagagccaccccaggaaaagcccggctggacgaggtcatggctgccgctgcccttacaagcctgtccaccagccctctccttctgggggccccggttgcagccttcagcccagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaagagcccggcccaggtcatgttccagtgtctgtggaagagctgcgggaaggtgctgagcacggcgtcggcgatgcagagacacatccgcctggtgcacctggggaggcaggcagagcctgagcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccagggctgcctgacgcccgcccgcctggagccgcagcccacggaggtcggagcctgcccacccgccttgtcctccaggatcggagtcaccctgaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggctttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcaaaaaaaaaaaaaaaaaa

SEQ ID NO: 915 - DNA, 4102 bp, Homo sapiens
gcggagtgattccccacccctgctccatctagctctttccagtgcagccactgccgccgcccaggagccctcgtcccctgccttgtccccctactcgttcccgctcccacggcatggagcaggacactgccgcagtggcagccaccgtggcagccgcggatgcgaccgccactatcgtggtcatagaggacgagcagcccgggccgtccacctctcaggaggagggagcggccgccgcggccaccgaagccaccgcggccacggagaagggcgagaagaagaaggagaaaaacgtttcttcatttcaactcaaacttgctgctaaagcgcctaaatctgaaaaggaaatggacccagaatatgaagagaaaatgaaagccgaccgagcaaagagatttgaatttttactgaagcagacagaactttttgcacatttcattcagccttcagcacagaaatctccaacatctccactgaacatgaaattgggacgtccccgaataaagaaagatgaaaagcagagcttaatttctgctggagactaccgccataggcgcacagagcaagaagaagatgaagagctactgtctgagagtcggaaaacatctaatgtgtgtattagatttgaggtgtcaccttcatatgtgaaaggggggccactgagagattatcagattcgaggactgaattggttgatctctttatatgaaaatggagtcaatggcattttggctgatgaaatgggccttgggaaaactttacaaacaattgctttgcttggttacctgaaacactaccgaaatattcctggacctcacatggttttagttccaaagtctactttacacaactggatgaatgaatttaaacgatgggtcccatctctccgtgtcatttgttttgtcggagacaaggatgccagagctgcttttattcgtgatgaaatgatgccaggagagtgggatgtttgcgttacttcttatgagatggtaattaaagaaaaatctgtattcaaaaagtttcactggcgatacctggtcattgatgaagctcacagaataaagaatgaaaaatctaagctttcagagattgttcgtgagttcaagtcgactaaccgcttgctcctaactggaacacctttgcagaataacctgcatgaactgtgggccttactcaactttttattgcctgatgtctttaattctgcagatgactttgattcttggtttgacactaaaaattgtcttggtgatcaaaaactcgtggaaagacttcatgcagttttaaaaccatttttgttacgccgtataaaaactgatgtagagaagagtctgccacctaaaaaggaaataaagatttacttggggctgagtaagatgcaacgagaatggtatacaaaaatcctgatgaaagatattgatgttttaaactcttctggcaagatggacaagatgcgactcttaaacattctgatgcagcttcgaaagtgttgtaatcatccatatctgtttgatggtgctgaacctggtccaccttataccactgatgagcatattgtcagcaacagtggtaaaatggtagttctggataaactattggccaaactcaaagaacagggttcaagggttctcattttcagccagatgactcgcttgctggatattttggaagattattgcatgtggcgtggttatgagtattgtcgactggatggacaaaccccgcatgaagaaagagaggataaattcctagaagtggaatttctgggtcaaagggaagcaatagaggcttttaatgctcctaatagtagcaaattcatctttatgctaagtaccagggctggaggtctcggaattaacctggcaagtgctgatgtggttatactatatgattcagactggaacccacaggttgatctacaagctatggatcgagcacatcgtattggtcagaagaaaccagtacgtgtattccgtctcatcactgacaacactgttgaagagaggattgtagaaagagctgagataaaactgagactcgattcaattgttatacaacaaggaagactcattgaccaacagtctaacaagctggcaaaagaggaaatgttacaaatgatacggcatggagccacccatgtttttgcttctaaagagagtgagttgacagatgaagacattacaactattctggaaagaggggaaaagaagactgcagagatgaatgaacgcctgcaaaaaatgggagagtcttctctaagaaattttagaatggacattgaacaaagtttatacaaatttgagggagaagattatagagaaaaacagaagcttggcatggtggaatggattgaacctcctaaacgagaacgcaaagcaaactacgcagtggatgcctactttagagaggctttgcgtgtcagcgagccaaagattccaaaggctccacggcctccaaaacagccaaatgttcaggattttcaatttttcccaccacgcttatttgagctcctggaaaaggaaattctttattatcggaagacaataggctataaggttccaaggaatcctgatatcccaaatccagctctggctcaaagagaagagcaaaaaaagattgatggagctgaacctcttacaccagaagagactgaagaaaaggaaaaacttctcacacaaggtttcacaaactggactaaacgagattttaaccagtttattaaagctaatgagaaatatggaagagatgacattgataacatagctcgagaggtagagggcaaatcccctgaggaggtcatggagtattcagctgtattttgggaacgttgcaatgaattacaggacattgagaaaattatggctcaaattgaacgtggagaagcaagaattcaacgaaggatcagtatcaagaaagccctggatgccaaaattgcaagatacaaggctccatttcatcagttgcgcattcagtatggaaccagcaaaggaaagaactatactgaggaagaagatagattcttgatttgtatgttacacaaaatgggctttgatagagaaaatgtatatgaagaattaagacagtgtgtacgaaatgctccccagtttagatttgactggtttatcaagtctaggactgccatggaattccagagacgctgtaacactctgatttcattgattgagaaagaaaatatggaaattgaggaaagagagagagcagaaaagaagaaacgggcaactaaaactccaatggtaaaattttcagcattttcctaacttttagatttaacattgttgggccatttaaaatgtgcatattggagcagaacattaaatctgtttccattttagtcacagaaaagaaaagcagagtcagctactgagagctctggaaagaaggatgtcaagaaggtgaaatcctaaagcctagaaataaagttttaaatgggaaactgctattttcttgttcccatcttcaaatgctaattgccagttccagtgtattcatggtactctaagaaaaatctctttggttttgatttcttgcatattttatatattttacaatgctttctacctgaaatgtgtagctttatattttatggcattctagtatttttgtgtactgtattttgtgcatttcatgtcttcatcaaaatcctctcagtccttgttcttttgaagcttgtgctgaggttttagcttttctatgttttatatgccgctgctttgaaagagaacctagattctatagttgtattattgttgtttcatactttaaatttatatggctgtggaaaaacgaattaaaatgttttgaggagaaagactttttcacttctttgttgctttcttttctattgagtctgggcttgtttgtgttactgcatactgtgattagcataataattgtttctttgaggtcatctaaatatttttttcctaaaggaataaagggtgaggaaagaaaaatattaaaaaagctaatatttgatactgtgcttgctgtcagtatgcattacatttaaattattctctattcaagtgggaaaatataataaagaaatgtctataagaaatttaaaaaaaaaaaaaaaaaa

SEQ ID NO: 916 - DNA, 5758 bp, Homo sapiens
tttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaa

SEQ ID NO: 917 - DNA, 5351 bp, Homo sapiens
acagagcgacgctggtctcccagattgttgcagaaggagacggcgtcgacgtctgactggactcgcggcgacttacctttcagtcgtgcgctcctgatccggcgctcggaatttgtccccggcttcagggctgcggggcctggaaggaggcgtatcgaggcggctcgaaaacgatccaggggagccgaggcgctcctcttgtcatcccactcagcgccatgtcctggatgttcaagagggatccagtttggaagtacttgcagactgtccagtatggagttcatggaaattttccacgcctctcatatccaactttctttccacgttttgaattccaagatgttatccctccagatgactttctaactagtgatgaagaagtagattccgttttatttggaagtttgagaggtcatgtggttggactacgctattacacgggagtagttaataataatgaaatggttgcattacaacgagatcctaataacccttatgataagaatgcaattaaagtaaacaatgtgaatggaaatcaagttggccatttaaagaaagagcttgcaggtgctttggcctatatcatggacaacaaattggcacaaattgaaggggtagttccttttggtgcaaacaatgcttttaccatgcctctgcatatgactttttggggaaaagaagaaaatagaaaagcggtttcagatcagttgaagaaacatggatttaaattgggtcctgcaccaaaaactttaggattcaatttggaaagtggttggggctctggaagagctggaccaagctatagtatgccagtgcatgctgcagtacagatgacaactgaacagcttaaaacagaatttgacaaattgtttgaagatttaaaagaagatgataaaacccatgaaatggaaccagctgaggctattgaaacaccactgcttccacatcaaaaacaagctctagcttggatggtgtcacgggaaaatagcaaagaacttccaccattctgggaacagcgaaatgacttatactataacacaataacaaatttttctgagaaggaccgaccagaaaatgtccatggaggaattttagctgatgatatgggtttgggtaaaactcttacggccattgcagtaatccttaccaacttccatgatggcagacctcttcctattgaaagagttaaaaagaatctactgaagaaggaatataatgttaacgatgactctatgaaacttggaggaaacaataccagtgaaaaggcagatggactaagcaaagacgcatctagatgtagtgaacaacccagtatttcagatatcaaggagaagagtaagtttcgcatgtcagaattgtctagctcccgccccaaaagaagaaaaactgctgtccagtacatagaaagcagtgattcagaggaaattgaaacaagtgaattgccgcagaaaatgaaaggcaaactgaaaaatgtacagtctgaaactaaaggcagggcgaaagcaggatcttctaaggttatagaagatgtggcatttgcatgtgcattaacttcatctgttcctacaacaaaaaagaaaatgttgaaaaagggagcttgtgcagtggaggggtcaaagaaaactgatgttgaggagagaccaagaacaacactgatcatctgtccgctttctgtgttaagcaactggattgaccagtttggacaacatataaaatcagatgtacacttgaatttttatgtttattatggtcctgatcgtattagagaaccggccttactttcaaaacaggatattgttttgactacgtataatattttaactcatgactatggaactaaaggagatagtccattacatagcataaggtggctaagagtgatcctggatgaaggacatgccatacgaaatccaaatgctcagcagacaaaagctgtacttgacttagaatcagaaagaagatgggttttgacaggtactccaatccagaattctttaaaggacttgtggtctcttctttcctttttaaaacttaaaccatttattgatagagaatggtggcatagaacaatacagcgtcctgtcacaatgggagatgaaggaggacttaggcgtttacagtccctaattaaaaatattacacttagaagaacaaagacaagcaaaattaaaggaaaacctgttttggagttaccagaacgtaaagtatttattcagcacattacactttcagatgaagagagaaagatttatcagtctgtgaaaaatgaaggcagagccactattggaaggtattttaatgaagggactgtcctggcacattatgcagatgtcctgggtcttttgcttagactgcggcaaatttgttgccatacttaccttcttacaaatgcagtgtcttccaatggcccctcaggaaatgatacacctgaagaactgagaaagaagttaataaggaagatgaagttaattctgagctcaggttcagatgaggaatgtgcaatttgcctggattctttaacagttcctgtgataacacattgtgcacatgtattttgtaaaccctgtatttgccaagtcattcagaatgagcagccacatgctaaatgccctttatgcagaaatgatatacatgaagataatttattagaatgtcctccagaagaattagcacgtgacagtgagaaaaagtctgatatggaatggacatccagttcaaagattaatgcgctaatgcacgcattgactgacttaagaaagaagaatcccaacataaaaagtttggttgtttctcagtttacaacattcctgtctttaatagaaataccacttaaagcctctggatttgtgtttactcgtttggatggttccatggcccaaaagaaaagagttgaatcaattcagtgttttcaaaacactgaagcaggatctccaactataatgcttctgtccttaaaagcaggtggagttggtttgaatctgtctgcagcttctcgagtgtttttaatggatccagcctggaatcctgctgctgaagatcagtgctttgacagatgccatagacttggtcagaagcaagaagttatcatcacaaaattcattgtaaaggactctgttgaagaaaatatgctgaaaatacaaaacaaaaagagagaacttgcagcaggagcctttggaactaaaaaaccaaatgctgacgaaatgaaacaagccaaaattaatgaaatcagaacattaattgacttataatttgtgggattttagtaaggtcagtttgattggatacttaagttttagaaatgagaaaaatacagagttttagaaatgagatctagagaacacgtcttctaaaaggggcatattttatattagtgaagaggtattactgacacaatttcttctatatatgaacctatttttaatgaaacttcaaatagcaataagttccgttatatactgtggcctgaaataatttgagaaaaaaggttactttgttattcagcttttcataatatctatgctgagtattttcacgtatcttccaagtactcagctttttcgtatttcaaataaggtcagaccttttatacttttgaccaaatagttattttctatgttggacacttagttatttaccaaagcctccgatttgtgatgcagtgtttgtagtccttgtaaacaatatatacagactatacaagaattaattttattgggctttcaaaaaccatatttgcattccagaaccaaatcttaaatgagaccaaagtccaggttagcacaggtttttatttttcctacagctacattgagatatagttcacataaatgacttggagttttatgttcatgaaaaaattagggattatgttaagagtactattttttccattttagttaagtagtactacactcattgtttaaatgtaacttgctgtgtctgaggtataaatatagtctgtgggagtgagaggcaaaccagtcctacccaatttgatttgaatattttaaattatggaactgctaaatagatatttctataaatagataatttttatttatgtagctttttttggaagtaactttataaatttttataattcagaagactactatatgtgagaggcgtgatatctggatggaagttgggctggatgatctccaaagtcgtttcaactcttaaagacatcttaatcctgaatgtaaacaattgttatgtgtttagaatcagaatttgattttgaacttgagtaattcatccttacagctatctgtagaattagtcatcttttttcttttcttttttttttacttttttgttaataagcaaacttatttgctgcagaatttgggttgactcctgagcatatttaaaacaaagaagctagaaatttagcagtcagattaggtaggtggttttatttcaaagggaaactttaatccaaagaaagattaattactctaacaaacaagagaagcttcatgtttgatgatacagatttaagaatacctgagacttaagagtgttggaagtcatttgatagaaagatgagatcggagacaatgttgtgttatagggcacacattgaaggtatatgccaaatctctcaccagataagtccttttctccctgtgccgttttcttgctcaaagggaacagtgaattagccagctagaatcttcctggtccctttttgaggcagtagcaggtaaggaaagggctgattttcatcaaaaccaagacctttctgcagggatgatagtggaataataatgtgggattagcccgctagcattaggagcagttgggaagttacctggtagatcaagcattacacacaaaaaatcaagttgatcagagtatgggttctccatatagcaatacttcagtgagattaagtataaacagtttttggcaaaaaacaacacagtctactctttctgcttacaaagacaaagccttacaaactcactatgaaggtaaagggaggacagcttgcttctttgcccagacatttacaaagttgtttttaaaacacactcataagtaagtttggcaagttgtttaaaaaatgtctctttgttttgtacagttctgttagatgttgttatattttaaaagtttaatttaaaaaatttaatttgtccttcctaagaaggataaatatataaaaaagccactggaatgaaaacttcctatatgctatgctgttgtcttattattatatagaaaaataactttagaaaaatattgaagacattgtattaccacttgtgattcaaacaattttgtggttaaaactggattttaaatttaaaaatcaataaaaatttcaaatgtttattaccttc

SEQ ID NO: 918 - DNA, 5703 bp, Homo sapiens
ggagaggccgccgcggtgctgagggggaggggagccggcgagcgcgcgcgcagcgggggcgcgggtggcgcgcgtgtgtgtgaagggggggcggtggccgaggcgggcgggcgcgcgcgcgaggcttcccctcgtttggcggcggcggcggcttctttgtttcgtgaagagaagcgagacgcccattctgcccccggccccgcgcggaggggcgggggaggcgccgggaagtcgacggcgccggcggctcctgcaggaggccactgtctgcagctcccgtgaagatgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcggacgacccgcgctacaaccagatgaaaggaatggggatgcggtcagggggccatgctgggatggggcccccgcccagccccatggaccagcactcccaaggttacccctcgcccctgggtggctctgagcatgcctctagtccagttccagccagtggcccgtcttcggggccccagatgtcttccgggccaggaggtgccccgctggatggtgctgacccccaggccttggggcagcagaaccggggcccaaccccatttaaccagaaccagctgcaccagctcagagctcagatcatggcctacaagatgctggccagggggcagcccctccccgaccacctgcagatggcggtgcagggcaagcggccgatgcccgggatgcagcagcagatgccaacgctacctccaccctcggtgtccgcaacaggacccggccctggccctggccctggccccggcccgggtcccggcccggcacctccaaattacagcaggcctcatggtatgggagggcccaacatgcctcccccaggaccctcgggcgtgccccccgggatgccaggccagcctcctggagggcctcccaagccctggcctgaaggacccatggcgaatgctgctgcccccacgagcacccctcagaagctgattcccccgcagccaacgggccgcccttcccccgcgccccctgccgtcccacccgccgcctcgcccgtgatgccaccgcagacccagtcccccgggcagccggcccagcccgcgcccatggtgccactgcaccagaagcagagccgcatcacccccatccagaagccgcggggcctcgaccctgtggagatcctgcaggagcgcgagtacaggctgcaggctcgcatcgcacaccgaattcaggaacttgaaaaccttcccgggtccctggccggggatttgcgaaccaaagcgaccattgagctcaaggccctcaggctgctgaacttccagaggcagctgcgccaggaggtggtggtgtgcatgcggagggacacagcgctggagacagccctcaatgctaaggcctacaagcgcagcaagcgccagtccctgcgcgaggcccgcatcactgagaagctggagaagcagcagaagatcgagcaggagcgcaagcgccggcagaagcaccaggaatacctcaatagcattctccagcatgccaaggatttcaaggaatatcacagatccgtcacaggcaaaatccagaagctgaccaaggcagtggccacgtaccatgccaacacggagcgggagcagaagaaagagaacgagcggatcgagaaggagcgcatgcggaggctcatggctgaagatgaggaggggtaccgcaagctcatcgaccagaagaaggacaagcgcctggcctacctcttgcagcagacagacgagtacgtggctaacctcacggagctggtgcggcagcacaaggctgcccaggtcgccaaggagaaaaagaagaaaaagaaaaagaagaaggcagaaaatgcagaaggacagacgcctgccattgggccggatggcgagcctctggacgagaccagccagatgagcgacctcccggtgaaggtgatccacgtggagagtgggaagatcctcacaggcacagatgcccccaaagccgggcagctggaggcctggctcgagatgaacccggggtatgaagtagctccgaggtctgatagtgaagaaagtggctcagaagaagaggaagaggaggaggaggaagagcagccgcaggcagcacagcctcccaccctgcccgtggaggagaagaagaagattccagatccagacagcgatgacgtctctgaggtggacgcgcggcacatcattgagaatgccaagcaagatgtcgatgatgaatatggcgtgtcccaggcccttgcacgtggcctgcagtcctactatgccgtggcccatgctgtcactgagagagtggacaagcagtcagcgcttatggtcaatggtgtcctcaaacagtaccagatcaaaggtttggagtggctggtgtccctgtacaacaacaacctgaacggcatcctggccgacgagatgggcctggggaagaccatccagaccatcgcgctcatcacgtacctcatggagcacaaacgcatcaatgggcccttcctcatcatcgtgcctctctcaacgctgtccaactgggcgtacgagtttgacaagtgggccccctccgtggtgaaggtgtcttacaagggatccccagcagcaagacgggcctttgtcccccagctccggagtgggaagttcaacgtcttgctgacgacgtacgagtacatcatcaaagacaagcacatcctcgccaagatccgttggaagtacatgattgtggacgaaggtcaccgcatgaagaaccaccactgcaagctgacgcaggtgctcaacacgcactatgtggcaccccgccgcctgctgctgacgggcacaccgctgcagaacaagcttcccgagctctgggcgctgctcaacttcctgctgcccaccatcttcaagagctgcagcaccttcgagcagtggtttaacgcaccctttgccatgaccggggaaaaggtggacctgaatgaggaggaaaccattctcatcatccggcgtctccacaaagtgctgcggcccttcttgctccgacgactcaagaaggaagtcgaggcccagttgcccgaaaaggtggagtacgtcatcaagtgcgacatgtctgcgctgcagcgagtgctctaccgccacatgcaggccaagggcgtgctgctgactgatggctccgagaaggacaagaagggcaaaggcggcaccaagaccctgatgaacaccatcatgcagctgcggaagatctgcaaccacccctacatgttccagcacatcgaggagtccttttccgagcacttggggttcactggcggcattgtccaagggctggacctgtaccgagcctcgggtaaatttgagcttcttgatagaattcttcccaaactccgagcaaccaaccacaaagtgctgctgttctgccaaatgacctccctcatgaccatcatggaagattactttgcgtatcgcggctttaaatacctcaggcttgatggaaccacgaaggcggaggaccggggcatgctgctgaaaaccttcaacgagcccggctctgagtacttcatcttcctgctcagcacccgggctggggggctcggcctgaacctccagtcggcagacactgtgatcatttttgacagcgactggaatcctcaccaggacctgcaagcgcaggaccgagcccaccgcatcgggcagcagaacgaggtgcgtgtgctccgcctctgcaccgtcaacagcgtggaggagaagatcctagctgcagccaagtacaagctcaacgtggaccagaaggtgatccaggccggcatgttcgaccagaagtcctccagccatgagcggcgcgccttcctgcaggccatcctggagcacgaggagcaggatgagagcagacactgcagcacgggcagcggcagtgccagcttcgcccacactgcccctccgccagcgggcgtcaaccccgacttggaggagccacctctaaaggaggaagacgaggtgcccgacgacgagaccgtcaaccagatgatcgcccggcacgaggaggagtttgatctgttcatgcgcatggacctggaccgcaggcgcgaggaggcccgcaaccccaagcggaagccgcgcctcatggaggaggacgagctcccctcgtggatcatcaaggacgacgcggaggtggagcggctgacctgtgaggaggaggaggagaagatgttcggccgtggctcccgccaccgcaaggaggtggactacagcgactcactgacggagaagcagtggctcaaggccatcgaggagggcacgctggaggagatcgaagaggaggtccggcagaagaaatcatcacggaagcgcaagcgagacagcgacgccggctcctccaccccgaccaccagcacccgcagccgcgacaaggacgacgagagcaagaagcagaagaagcgcgggcggccgcctgccgagaaactctcccctaacccacccaacctcaccaagaagatgaagaagattgtggatgccgtgatcaagtacaaggacagcagcagtggacgtcagctcagcgaggtcttcatccagctgccctcgcgaaaggagctgcccgagtactacgagctcatccgcaagcccgtggacttcaagaagataaaggagcgcattcgcaaccacaagtaccgcagcctcaacgacctagagaaggacgtcatgctcctgtgccagaacgcacagaccttcaacctggagggctccctgatctatgaagactccatcgtcttgcagtcggtcttcaccagcgtgcggcagaaaatcgagaaggaggatgacagtgaaggcgaggagagtgaggaggaggaagagggcgaggaggaaggctccgaatccgaatctcggtccgtcaaagtgaagatcaagcttggccggaaggagaaggcacaggaccggctgaagggcggccggcggcggccgagccgagggtcccgagccaagccggtcgtgagtgacgatgacagtgaggaggaacaagaggaggaccgctcaggaagtggcagcgaagaagactgagccccgacattccagtctcgaccccgagcccctcgttccagagctgagatggcataggccttagcagtaacgggtagcagcagatgtagtttcagacttggagtaaaactgtataaacaaaagaatcttccatatttatacagcagagaagctgtaggactgtttgtgactggccctgtcctggcatcagtagcatctgtaacagcattaactgtcttaaagagagagagagagaattccgaattggggaacacacgatacctgtttttcttttccgttgctggcagtactgttgcgccgcagtttggagtcactgtagttaagtgtggatgcatgtgcgtcaccgtccactcctcctactgtattttattggacaggtcagactcgccgggggcccggcgagggtatgtcagtgtcactggatgtcaaacagtaataaattaaaccaacaacaaaacgcacagccaaaaaaaaa

SEQ ID NO: 919 - DNA, 1717 bp, Homo sapiens
aacgccagcgcctgcgcactgagggcggcctggtcgtcgtctgcggcggcggcggcggctgaggagcccggctgaggcgccagtacccggcccggtccgcatttcgccttccggcttcggtttccctcggcccagcacgccccggccccgccccagccctcctgatccctcgcagcccggctccggccgcccgcctctgccgccgcaatgatgatgatggcgctgagcaagaccttcgggcagaagcccgtgaagttccagctggaggacgacggcgagttctacatgatcggctccgaggtgggaaactacctccgtatgttccgaggttctctgtacaagagatacccctcactctggaggcgactagccactgtggaagagaggaagaaaatagttgcatcgtcacatggtaaaaaaacaaaacctaacactaaggatcacggatacacgactctagccaccagtgtgaccctgttaaaagcctcggaagtggaagagattctggatggcaacgatgagaagtacaaggctgtgtccatcagcacagagccccccacctacctcagggaacagaaggccaagaggaacagccagtgggtacccaccctgcccaacagctcccaccacttagatgccgtgccatgctccacaaccatcaacaggaaccgcatgggccgagacaagaagagaaccttccccctttgctttgatgaccatgacccagctgtgatccatgagaacgcatctcagcccgaggtgctggtccccatccggctggacatggagatcgatgggcagaagctgcgagacgccttcacctggaacatgaatgagaagttgatgacgcctgagatgttttcagaaatcctctgtgacgatctggatttgaacccgctgacgtttgtgccagccatcgcctctgccatcagacagcagatcgagtcctaccccacggacagcatcctggaggaccagtcagaccagcgcgtcatcatcaagctgaacatccatgtgggaaacatttccctggtggaccagtttgagtgggacatgtcagagaaggagaactcaccagagaagtttgccctgaagctgtgctcggagctggggttgggcggggagtttgtcaccaccatcgcatacagcatccggggacagctgagctggcatcagaagacctacgccttcagcgagaaccctctgcccacagtggagattgccatccggaacacgggcgatgcggaccagtggtgcccactgctggagactctgacagacgctgagatggagaagaagatccgcgaccaggacaggaacacgaggcggatgaggcgtcttgccaacacggccccggcctggtaaccagcccatcagcacacggctcccacggagcatctcagaagattgggccgcctctcctccatcttctggcaaggacagaggcgaggggacagcccagcgccatcctgaggatcgggtgggggtggagtgggggcttccaggtggcccttcccggcacacattccatttgttgagccccagtcctgccccccaccccaccctccctacccctccccagtctctggggtcaggaagaaaccttattttaggttgtgttttgtttttgtataggagccccaggcagggctagtaacagtttttaaataaaaggcaacaggtcatgttcaatttcttcaacaaaaaaaaaaaaaaa

SEQ ID NO: 920 - DNA, 5780 bp, Homo sapiens
ctgggcggggccgggaagcggcagtggcggctacgcgcgcgggggtgcgcgcgggaacgaccgggaaacaccgcgagggccggggtgggccaggctgtggggacgacgggctgcgacgatggccgcagcggcgggcggcggcgggccggggacagcggtaggcgccacgggctcggggattgcggcggcagccgcaggcctagctgtttatcgacggaaggatgggggcccggccaccaagttttgggagagcccggagacggtgtcccagctggattcggtgcgggtctggctgggcaagcactacaagaagtatgttcatgcggatgctcctaccaataaaacactggctgggctggtggtgcagcttcttcagttccaggaagatgcctttgggaagcatgtcaccaacccggccttcaccaaactccctgcaaagtgtttcatggatttcaaagctggaggcgccttatgtcacattcttggggctgcttacaagtataaaaatgaacagggatggcggaggtttgacctacagaacccatctcgaatggatcgtaatgtggaaatgtttatgaacattgaaaaaacattggtgcagaacaattgtttgaccagacccaacatctacctcattccagacattgatctgaagttggctaacaaattgaaagatatcatcaaacgacatcagggaacatttacggatgagaagtcaaaagcttcccaccacatttacccatattcttcctcacaagacgatgaagaatggttgagaccggtgatgagaaaagagaagcaagtgttagtgcattggggcttttacccagacagctatgatacttgggtccatagtaatgatgttgatgctgaaattgaagatccaccaattccagaaaaaccatggaaggttcatgtgaaatggattttggacactgatattttcaatgaatggatgaatgaggaggattatgaggtggatgaaaataggaagcctgtgagttttcgtcagcggatttcaaccaagaatgaagagccagtcagaagtccagaaagaagagatagaaaagcatcagctaatgctcgaaagaggaaacattcgccttcgcctccccctccgacaccaacagaatcacggaagaagagtgggaagaaaggccaagctagcctttatgggaagcgcagaagtcagaaagaggaagatgagcaagaagatctaaccaaggatatggaagacccaacacctgtacccaatatagaagaagtagtacttcccaaaaatgtgaacctaaagaaagatagtgaaaatacacctgttaaaggaggaactgtagcggatctagatgagcaggatgaagaaacagtcacagcaggaggaaaggaagatgaagatcctgccaaaggtgatcagagtcgatcagttgaccttggggaagataatgtgacagagcagaccaatcacattattattcctagttatgcatcatggtttgattataactgtattcatgtgattgaacggcgtgctcttcctgagttcttcaatggaaaaaacaaatccaagactccagaaatatacttggcatatcgaaattttatgattgacacgtatcgtctaaacccccaagagtatttaactagcactgcttgtcggaggaacttgactggagatgtgtgtgctgtgatgagggtccatgcctttttagagcagtggggactcgttaattaccaagttgacccggaaagtagacccatggcaatgggacctcctcctactcctcattttaatgtattagctgataccccctctgggcttgtgcctctgcatcttcgatcacctcaggttcctgctgctcaacagatgctaaattttcctgagaaaaacaaggaaaaaccagttgatttgcagaactttggtctccgtactgacatttactccaagaaaacattagcaaagagtaaaggtgctagtgctggaagagaatggactgaacaggagacccttctactcctggaggccctggagatgtacaaggatgattggaacaaagtgtcggaacatgttggaagtcgtactcaggatgaatgcatcctccactttttgagacttcccattgaggacccataccttgagaattcagatgcttcccttgggcctttggcctaccagcctgtccccttcagtcagtcaggaaatccagttatgagtactgttgcttttttggcatctgtggtggaccctcgcgtggcatctgctgcagcaaaagcggctttggaggagttttctcgggtccgggaggaggtaccactggaattggttgaagctcatgtcaagaaagtacaagaagcagcacgagcctctgggaaagtggatcccacctacggtctggagagcagctgcattgcaggcacagggcccgatgagccagagaagcttgaaggagctgaagaggaaaaaatggaagccgaccctgatggtcagcagcctgaaaaggcagaaaataaagtggaaaatgaaacggatgaaggtgataaagcacaagatggagaaaatgaaaaaaatagtgaaaaggaacaggatagtgaagtgagtgaggataccaaatcagaagaaaaggagactgaagagaacaaagaactcactgatacatgtaaagaaagagaaagtgatactgggaagaagaaagtagaacatgaaatttccgaaggaaatgttgccacagccgcagcagctgctcttgcctcagcggctaccaaagccaagcacctggctgcagtggaagaaagaaagatcaagtccctggtagctctcttggttgagacacaaatgaagaaactagagatcaaacttcgacattttgaagagctggaaactatcatggacagagagaaagaagctctagaacaacagaggcagcagttgcttactgaacgccaaaacttccacatggaacagctgaagtatgctgaattacgagcacgacagcaaatggaacagcagcagcatggccagaaccctcaacaggcacaccagcactcaggaggacctggcctggccccacttggagcagcagggcaccctggcatgatgcctcatcaacagccccctccctaccctctgatgcaccaccagatgccaccacctcatccaccccagccaggtcagataccaggcccaggttccatgatgcccgggcagcacatgccaggccgcatgattcccactgttgcagccaacatccacccctctgggagtggccctacccctcctggcatgccaccaatgccaggaaacatcttaggaccccgggtacccctgacagcacctaacggcatgtatccccctccaccacagcagcagccaccgccaccaccacctgcagatggggtccctccgcctcctgctcctggcccgccagcctcagctgctccttagcctggaagatgcagggaacctccacgcccaccaccatgagctggagtggggatgacaagacttgtgttcctcaactttcttgggtttctttcaggatttttcttctcacagctccaagcacgtgtcccgtgcctccccactcctcttaccacccctctctctgacactttttgtgttgggtcctcagccaacactcaaggggaaacctgtagtgacagtgtgccctggtcatccttaaaataacctgcatctcccctgtcctggtgtgggagtaagctgacagtttctctgcaggtcctgtcaactttagcatgctatgtctttaccatttttgctctcttgcagttttttgctttgtcttatgcttctatggataatgctatataatcattatctttttatctttctgttattattgttttaaaggagagcatcctaagttaataggaaccaaaaaataatgatgggcagaagggggggaatagccacaggggacaaaccttaaggcattataagtgaccttatttctgcttttctgagctaagaatggtgctgatggtaaagtttgagacttttgccacacacaaatttgtgaaaattaaacgagatgtggaaggagaacctcagtgattttattccctagtgaggcctctgagggcctccacactgcctggcagaacataccactgaactagtatgtgctagaggagggcacaaacatccgctccttccctaggcctgctggctctggttttctatgcagatgattcattggattgggggtgagtgttttgtttttctgggggcagtgtgagctttgagggttggaatattgggaggcattccttagtttcctcaactagcctggaaagttaggagtctagggtaattacccccaatgagtctagcctactattcactgctttgtgtgcatttttttctccctctttaaaaaaccctttaaaagaaaaaaaaaagtagatagtgctaaatattttagctcatgaaacttggttaggatggctgggggtacaagtccccaaactacctcttgttacagtagccagggagtggaatttcgtcaaccggtacttttaaggttaggatgggacgggaaaagtgaagcaggatattagctccttataccttctcccttccatttctgagatctcacattccatctatcacagggttttcaaagagatgctgagggtaacaaggaactcacttggcagtcagagcatcatgctttgaggtttggggtgctcaggctgggagggtagaatgccattccagaggacaagccacaaaaatgccttaatttgagctcgtatttacccctgctgataagtgacttgagagttcccggttttttcctcttgtccttccctcccttctgtccttccatgtgtggggaaagggtgtttttggtagagcttggtttccaaagcgcctggctttctcacttcacattctcaagtggcagtttcattatttagaatgcaaggtggacatcttttggatatctttttctatatattttctaaagctttacatatgagagggtatagggaggtgtttataaaacacttgagaacttttttccttaatatcagaaagcaaaaaaataaaaccacaattgagatttgcctttcaaaccctcaggtttgcctctaaccaggtgtccctggtcaccatcagagtactggaatacgggaaccgaggagaccttggtccttttgtttttgttctggactcttgggagtggaaatgagaatgagtttattcctactggagcttagttccaatgcatttggctccagaaagaccccagtgccttttgacaatggccagggttttacctacttcctgccagtctttcccaaaggaaactcattccaaatacttcttttttcccctggagtccgagaaggaaaatggaattctggttcatactgtggtcccttgtaacctcaggtctttaatgtgatcactttcaaatttaaaagatccaggtggaaatatttttactatagtaataattctacaaaatacctgaattcttaacactgttatatttcagtataagtggtggctttttcttttcatgtctttgatctggttttattcctgtaattcagccacctgattttgtgaggggggggaataatatgtggtttttgtacaaacatgtttctcagtgtgttgttattttggaaaaaatgaggggagggagtttggcaagaatggagaaaatgaatgaagaaggcctaatctctctctttttcagtgaataaatggaacaccatttctggattctaaaaaaaaaaaaaaaaaaaaaaaa

SEQ ID NO: 921 - DNA, 5588 bp, Homo sapiens
gcggccgcggcggcgggaggcggcgggaggcgggcggaggaggaggcggaggaggcgggagctgagctgagtggggcgggcggcggcggggcccgagccggagaagatggcggtgcggaagaaggacggcggccccaacgtgaagtactacgaggccgcggacaccgtgacccagttcgacaacgtgcggctgtggctcggcaagaactacaagaagtatatacaagctgaaccacccaccaacaagtccctgtctagcctggttgtacagttgctacaatttcaggaagaagtttttggcaaacatgtcagcaatgcaccgctcactaaactgccgatcaaatgtttcctagatttcaaagcgggaggctccttgtgccacattcttgcagctgcctacaaattcaagagtgaccagggatggcggcgttacgatttccagaatccatcacgcatggaccgcaatgtggaaatgtttatgaccattgagaagtccttggtgcagaataattgcctgtctcgacctaacatttttctgtgcccagaaattgagcccaaactactagggaaattaaaggacattatcaagagacaccagggaacagtcactgaggataagaacaatgcctcccatgttgtgtatcctgtcccggggaatctagaagaagaggaatgggtacgaccagtcatgaagagggataagcaggttcttctgcactggggctactatcctgacagttacgacacgtggatcccagcgagtgaaattgaggcatctgtggaagatgctccaactcctgagaaacctaggaaggttcatgcaaagtggatcctggacaccgacaccttcaatgaatggatgaatgaggaagactatgaagtaaatgatgacaaaaaccctgtctcccgccgaaagaagatttcagccaagacactgacagatgaggtgaacagcccagattcagatcgacgggacaagaaggggggaaactataagaagaggaagcgctccccctctccttcaccaaccccagaagcaaagaagaaaaatgctaagaaaggtccctcaacaccttacactaagtcaaagcgtggccacagagaagaggagcaagaagacctgacaaaggacatggacgagccctcaccagtccccaatgtagaagaggtgacacttcccaaaacagtcaacacaaagaaagactcagagtcggccccagtcaaaggcggcaccatgaccgacctggatgaacaggaagatgaaagcatggagacgacgggcaaggatgaggatgagaacagtacggggaacaagggagagcagaccaagaatccagacctgcatgaggacaatgtgactgaacagacccaccacatcatcattcccagctacgctgcctggtttgactacaatagtgttcatgccattgagcggagggctctccccgagttcttcaacggcaagaacaagtccaagactccagagatctacctggcctatcgaaactttatgattgacacttaccgactgaacccccaagagtatcttacctctaccgcctgccgccgaaacctagcgggtgatgtctgtgccatcatgagggtccatgccttcctagaacagtggggtcttattaactaccaggtggatgctgagagtcgaccaaccccaatggggcctccgcctacctctcacttccatgtcttggctgacacaccatcagggctggtgcctctgcagcccaagacacctcagcagacctctgcttcccaacaaatgctcaactttcctgacaaaggcaaagagaaaccaacagacatgcaaaactttgggctgcgcacagacatgtacacaaaaaagaatgttccctccaagagcaaggctgcagccagtgccactcgtgagtggacagaacaggaaaccctgcttctcctggaggcactggaaatgtacaaagatgactggaacaaagtgtccgagcatgtgggaagccgcacacaggacgagtgcatcttgcattttcttcgtcttcccattgaagacccatacctggaggactcagaggcctccctaggccccctggcctaccaacccatccccttcagtcagtcgggcaaccctgttatgagcactgttgccttcctggcctctgtcgtcgatccccgagtcgcctctgctgctgcaaagtcagccctagaggagttctccaaaatgaaggaagaggtacccacggccttggtggaggcccatgttcgaaaagtggaagaagcagccaaagtaacaggcaaggcggaccctgccttcggtctggaaagcagtggcattgcaggaaccacctctgatgagcctgagcggattgaggagagcgggaatgacgaggctcgggtggaaggccaggccacagatgagaagaaggagcccaaggaaccccgagaaggagggggtgctatagaggaggaagcaaaagagaaaaccagcgaggctcccaagaaggatgaggagaaagggaaagaaggcgacagtgagaaggagtccgagaagagtgatggagacccaatagtcgatcctgagaaggagaaggagccaaaggaagggcaggaggaagtgctgaaggaagtggtggagtctgagggggaaaggaagacaaaggtggagcgggacattggcgagggcaacctctccaccgctgctgccgccgccctggccgccgccgcagtgaaagctaagcacttggctgctgttgaggaaaggaagatcaaatctttggtggccctgctggtggagacccagatgaaaaagttggagatcaaacttcggcactttgaggagctggagactatcatggaccgggagcgagaagcactggagtatcagaggcagcagctcctggccgacagacaagccttccacatggagcagctgaagtatgcggagatgagggctcggcagcagcacttccaacagatgcaccaacagcagcagcagccaccaccagccctgcccccaggctcccagcctatccccccaacaggggctgctgggccacccgcagtccatggcttggctgtggctccagcctctgtagtccctgctcctgctggcagtggggcccctccaggaagtttgggcccttctgaacagattgggcaggcagggtcaactgcagggccacagcagcagcaaccagctggagccccccagcctggggcagtcccaccaggggttcccccccctggaccccatggcccctcaccgttccccaaccaacaaactcctccctcaatgatgccaggggcagtgccaggcagcgggcacccaggcgtggcgggtaatgctcctttgggtttgccttttggcatgccgcctcctcctcctcctcctgctccatccatcatcccatttggtagtctagctgactccatcagtattaacctccccgctcctcctaacctgcatgggcatcaccaccatctcccgttcgccccgggcactctccccccacctaacctgcctgtgtccatggcgaaccctctacatcctaacctgccggcgaccaccaccatgccatcttccttgcctctcgggccggggctcggatccgccgcagcccaaagccctgccattgtggcagctgttcagggcaacctcctgcccagtgccagcccactgccagacccaggcacccccctgcctccagaccccacagccccgagcccaggcacggtcacccctgtgccacctccacagtgaggagccagccagacatctctccccctcaccccctgtggacatcacggttccaggaacagcccttcccccaccactgggaccctccccagcctggagagttcatcactacgtaaggaaagctccttccgcccctccaaagccctcaccatgcctaacagaggcatgcatttttatatcagattattcaaggacttctgtttaaaagatgtttataatgtctgggagagaggataggatgggaatgctgccctaaaggaagggctggtgaaaggtgtttatacaaggttctattaaccacttctaagggtacacctccctccaaactactgcattttctatggattaaaaaaaaaaaaaaaaagtagattttaaaaagccacattggagctcccttctacccactaaaaaataaccaatttttacattttttgagggggagtgagttttaggaaaggggaattaagattccagggagagctctggggatagaacagggcgcagattccatctctccccaagcccctttttagtgactaagtcaaggccccaactcccctcccccaccctacgctgagcttattcgagttcattcgtactaataatccctcctgcggcttcctcattgttgctgttttaggccaccccagctcagccaatgattcctttccctctgaatgtcagttttgtttttaaaagtcacttgcttagttgatgtcagcgtatgtgtatttggtggggaaaacctaatttcggggatttctgtggtaggtaataggagaagaaagggcactgggggctgttctccttccttccctgggctgtatccatggactcctggaaggcacagagaagggagctataagaggatgtgaagttttaaaacctgaaattgttttttaaagcacttaagcacctccatattatgacttggtgggtcaccccttagcttcctccctctcccaccaagactatgagaacttcagctgatagctgggggctccccagatgaggatgcagggatttgggagcagtggaagagggtgcccaaccttgggttggaccaacccttggctcgcagctcaactctgcttcccgcattcctgctccacgtgtcccagcttctcccctgtgacgggaaggcaggtgtgactccaggctctgcactggttcttcttggttcctcccaccaggccctttgttcctcatgtccccatgtttctctccctctgcgtcttagcacctttcttctgttcaaagttttctgtaaattttctctttttttctttctttcttttttttttttttataaattaatttgctttcagttccatcttgtgggtgcattctgtgttcttacctgtggctgtcaggcagggggattgtgatgggagcagctttcctggagtccttcacagcggcgtttacctgggccgaaagacactctgcaagccacacggcctacagacactgcgcctccccacaaaacacgaacggcagcacaactgtcgagactatgtgctggtataggagcagaggctctcacctgccctaaaagctgtttaagacttggaaggacattcccacaacatggaattttgtatctctgtcccttcagaagtagtggtttcactccttcccttattagagaggaggcaagccccttacctacttttgttataattggcccttcaccctgctgaggtgacggacaggcttaggcagtgctaataatggcctggctttagctccaataaacactccacaggcttccccacaaaaggccttattgggagcttgggagggcgggggccagatttaaggagctggaagggtagga

SEQ ID NO: 922 - DNA, 2425 bp, Homo sapiens
gctccggacgcgaggggcggggcgagcgcgggacaaagggaagcgaagccggagctgcgggcgctttttctgcccgcggtgtctcagattcattcttaaggaactgagaacttaatcttccaaaatgtcaaaaagaccatcttatgccccacctcccaccccagctcctgcaacacaaatgcccagcacaccagggtttgtgggatacaatccatacagtcatctcgcctacaacaactacaggctgggagggaacccgggcaccaacagccgggtcacggcatcctctggtatcacgattccaaaacccccaaagccaccagataagccgctgatgccctacatgaggtacagcagaaaggtctgggaccaagtaaaggcttccaaccctgacctaaagttgtgggagattggcaagattattggtggcatgtggcgagatctcactgatgaagaaaaacaagaatatttaaacgaatacgaagcagaaaagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatgattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcagcgaaaactagaagctgaacttcttcaaatagaggaacgacaccaggagaagaagaggaaattcctggaaagcacagattcatttaacaatgaacttaaaaggttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcacaccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaa

SEQ ID NO: 923 - DNA, 6863 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcggactggcagccaccctttgctgtggaagtggacaacttcaggtttaccccccgaatccagaggctgaatgagctagaggcccagacgagagtgaaactgaactacttggaccagattgccaaattctgggaaatccagggctcctccttaaagattcccaatgtagaacggcggatcttggacctctacagtctcagcaaaattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcaggtaagagagatctggagctgctgtcctcgctgttgccacagttgactggccctgtgttggaactgcctgaggcaacccgggcccccttggaggagctcatgatggagggggacctgctcgaggtgaccctggatgagaaccacagcatatggcagctgctgcaggctggacagcccccagacctggagaggatccgcacacttctggagctggagaaggcagagcgtcacgggagtcgggctcggggccgggccctggagaggcggcggcggcggaaggtggatcggggtggggagggcgatgacccagcccgagaggagctagagccaaagagggtacggagctcagggccagaggctgaggaggtccaggaggaggaagagctggaggaggagactgggggtgagggcccccctgcacccatccccaccactggcagccccagcacccaggagaaccagaatggcttggaaccggcggaagggaccacttcaggcccctcggcccctttctccactctgactccccggctgcatctgccctgcccacagcagccgcctcagcaacagttgtgacagtggctgagcctagcacagaccctgacagagacccccctcggcctcaaggatcctctttctgaccatcaagcctgcttcttggggggtgggcgggtaggggggtggccatccctgctacccgcccacccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatctactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgaa

SEQ ID NO: 924 - DNA, 6097 bp, Homo sapiens
cttgttcctccgccgttgcaatgaactattttctctcagtccggggtggtacttttgagtaaccccttccaaatagaaacccataccagcctatttagctcggtctccactatatgaaggtttcctagggcttggtgtgacgcaacgtatacgaggctcggaaggacaccccgcggaaggatccggtttgttgtggtgtggggaggggagacgctgacaaaccaagatggcggcggcggcgctgaaggccgcggcgtttgggaggtaactgtggtggcgaaggctgcggtagtggggaggcaaccacacagtttggaagaaacggagcgggacgaagaggcggtagcagtagagtcagcctgagactctcagagcacgacggccacacgcccccttaggccctcggcgggcggcggctgccccgcttagggcctagcctccgagcattgcctcggcttcaaacagcggcggcgccatgagtccttaagggcggtccaagcctcccgatccctggcccagacctcgggcccaccatggagccggggtccgacgatttcctaccgccaccggagtgcccggtgttcgagcctagctgggccgagttccgagaccctcttggctacatcgcgaaaatcaggcccatcgcagagaaatcgggcatttgcaagatccgcccacccgcgattgtggtggaggaaggtggttatgaagctatctgcaaggaccgtcggtgggctcgggtagcccagcgcctcaactatccaccaggcaaaaatattggctccttgctacgctcccactacgaacgcattgtttatccctatgaaatgtaccagtctggagccaaccttgtgcagtgtaacacacgtccatttgataatgaggagaaggacaaggaatacaaaccccacagcatccccctacgacagtctgtgcagccttccaagttcaacagctatggccggcgggccaagagactgcagcctgatccggaacccacagaggaagacattgagaagaatccagagctgaaaaagctacagatctatggggcaggccccaagatgatgggcctgggcctcatggccaaagacaagactctgcggaagaaagataaggaggggcctgagtgtccccccacagtagtggtgaaggaggagttaggtggggatgtgaaggtggagtcaacatcgcctaagaccttcctggagagcaaggaggagctgagtcacagcccagaaccctgcaccaagatgaccatgaggctacggaggaaccacagcaatgcccagtttattgagtcatatgtctgccggatgtgttctcgaggggatgaggatgacaagctcctgctgtgtgatggctgtgatgacaactaccacatcttctgcctgctgcctcctctgcctgagatccccaagggtgtctggcggtgcccaaagtgtgtcatggcggagtgtaagcggcccccagaagcctttggctttgagcaggctacccgggaatacactctgcagagctttggcgagatggccgactcctttaaagctgactacttcaacatgcccgtgcatatggtgcccacagaacttgtggagaaggagttctggaggctggtaaatagcattgaggaagatgtgactgttgagtatggagctgacatccattccaaagaatttggcagcggtttccctgtcagtgacagtaaacggcacctaacccccgaagaggaggagtatgctaccagtggttggaacctaaatgtgatgccggtgttggaacagtctgtactgtgccacatcaatgcagatatctctggcatgaaggtgccctggctctacgtgggcatggtcttctcagccttttgctggcatattgaggatcactggagttactccattaactacctccactggggtgagccgaagacctggtatggggtgccctcacttgcagcagaacatttggaagaagtgatgaagaagctgacacctgaactatttgatagccagcctgacctcctgcaccaacttgtcaccctcatgaatcccaacaccctcatgtcccatggtgtgccagttgtccgcacaaaccagtgtgcaggagagtttgtcatcaccttcccccgtgcttaccacagcggcttcaaccaaggctacaactttgccgaggctgtcaacttttgcactgctgactggttgcctgctgggcgccagtgcattgagcactaccgccggctccggagatactgcgtcttctcccatgaggagcttatctgcaagatggctgcctgcccagagaagctagacctgaacctggcggcagctgtgcataaggagatgttcatcatggtgcaagaagagcggcgtctacgaaaggccctgctggagaagggtatcacagaggctgagcgagaggctttcgagctgctcccagatgatgagcgccagtgtatcaagtgcaagactacgtgtttcctgtcagccctggcctgctacgactgcccagacggccttgtctgcctttcccacatcaatgatctctgcaagtgctccagtagccggcagtacctgcggtatcggtataccttggatgagcttcctgccatgctgcataagctgaaggttcgggctgagtcctttgacacctgggccaacaaagtgcgagtggccctggaggtggaggatgggcggaagcgcagccttgaagaactgagggcactagagtctgaagcccgtgagcggaggtttcctaatagtgagctgctgcagcaactaaagaactgcctgagtgaggcagaggcttgcgtgtcccgagctctgggactggtcagcggccaggaagctggcccccacagggtggctggtctacagatgaccctgactgagctccgggcctttctggaccagatgaacaacctgccttgcgccatgcaccagattggggatgtcaagggtgttctggaacaggtggaggcctaccaggctgaggctcgtgaggccctggcctcactgccctccagtccagggctactgcagtccctgttggagagggggcggcagctgggggtggaggtgcctgaggcccagcagctccagcggcaggtggaacaggcgcgatggctggatgaggtgaaacgcacactggccccctcagcccgaaggggcaccttggctgtcatgcgaggactgttggtcgcgggtgccagtgtagcccctagccctgctgtggataaagcccaggccgagctgcaggaactgctgaccattgctgaacgctgggaggagaaagcccacctctgcctggaggccaggcagaagcatccaccagccacacttgaggccataatccgtgaagcggaaaacatccctgttcacctgcccaacatccaggctctcaaggaggctcttgctaaggcccgggcctggattgctgatgttgatgagatccaaaatggtgaccactacccctgcctggatgacttggagggcctagtagctgtgggccgggacctacctgtggggctggaggagctgagacagctagagctacaggtactgacagcgcactcctggagggagaaggcctccaagaccttcctcaagaaaaattcttgctacacgctgctggaggttctctgcccatgtgcagatgccggctcagacagcaccaagcgcagccggtggatggagaaggagctggggttgtacaaatctgacacagagctgctggggctgtctgcgcaggacctcagggacccaggctctgtgatcgtggccttcaaggagggggaacagaaggagaaggagggtatcctgcagctgcgtcgcaccaattcggccaagcccagtccactggcatcatcgagcacggcctcctctacaacctctatctgtgtgtgtgggcaggtgctggctggggcgggagctctgcagtgtgacctgtgtcaggactggttccatgggcggtgtgtgtcagtgcctcgcctcctcagctctccgaggcccaatcccacctcatccccactgctggcctggtgggaatgggacaccaaattcctgtgtccactgtgtatgcgctcaaggcgcccgcgcctggagaccatcctggcactgctggtagccctgcagagactgcctgtgcggctgcccgagggcgaggccctgcagtgcctcacagagagggccatcagctggcaaggccgcgccaggcaggctctggcctctgaagatgtgactgctcttttgggacggctggctgagctccgccaacggctacaggctgaacctagacctgaggagcctcctaactaccctgcagcccctgcttctgaccccctcagagagggcagtggcaaggatatgcctaaggtccagggcttactggagaatggagacagtgtgaccagtcctgagaaggtagccccggaggagggctcagatctggagctgctgtcctcgctgttgccacagttgactggccctgtgttggaactgcctgaggcaacccgggcccccttggaggagctcatgatggagggggacctgctcgaggtgaccctggatgagaaccacagcatccctgagtcccttgacttttgtattctgactccaaggtattgttcagacctcagctcctgggggccggcccctggagtcttccctccctggtagcctctaaccagcattcccagacacctgaggcagatagatggatgggctggtgggcaggggggtggctggggctgggccatcaccattccagagacaaggccagtgtatatgcaaactgggggactctcctcccttctctccccagttctggtcctggccaggccatgctacactaacccctgcccccactctcctcccctcttttccttccttcctacccccttctccctctcccttcccctgactgttccacccaggaggaggaaacttcacatagccgtgctcacagttttttattttaaaggaatttggctggggagctgaacagggctccctgtgatctgaagaaagcttttggtgcttgtcctcacaaccacctcagtcctccctccctgtcctcccctgtctcctttcctcctcctgggttcatgttgtaataaaagaagattgttggtgtgtaattaatttgttcaaaagaaaaaaaaaagcaaaacaagaaacttggttccaactgaagcctattttaattttattttattattttcctcttgttagaaataaaacccttagaaacattttttggaaacatgtttctgaagtgcatttctcttagacggggaagacagtgcttccatcaccagtcagtggagcagctgtagtgctggcaggagcactagggctgaagccagggagctctgggttctgaaatcaagttccaccagcttcttaaccttgggcaagacattctgatcctcccccgactctaaccccaagccactttccctcaagtccaaacagatgggctcgggccccctcacccaaactcctacactacaacctcccccagttgatgccctccagtttatcctcctcaagctcccaaagggatttttttgttaatggctttattgagatataatttacatactataaaattcacttgtttgaaatgtacaattcagtgatttggggggtttctaaagtgtagatctgattatatactgcttaaaaccttccatgatgctttattgcccttaagattatacatagaatctcgttcttcctagaatgttttcctgtctaacccatctactgcataattccctgatttttctccacaggttatgcccctgatgaatggggactaaagctcagatgtgtggtcatttgcaacccctgagttcacttttttaagacagcttattgatatatataatgtacataccatacagtcacccacttaaaagtatacaattaaatagcttttagtatattcagagttgtgcagccatcattcgaaaaaaaatttcagaacattttcatcactgcagaaagaaactccatatcccttaggcgtcctttacccctcatcccatttgcctattctggacattttacataaatggaatcgtataatatgtgaa

SEQ ID NO: 925 - DNA, 1708 bp, Homo sapiens
ggcacggcctagcgagtggttcttctgcgctactgctgcgcgaatcggcgaccccagtgcctcgaccactatgccgcgctctttcctcgtcaggaagccctccgaccccaatcggaagcctaactacagcgagctgcaggactctaatccagagtttaccttccagcagccctacgaccaggcccacctgctggcagccatcccacctccggagatcctcaaccccaccgcctcgctgccaatgctcatctgggactctgtcctggcgccccaagcccagccaattgcctgggcctcccttcggctccaggagagtcccagggtggcagagctgacctccctgtcagatgaggacagtgggaaaggctcccagccccccagcccaccctcaccggctccttcgtccttctcctctacttcagtctcttccttggaggccgaggcctatgctgccttcccaggcttgggccaagtgcccaagcagctggcccagctctctgaggccaaggatctccaggctcgaaaggccttcaactgcaaatactgcaacaaggaatacctcagcctgggtgccctcaagatgcacatccgaagccacacgctgccctgcgtctgcggaacctgcgggaaggccttctctaggccctggctgctacaaggccatgtccggacccacactggcgagaagcccttctcctgtccccactgcagccgtgccttcgctgaccgctccaacctgcgggcccacctccagacccactcagatgtcaagaagtaccagtgccaggcgtgtgctcggaccttctcccgaatgtccctgctccacaagcaccaagagtccggctgctcaggatgtccccgctgaccctcgaggctccctcttcctctccatacctgcccctgcctgacagccttccccagctccagcaggaaggaccccacatccttctcactgccatggaattccctcctgagtgccccacttctggccacatcagccccacaggactttgatgaagaccattttctggttctgtgtcctctgcctgggctctggaagaggccttcccatggccatttctgtggagggagggcagctggcccccagccctgggggattcctgagctggcctgtctgcgtgggtttttgtatccagagctgtttggatacagctgctttgagctacaggacaaaggctgacagactcactgggaagctcccaccccactcaggggaccccactcccctcacacacacccccccacaaggaaccctcaggccaccctccacgaggtgtgactaactatgcaataatccacccccaggtgcagccccagggcctgcggaggcggtggcagactagagtctgagatgccccgagcccaggcagctatttcagcctcctgtttggtggggtggcacctgtttcccgggcaatttaacaatgtctgaaaagggactgtgagtaatggctgtcacttgtcgggggcccaagtggggtgctctggtctgaccgatgtgtctcccagaactattctgggggcccgacaggtgggcctgggaggaagatgtttacatttttaaaggtacactggtatttatatttcaaacattttgtatcaaggaaacgttttgtatagttatatgtacagtttattgatattcaataaagcagttaatttatatattaaaaaaaaaaaaaaaaaa

SEQ ID NO: 926 - DNA, 2101 bp, Homo sapiens
agttcgtaaaggagccgggtgacttcagaggcgccggcccgtccgtctgccgcacctgagcacggcccctgcccgagcctggcccgccgcgatgctgtagggaccgccgtgtcctcccgccggaccgttatccgcgccgggcgcccgccagacccgctggcaagatgccgcgctccttcctggtcaagaagcatttcaacgcctccaaaaagccaaactacagcgaactggacacacatacagtgattatttccccgtatctctatgagagttactccatgcctgtcataccacaaccagagatcctcagctcaggagcatacagccccatcactgtgtggactaccgctgctccattccacgcccagctacccaatggcctctctcctctttccggatactcctcatctttggggcgagtgagtccccctcctccatctgacacctcctccaaggaccacagtggctcagaaagccccattagtgatgaagaggaaagactacagtccaagctttcagacccccatgccattgaagctgaaaagtttcagtgcaatttatgcaataagacctattcaactttttctgggctggccaaacataagcagctgcactgcgatgcccagtctagaaaatctttcagctgtaaatactgtgacaaggaatatgtgagcctgggcgccctgaagatgcatattcggacccacacattaccttgtgtttgcaagatctgcggcaaggcgttttccagaccctggttgcttcaaggacacattagaactcacacgggggagaagcctttttcttgccctcactgcaacagagcatttgcagacaggtcaaatctgagggctcatctgcagacccattctgatgtaaagaaataccagtgcaaaaactgctccaaaaccttctccagaatgtctctcctgcacaaacatgaggaatctggctgctgtgtagcacactgagtgacgcaatcaatgtttactcgaacagaatgcatttcttcactccgaagccaaatgacaaataaagtccaaaggcattttctcctgtgctgaccaaccaaataatatgtatagacacacacacatatgcacacacacacacacacacccacagagagagagctgcaagagcatggaattcatgtgtttaaagataatcctttccatgtgaagtttaaaattactatatatttgctgatggctagattgagagaataaaagacagtaacctttctcttcaaagataaaatgaaaagcacattgcatcttttcttcctaaaaaaatgcaaagatttacattgctgccaaatcatttcaactgaaaagaacagtattgctttgtaatagagtctgtaataggatttcccataggaagagatctgccagacgcgaactcaggtgccttaaaaagtattccaagtttactccattacatgtcggttgtctggttgccattgttgaactaaagcctttttttgattacctgtagtgctttaaagtatatttttaaaagggaggaaaaaaataacaagaacaaaacacaggagaatgtattaaaagtatttttgttttgttttgtttttgccaattaacagtatgtgccttgggggaggagggaaagattagctttgaacattcctggcgcatgctccattgtcttactattttaaaacattttaataatttttgaaaattaattaaagatgggaataagtgcaaaagaggattcttacaaattcattaatgtacttaaactatttcaaatgcataccacaaatgcaataatacaataccccttccaagtgcctttttaaattgtatagttgatgagtcaatgtaaatttgtgtttatttttatatgattgaatgagttctgtatgaaactgagatgttgtctatagctatgtctataaacaacctgaagacttgtgaaatcaatgtttcttttttaaaaaacaattttcaagttttttttacaataaacagttttgatttaaaatctcgtttgtatactattttcagagactttacttgcttcatgattagtaccaaaccactgtacaaagaattgtttgttaacaagaaaaaaa

SEQ ID NO: 927 - DNA, 1676 bp, Homo sapiens
cgcactccagccacagggtccccaactaccggcggctggagacgcagagagaaatcaatggtgcctgctctgcctgtggggggctggtggtgcccctcctcccccgagacaaggaggccccttctgtgcccggtgaccttccccagccctgggaccgctcctcggccgtcgcctgcatctccctgcccctcctgccacggatcgaggaagctctgggggcctctgggctggacgccttggaagtcagcgaggtcgaccctcgggccagccgggccgccattgtacccctcaaagacagcctgaaccacctcaacctgcccccactgctggtgctgcccacacggtggtccccgaccttgggcccagaccggcacggggctccggaaaaactgcttggggctgagcggatgccccgagccccgggcggctttgagtgcttccactgccacaaaccctaccacacgctggccgggctggccaggcaccggcagctgcactgccacctgcaggtggggcgtgtcttcacctgcaagtactgcgacaaggagtacaccagcctgggtgccctcaagatgcacatccgcactcacacgctgccctgcacctgcaagatctgtggcaaggccttctccaggccctggttactgcagggccatgtccgcacccacacaggggagaagccctatgcctgctcgcactgcagcagggcctttgccgaccgctccaaccttcgggcccatctgcaaacgcactcagacgccaagaagtaccggtgccggcgctgcaccaagaccttctcccgcatgtccctcctggcgcggcatgaggagtctggctgctgcccgggcccctgagaggcacgtggtcggcgcaggtaggagggatggtcctcaccgggagagctggcgtccctcctgcccccagaggagccaggagtctgggagggcggggccgggcctcacacttggtgcgtcctccacatctgcgtccaatcagaaccaaagaagtccagcggggggccactgggccggaggacactcccccaggcatcccaccgcgcggagcccactcagaggagactcctctcccggggaaggctttcatcagaacaagagccatggttccatttcgacacggccaggtctccggggctacccttccaagagtcagagcctcggggaggtggccgccagcatgggccggcactgccgccggatggctggcaaggctgcctagttcccttgcagcagaaatgaacagttctgacttatagtgagcacggccctgtggcccttcctcagtaggcacaactacctctcagccagcccccgccagcctttggtttggggtctgggacgagctgccccatgtcacacgtctatgtgcatgtgcacacacactcaaacatgtacacacacgtgccctccccacctcactagactctccgggagatggggcaggactgggagagcccacgattggtgatttgggtgtgttgggatgaggcggagtgcctgtgggatttgtcccggtcagagcctcagggggctggggtctcagggcactcagcttcccaggcaataacagccgtggggtaataaatggtctctgcacacctgcaaaaaaaaaaaaaaaaaaaaaaaaaaaaaaaaaaaaaaaaaaaaaaaaaaaaaaaa

SEQ ID NO: 928 - DNA, 2684 bp, Homo sapiens
acgccgtagggggcgggccgttcgggcttggtttcctgggcgaccaccgctggctagtccgttagaggcgtgcgggcttcggaggcgtgcgggcttcgggtgccatggggactcctcccggcctgcagaccgactgcgaggcgctgctcagccgcttccaggagacggacagtgtacgcttcgaggacttcacggagctctggagaaacatgaagttcgggactatcttctgtggcagaatgagaaatttagaaaagaacatgtttacaaaagaagctttagctttggcttggcgatattttttacctccatacaccttccagatcagagttggtgctttgtatctgctatatggattatataatacccaactgtgtcaaccaaaacaaaagatcagagttgccctgaaggattgggatgaagttttaaaatttcagcaagatttagtaaatgcacagcattttgatgcagcttatatttttaggaagctacgactagacagagcatttcactttacagcaatgcccaaattgctgtcatataggatgaagaaaaaaattcaccgagctgaagttacagaagaatttaaggacccaagtgatcgtgtgatgaaacttatcacttctgatgtattagaggaaatgctgaatgttcatgatcattatcagaacatgaaacatgtaatttcagttgataagtccaagccagataaagccctcagcttgataaaggatgatttttttgacaatattaagaacatagttttggagcatcagcagtggcacaaagacagaaagaatccatccttaaagtcaaaaactaatgatggagaagaaaaaatggaaggaaattcacaagaaacggagagatgtgaaagggcagaatcattagcgaaaataaaatcaaaggccttttcagttgtcatacaggcatccaaatcaagaaggcatcgtcaagtcaaactcgactcttctgactctgattctgcatctggtcaagggcaagtcaaagcaactaggaaaaaagagaagaaagaaagattgaaaccagcaggaaggaagatgtctctcagaaacaaaggcaatgtgcagaatatacacaaggaagataaacctttaagtctgagtatgcctgtaattacagaagaagaagagaatgaaagtttgagtggaacagagttcactgcatccaagaagaggagaaaacactgaacaaagagcctggtgtagtttttaattttgagttttctgacagaagaaaagattgatattttgtgtattgaacaggaagactgccagtattaaaaaaatccttctgggaatctgtaggttatttcttggaaattgcaatacgtagttctagaataaaagtacaaaaaattagaataagaattctttaacattttctttaatgatttgcataaatggagataaaacttgtatttagtatgtaatagaaaaaattctgttattcgcagattgttactatttcctataaggttttgtgatactatactgtcctaatacagtctggtaatactattctattttatttaaaatattttttattgaaatattaatgtttattacatgcaaataactattttgtatctacagtcggataatggattttttattttgtatatttattctattttgtatattgttaagtgcaataaagtttttgccttgctttattttttaatacataaaacttacattctcataacgtgattgataacttaggaagttcacaatgtattttctacttctgcaattaaatattctttagtgcttgtttattattactaaatactaattaagtactaacaagtacttaaatactaatgtattaagtatttaagtactttctaataaaatctttaacaataataatgtaaatttcagaatgtgtctctggtacagaatagttgatattaacagaaaaaaaaaaatctgtagcttcatgaatatgccactctgttaatttcttgttccagacattttaatagagattgcttgagccatgttgtttgaattgctgccaatagcagaccatatccctatcatgttgttggctcaactgttttttttttttccctaatagagatggagtatcgctatgttgctcaggctggtcttgaactcctgggctcaagctatcctcctgcctcagcctcccaaagtactgggattataggtgtgagctactgtacccagccttaacctgtttcacagttgattatacttcatgctgttttccagcatggtattattaagggatttaaagtttgggttgcatgcctgtaatcccagcattttgggaggccgaggtgggcggatcacgaggtcaggagatcgagaccatcgtgactaacacagtgaaaccccgtctctaataaaaatacgaaaaattagccaggcgtggtggcgggcgcctgtaatcccagctactcgggaagctgaggcaggagaatggtgtgaacccagtgagccgagatcgtgccactgcactccagcctgggcaacagagtgagacttcgtctcaaaaaaaaaaaaaagtttgggttgaagatcaaattcgtgatatctctatatctaatctttaaaaatcagaatgctaatgctgacgcaaataaaattttcatttattagcaaaaaaaaaaaaaaaaaaaaaaaaaaaaa

SEQ ID NO: 929 - DNA, 1561 bp, Homo sapiens
cccgtagctccgcccatcggagaagcgaccttacagcgcctgcctctttctgagcggcatgaagccacctcccaggcggcgagcggccccggcgcgctatctgggcgaggtgaccggtcccgcgacctggagcgctcgcgagaagcggcagctagtgcgactcctgcaggcgcggcagggccagccggagccggacgccaccgagctggcccgggagctgcggggccggagcgaggctgagatccgggtcttcctccagcagctcaagggccgcgtagcccgggaggccattcagaaagtgcatccgggtggccttcagggaccaaggcgccgggaggcacagcccccagcccccatagaggtctggacggatctggctgagaagataacagggccactggaagaagccctggcagtggctttctcgcaggtgctcaccatcgcggccacggaaccggtcaccctcctgcactccaagccccccaagcccacgcaggcccgtggaaagcctttgctcctgagcgcccctggaggacaggaagaccccgcccctgaaatacctagctctgcccctgctgcacctagctccgcacccaggactcctgaccctgcccctgagaaaccttctgagtcgtcggctggtccctccactgaagaagactttgctgtggactttgagaagatctacaagtacttgtcctctgtctcccgaagtggccgcagccccgagctctcagcagctgagtccgctgtggtcctcgacctgctcatgtcacttccagaggagctgccactcctgccctgcacagccctggttgagcatatgacggagacgtacctacgcctgacagccccccagcccattcccgctggagggagcctggggcctgcagcagaaggggatggggctggctccaaggcaccagaggagacccccccagccaccgagaaggccgagcacagcgaactgaaatcgccttggcaagcagctgggatctgtcccctgaacccgttcctggtgcccctggagcttctgggtcgggcagccacccctgccaggtgaggggcatggcgggcaggaggccacaccaggccccccgccctgcccctcggttctgctcggctggccctggctctttctgaggatcccgtcatgggggaaggtccttgagatgatgctcagctgtggggcgggcctctaagatgccccatactttgggggtctcagaaatggaacccccgttgtacaggggttgggtgggggttgcaggactccactcacaagcctcctgatgtcaaggacaggcggacagggctggcctcccccagtccccaagccccactgtgccttgttgtctgctggggggccatagctggcactgcccaccgtaaaggccctcgcacattttcccccttcctgtacacctcggggccagcatcctcaccttcttcaactgaccagtcgtggttactccctgctgccaggtccttccccttcccgggggtattctgtgaccatgaataaagttatcattctctttctctttcacaaaaaaaaaaa

SEQ ID NO: 930 - DNA, 2533 bp, Homo sapiens
gtggggcgaacatggctgaaggaagccgaggtggccctacgtgtagcggggtgggtggcaggcaggacccagtctccggcagtggcggctgcaactttccagagtatgagcttcccgagctaaatacgcgcgctttccatgtgggcgcctttggggagctgtggcggggccgtctgcgcggggccggggacttgtcgctgagggagccgccggcatccgctctgcctgggagccaggcagctgactccgaccgggaggatgccgcggtggccagggatctggactgcagcctggaggcggcggctgagctgagggcggtgtgcggccttgataaactgaaatgccttgaggacggtgaggatccagaagtcattccggagaatactgacctggtgactttgggggttagaaaaaggttcttggaacatcgggaagaaaccattacaatagatcgagcctgcagacaagaaacattcgtttatgagatggagtcacatgccataggaaaaaagcctgaaaattcagcagacatgattgaagaaggggagcttatcctatctgtgaatatcttgtaccctgttatatttcataagcacaaagaacacaaaccataccaaacaatgctggtgttgggcagtcaaaaactcacacaactgagggattcaattcgatgtgtcagtgacctccagattggtggtgaattcagcaacactcctgaccaagcccctgagcacatcagcaaagacctatacaaatcagccttcttttattttgaaggaacattttataatgataaaagatacccagaatgcagagatttgagcagaactatcattgagtggtcagagtcccatgatagaggctatggaaagtttcagactgctagaatggaagatttcaccttcaatgacttgtgtattaaactgggttttccttacttatactgtcatcagggagactgtgaacatgtcattgtcattactgacataaggcttgtgcatcatgatgactgcttggataggacattgtatcccctccttatcaagaagcattggctatggaccagaaaatgttttgtttgtaaaatgtatacagccagatgggtgacgaacaatgacagttttgcaccagaggacccatgcttcttttgtgatgtttgcttccgaatgctgcactatgattcagaaggcaacaaactgggggaattccttgcttatccttatgttgatcctggaacctttaattaagaatagctacactcacaaaaataccccctcatgaaataactgttctcttggatggttaccttatttctaagaaacgccactgaggaacaggatccactttgaacagtccgctaaagctatcaaaaaaaagtccaaatcacagattttcttataatgatagtatttaaatgtttataacatagtttaattttatatttattccagatagtatttaatttagtgctttttacccattttgagttgagttgtagtactttatatattctgactttaaatcctttgctcagacacacatattctttctcccaatccatgccttccctattcattctctgtccagagttttttgctaaagatagaattattaatgatacatcaagtagtggaagtgttttgaaaattctttgaagaatgtgagagctacaccttctaccatgaggcttccaaggttgtatttaaatttgactgaatatctggatggctaagaacagacatttatcttacacatggaaaactgacgaaacctataagcctatgtgtttgacagtgaagtatgttttatggacttaaatgccacaaacagttaagtccattggcttggagatgacaagcacgagtttctggtatgtctagtgttctcattcactgattcagtcagtacacagataatcactatagagaacttaagaggctggcttatgttatacctaaatttttactttctgtatacaacaatgctaaaattgagcagattgataactgccagcaaaccatagatttaagataaatgaatgatttacccaacccgaaattccatgggctaaattttgatcctttattttcaatacgcgttccttataggtcttacatcgatatcgaaggatattttatcttattcattcatttcatactctcaaaacaccaaacttcaaaaagttaattattgtcataatgcattattccatgtgtggtgtcaatacattttagcggacaaagaagaaacatgccagttaaaacatttctgctactggattctttattaattatttgagaacgttattttgctagttcttaaggttaagtttttcatcaaagactcaggtacctattattgttccctggtgaaactgaggagaaaagttaatcaaccaggttactcccacagtttgcccgtgtgttatgtatcagttatacaggtatcccaccaagttcaagtcaaaagaaattcctaactttgtatatttctggagctatataaacccctgatttaagaaaaaaaaaaaaaa

SEQ ID NO: 931 - DNA, 4661 bp, Homo sapiens
gcgggagtcatggatgtagatgctgaaagagagaagataacacaggagatcaaggagctggaaaggattttggatcccggctcctcgggctcccacgtggagatctcagaatcaagtctcgagtcagattctgaagcagattcactgccttctgaggacttggatcctgccgatcccccgatctcggaagaagaaaggtggggcgaagccagcaatgacgaggacgatcccaaggataaaaccctccctgaagacccagaaacctgcctgcagctgaacatggtctaccaggaggtcatccaggagaagctggctgaggccaacctgctgctggcccagaaccgggagcagcaggaggaactcatgagggatctggctgggtccaaaggcaccaaggtgaaagatggcaaaagcctgcccccaagcacatacatggggcacttcatgaagccgtatttcaaggacaaggtcacgggcgtggggccacctgccaacgaggacacacgagagaaggctgcccaggggatcaaggctttcgaggagctccttgtgaccaaatggaaaaactgggaaaaggccttgctccgaaagtcagtggtgagtgaccgcctgcagcgattgcttcagcccaagttactgaagctcgagtacttgcaccagaagcagagcaaagtctccagtgagctggagaggcaagccctggagaagcagggcagggaagccgagaaggagatccaggacatcaaccagcttccagaagaggccttgctgggaaacaggctggacagccacgactgggagaagatttccaatattaactttgaaggcagccgcagtgcagaggagatccggaagttctggcagaactcggagcaccccagcatcaacaagcaggagtggagcagggaggaggaggagcggctgcaggcgatcgcggctgcacacggccacctggagtggcagaagattgcagaggagctggggaccagccgcagcgccttccagtgcctgcagaaattccagcagcacaacaaagctctgaaacgcaaggagtggacagaggaggaggaccgcatgctcacgcagctggtgcaggagatgcgcgtcggcagccacatcccctaccgcagaattgtctactatatggaagggagagactccatgcagctgatctaccgatggaccaagagcttggatcctggtctgaagaagggttactgggccccggaggaagatgctaagttgcttcaagctgttgccaaatacggggagcaggattggtttaaaatccgggaagaggtgccaggtaggagcgatgcccagtgccgagatcggtatctcaggagattacatttcagcttgaaaaagggtcggtggaatttaaaagaagaggaacagttaattgaattaatagaaaaatatggtgtcggtcactgggcaaaaatagcttctgagctgccccatcggtctggctcccagtgtctgagcaagtggaagatcatgatggggaagaagcagggtctccggaggcggcggcggagggcccgtcacagcgtccggtggagctctaccagcagcagcggcagcagcagtggcagcagtggagggagcagcagcagcagcagcagcagcagcgaggaggacgagccagagcaggcgcaggccggggagggtgacagagcgctgctgtccccacagtacatggtcccggacatggacctgtgggttcctgccaggcagagcaccagccagccatggagaggaggggcaggggcctggctgggaggccccgctgcctccctcagccctcccaaggggtccagtgccagccagggcggcagcaaggaagcttccaccacagccgcggctcctggagaggagacgagtccggtgcaggtccctgccagggcccacggccctgtcccgaggtctgcccaggcctcccactcagcagacactcgcccggcgggcgcagagaagcaggccctggagggtgggaggcgtctgctgacagtgcctgtggagaccgtgctgagggtgctcagggccaacacggctgctcggagctgcacacagaaagagcagctgaggcagccacccctgcccacctcatccccaggggtcagctctggtgacagcgtggcccgatcccatgtgcagtggctacggcacagagccacccagagtgggcagcggcgctggagacacgctctgcaccggaggctcctgaaccgcaggctgctgctggctgtgaccccttgggtaggggacgttgtcgtgccctgcacacaggcttcccagagacccgccgtagtgcagactcaagcggatggcctcagggagcagctgcagcaggcccgcctggccagcacccctgtgtttaccctgtttacccagctgttccacatcgatactgccggctgcttggaggtcgtccgagagaggaaggccctgccacccaggctgccccaggctggtgctcgggacccaccagttcatcttctgcaggcatcctcaagtgcccagagcaccccaggccacctcttcccaaacgtgccggctcaagaagcctcaaagagtgccagccacaaagggagccgaagactggcgtccagccgggtggagcgcaccctaccccaggcgtccctgctggcttcaaccggcccccggcccaagcccaagactgtgtcggagctgcttcaggagaagcggcttcaggaggcccgtgccagggaggccacccggggcccggtggtgctcccgtcccagctgctggtctcctcgtctgtgatcctccagccccctctaccacacaccccacacggccgcccagccccgggtcccaccgtcttaaatgtaccgctctctgggcctggggcccccgcggcagccaaacctggcacttctggctcctggcaggaggctgggacttcagccaaggacaagagactctccaccatgcaagccctgcccctcgctcctgtcttctcagaggccgagggcacagcccctgctgcttcccaagcccctgccctgggccccggccagatctctgtgagctgccccgagagtggtctcggacagtctcaggcccccgctgcatcccggaagcagggcctgcctgaggcgccaccctttctccccgcagcccccagccccaccccactgcccgtccagcccctcagcctgacgcacataggagggccacatgtggcgaccagtgtccccctgcctgtcacctgggtgctcacagcccaggggcttctccctgttcctgtaccagctgtggtgagccttcccaggccagcagggacccctggccccgcagggctgctggccactctgctgcctcccctgactgagactcgggcggcccagggccccagggccccagcgttgagcagctcttggcagcccccagccaatatgaacagggaaccggagccttcctgcaggacagacaccccagctcctcccacacacgccctctcccaaagtcctgcagaagcggatggcagtgtggcctttgtccctggagaggcccaggtggccagggagatacctgagcccaggacgtcctcccacgctgaccctcctgaagcagaacccccttggtccgggaggctgccagccttcggtggtgtcatcccagcaactgagccaagggggacgccggggtccccctcagggacacaggagcccagggggcctctgggcctggagaagctgcccctgcgccagcctgggcctgagaagggggccctggacctggagaagccgcccctaccccagcctgggcctgagaagggggccctggacctgggcctgctgtcccaggagggcgaggcggccacacagcagtggctggggggccagcggggggtgcgtgtgcctcttctgggcagcagactgccctatcagcccccagccctgtgcagcctgcgagctctgtccggtctcctactccacaagaaggccctggagcacaaggccacctccctggtggtggggggcgaggctgagcggccggccggagcactgcaagcctcactggggctggtgcgggggcagctccaggacaacccggcctacctcctgttgcgggcgcggttcctggcagccttcaccctccctgcgctcctggccaccctggccccccaaggcgtccgcaccaccctctcagtaccttcgagggtgggctctgagagtgaggatgaagacctcctgagtgagctggaacttgcagacagggacgggcagccgggctgcacgacagccacatgccccattcagggagccccagactctggtaaatgctctgcttcctcctgcctggatacttctaatgaccctgacgacctggacgtgctcagaacccggcatgccaggcacacccggaagcggaggcggctggtgtgagcagcaggacaagcactttctcagaagcccgtggccctgctgacgagagacagcccacccccagcctgcaagagaggcagccagaggccaggtatctgctggccgctgactgaccaggtccgcagtgaacagaggcgggcctgccgactgactgtgtggcatggagcatggctgttccccaagtgcacacctgaacacttggaggaataaagttctgtttttaattgtggaaaaaaaaaaaa

SEQ ID NO: 932 - DNA, 785 bp, Homo sapiens
gggagtcggcggcgatggcgtcatcaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtgaaatgcacatctgaacagagacaggcatgggaaggaggcccaaaagcgacatggcaaaccaccgggcaggggactcgctctttgttgcttcccaaacacttagacgccagcagcatgggttggtgtgctgggctggttaaggccgatggtggagcagagccaacctgcaaaatccacttcctcagcatcagatctcttgataaaagcatgaacctgcatgtaaggaaacgagaggacgtggtgttaaaaagaaacaaaaaaacaaaacccaccaggaaggaaaatccaagagtttcaggtctagagcttgtgctgcacttggaaagagcacctggcacctgcccctgagcaacagtggggccagctgcaggcccaaagacctgctcc

SEQ ID NO: 933 - DNA, 992 bp, Homo sapiens
ggggcagacgtgggacgggaaggacggctgccgggactggcgcgcggggacactgggccgacgcgtggagtagcggggagagcgggaagcctgagggggcggggccggcgcgaggccgtgggtgcggcacgaggatgccggcggcgggacagcgcccgtaggcagccccacgggcagggcgcgcgggcggggcggggcgggccgggccagaggagcgcccggcatgtcgcaagggctcccggccgccggcagcgtcctgcagaggagcgtcgcggcgcccgggaaccagccgcagccgcagccgcagcagcagagccctgaggatgatgacaggaaggtccgaaggagagaaaaaaaccgagttgctgctcagagaagtcggaagaagcagacccagaaggctgacaagctccatgaggaatatgagagcctggagcaagaaaacaccatgctgcggagagagatcgggaagctgacagaggagctgaagcacctgacagaggcactgaaggagcacgagaagatgtgcccgctgctgctctgccctatgaactttgtgccagtgcctccccggccggaccctgtggccggctgcttgccccgatgaagccggggacactcctctgcccagcaaggagccttggtcattttcatacctgggaggaaggcttttccttcacaattgtatacagggggcacctgtggccaggcctcctcctgggagctccaggaccagccagctgtgttccctgcagactgggctcagcccgacatccaacaggcgccaaactcacagagcccttgtgcagatccagcatggaggccaccctcaggagtgacttctcatccaccctggcagctagtaggttctgctgttatgcagagccatttcctctagaatttggataataaagatgcttattgtctctcccttctccagttctgggaatttacaggcacaatacacttccttttcctggaaaaaaaaaaaa

SEQ ID NO: 934 - DNA, 2146 bp, Homo sapiens
cgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagtgcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaaaaaaaaaaaaaaaaaaaaa

SEQ ID NO: 935 - DNA, 4759 bp, Homo sapiens
gccccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggcagcagcccagacgcggcacagagagggcctgggagcttgctgcagcttcagacagggagccaggatgggaaccacggactgacctgacctgcgtcctcggggccactgcactgggtgattcacgtgtgcccaggccctgaggtgggccggacctgggagtggcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggttcctcatgggtgcctcctgtggcgggggcaacatgaaggtggacgattcggcctacgagagcctgggcctgcgcccccggcatgcctactccatcctggatgtccgagatgtccagggcaccaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccaggcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacaggcaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtgaccaccatgcctggggcaggggctgtgcacagacggaccccccacccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaaaaaaaaaaaaaaaaa

SEQ ID NO: 936 - DNA, 2715 bp, Homo sapiens
aggagatgtgccaaactgttaagagtggttatttctgagcagaagaatgtggatgaattccattcttcctatttttcttttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacattaaaaaaaaaaaaaaaa

SEQ ID NO: 937 - DNA, 4108 bp, Homo sapiens
ccggccgtctatgctccaggccctctcctcgcggtgccggtgaacccgccagccgccccgatgtacagcatgatgatggagaccgacctgcactcgcccggcggcgcccaggcccccacgaacctctcgggccccgccggggcgggcggcggcgggggcggaggcgggggcggcggcggcggcgggggcgccaaggccaaccaggaccgggtcaaacggcccatgaacgccttcatggtgtggtcccgcgggcagcggcgcaagatggcccaggagaaccccaagatgcacaactcggagatcagcaagcgcctgggggccgagtggaaggtcatgtccgaggccgagaagcggccgttcatcgacgaggccaagcggctgcgcgcgctgcacatgaaggagcacccggattacaagtaccggccgcgccgcaagaccaagacgctgctcaagaaggacaagtactcgctggccggcgggctcctggcggccggcgcgggtggcggcggcgcggctgtggccatgggcgtgggcgtgggcgtgggcgcggcggccgtgggccagcgcctggagagcccaggcggcgcggcgggcggcggctacgcgcacgtcaacggctgggccaacggcgcctaccccggctcggtggcggcggcggcggcggccgcggccatgatgcaggaggcgcagctggcctacgggcagcacccgggcgcgggcggcgcgcacccgcacgcgcaccccgcgcacccgcacccgcaccacccgcacgcgcacccgcacaacccgcagcccatgcaccgctacgacatgggcgcgctgcagtacagccccatctccaactcgcagggctacatgagcgcgtcgccctcgggctacggcggcctcccctacggcgccgcggccgccgccgccgccgctgcgggcggcgcgcaccagaactcggccgtggcggcggcggcggcggcggcggccgcgtcgtcgggcgccctgggcgcgctgggctctctggtgaagtcggagcccagcggcagcccgcccgccccagcgcactcgcgggcgccgtgccccggggacctgcgcgagatgatcagcatgtacttgcccgccggcgaggggggcgacccggcggcggcagcagcggccgcggcgcagagccggctgcactcgctgccgcagcactaccagggcgcgggcgcgggcgtgaacggcacggtgcccctgacgcacatctagcgccttcgggacgccggggactctgcggcggcgacccacgagctcgcggcccgcgcccggctcccgccccgccccggcgcggcgtggcttttgtacagacgttcccacattcttgtcaaaaggaaaatactggagacgaacgccgggtgacgcgtgtcccccactcaccttccccggagaccctggcgaccgccgggcgctgacaccagacttgggttttagactgaacttcggtgttttcttgagactttttgtacagtatttatcacctacggaggaagcggaaagcgttttctttgctcgaggggacaaaaaagtcaaaacgaggcgagaggcgaagcccacttttgtataccggccggcgcgctcactttcctccgcgttgcttccggacggcgccgaccgccggagcccaagtgacgcggagctcgtcgcatttgttataaatgtagtaaggcaggtccaagcacttacaagttttttgtagttgttaccgctcttttgggttggtttgttaatttatacaaagagattaccaccaccaccccctccttcagacggcggagttatattctgggttttgtaaaactttatgtatctgagcatttccatttttttttttgggttttgtattatttcttgtaaatgcattgtgaaaaattttattttcggcgttgcaatgcggggaggagaagtcagattatgtacatagttttctaaaaagcctttcttctaaaaacgaaaaaagaccccccacccaaaatgtttcgagtcaacaaatttaagagacagagcccattttctccataaatttgtaacatgctatttttatgtgcatgttttatgagttcaaaatgcaatgaggaaatctgacagggaaattatctgtatgaactaaaagtaagggaaccccggggaatgggaggacaggatttttcaaggaacctttttcaatgaaagagaaggaagttaaaacctataggttattttgtagagctgagtgttaatacgggccgagaaataaaagtatcttctgctccggctgtttcactgcggacggctggggctgctgcgcgttaccttgctgcaagcggggcgccttccacctggctgggggtctgcgccacagtttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattgtgctggattctcacacacacagaaatatcgaccatcaccctcccccgcgtgaactgggatgcaagttgctaaccgatgtgaacgcaaaatgccttgttcattattcctgacgagatcttgaggttgtttgatgctttaaattttttaattatattattttctaggtgtttattggtacattgcagttttttttttgaaatttaaaaatttctgtaaaactttgtcttcaagtaatctgacagcattaaatattgcatttaaaaattatactgtagcaaatacatttaaaaattaatcacaacgttaagatgaaattatatttttggaaaaaaaaaacacttgaagcccagatggaaatacgtttatttcagcagccttaggtttcccctcgctttctcaacacccttccttgtcctggagtatggactgtccgtccaaaagtgagcctatgctataagtttaatgagaaccgaattcagcctgcattcgagaatagctttaagtataatgctgatctgacaattgacgtgtaatttgggaagtcattttgataattttgcttaaaccactcattcgttaaagtgattacaaaaaagttcaagaatgatgtccactgctttctaacaagataataaaccccccccctcttttctttttctttatttttatttcttttagctatttgatcctttctgaagcagttgtttctggaagagtctgtgcgcccatggatggctgagcaccactacgacttagtccgggataagggcctccccagtcctctccgggagatgatttgggaaattttataatgcttgttctgttaactcaccgggaccttgagggtccaatgggaccttgagggttttctctgaaatatacaaacttaaaggactctctctgaggttctttgactgacgtccactctcagtctggcccctgtgctcccctgtgtgtaccctggagtttctgtgtccaattgttggcatctaggtcttggctcaagattaggatgtgggccccactttagaggcacagactatgaaaagctgagttagtgcgcccgggacgccaggcaagcagcttttacagtttggcatcttattgcaggtgcttcgtgcacagtcagctgaaatagccaatgccaggtgctccaaccaccttatttccttgttttgttgattagaacaacacagaaaaaagcaaatataaatttttaatgactccatttaaaaatatcacagggtgggggcaaggaaattagctgagattcatctcaggattgagattctatccccccttccccgcccccagcagtgtcgctccaattcaaattagtggagaaaagattacagtaggccctgagccgactgtgaattcggtgcttggccaaggtaacactcatcgtattcacggagtgaaatactatatgatgatagttattatattatatgacgacttcattcacttcccaaatcacagggt

SEQ ID NO: 938 - DNA, 2882 bp, Homo sapiens
gtccggccagggtggttggtggtaaggattcaggctccgtcctaacgaggccgtggcctgaggctcagggccccccgcccctccctcccagcccaccagcgtcacctcccagccccgagctggaccgcacaccttgggacacggttttccacttcctaaggacgagccccagactggaggagaggtccgaggaggtgggcgttggactctttgcgaggaccccggcggctggcccgggggaggcggccgaggcggcggcggcggcggccgggggcgacatggcggaggagcaggacctatcggaggtggagctgagccccgtgggctcggaggagccccgctgcctgtccccggggagcgcgccctcgctagggcccgacggcggcggcggcggatcgggcctgcgagccagcccggggccaggcgagctgggcaaggtcaagaaggagcagcaggacggcgaggcggacgatgacaagttccccgtgtgcatccgcgaggccgtcagccaggtgctcagcggctacgactggacgctggtgcccatgcccgtgcgcgtcaacggcgccagcaaaagcaagccgcacgtcaagcggcccatgaacgccttcatggtgtgggctcaggcagcgcgcaggaagctcgcggaccagtacccgcacctgcacaacgctgagctcagcaagacgctgggcaagctctggaggctgctgaacgaaagtgacaagcgccccttcatcgaggaggctgagcggctccgtatgcagcacaagaaagaccacccggactacaagtaccagcccaggcggcggaagaacgggaaggccgcccagggcgaggcggagtgccccggtggggaggccgagcaaggtgggaccgccgccatccaggcccactacaagagcgcccacttggaccaccggcacccaggagagggctcccccatgtcagatgggaaccccgagcacccctcaggccagagccatggcccacccacccctccaaccaccccgaagacagagctgcagtcgggcaaggcagacccgaagcgggacgggcgctccatgggggagggcgggaagcctcacatcgacttcggcaacgtggacattggtgagatcagccacgaggtaatgtccaacatggagacctttgatgtggctgagttggaccagtacctgccgcccaatgggcacccaggccatgtgagcagctactcagcagccggctatgggctgggcagtgccctggccgtggccagtggacactccgcctggatctccaagccaccaggcgtggctctgcccacggtctcaccacctggtgtggatgccaaagcccaggtgaagacagagaccgcggggccccaggggcccccacactacaccgaccagccatccacctcacagatcgcctacacctccctcagcctgccccactatggctcagccttcccctccatctcccgcccccagtttgactactctgaccatcagccctcaggaccctattatggccactcgggccaggcctctggcctctactcggccttctcctatatggggccctcgcagcggcccctctacacggccatctctgaccccagcccctcagggccccagtcccacagccccacacactgggagcagccagtatatacgacactgtcccggccctaaagggggccctgtcgccaccaccccccgcccagcccctgcccccagcctgtgtgccctgttccttgcccacctcaggcctggtggtggcagtggaggaggctgaggaggctgaagaggctgacaggtcggggggctttctgtctggctcactgccctgatgacccacccgccccatccaggctccagcagcaaagccccaggagaacaggctggacagaggagaaggaggttgactgttgcacccacactgaaagatgaggggctgcaccttcccccaggaatgaccctctatcccaggacctgagaagggcctgctcaccctcctcggggaggggaagcaccagggttggtggcatcggaggccttaccactcctatgactcctgttttctctctcacagatagtgagggtctgacatgcccatgccacctatgccacagtgcctaagggctaggccacccagagactgtgcccggagctggccgtgtctcccactcaggggctgagagtagctttgaggagcctcattggggagtggggggttcgagggacttagtggagttctcatcccttcaatgccccctccctttctgaaggcaggaaggagttggcacagaggccccctgatccaattctgtgccaataacctcattctttgtctgagaaacagcccccagtcctcctccactacaacctccatgaccttgagacgcatcccaggaggtgacgaggcaggggctccaggaaaggaatcagagacaattcacagagcctccctccctgggctccttgccagctccctcttcccttactaggctctatggcccctgctcagtcagccccactccctgggcttcccagagagtgacagctgctcaggccctaacccttggctccaggagacacagggcccagcacccaggttgctgtcggcaggctgaagacactagaatcctgacctgtacattctgcccttgcctcttaccccttgcctcccagtggtatttgaataaagtatgtagctatatctgcccctattttcctgttctgcagccccccaaatccacatgtaactcattactgtctcctgttatttatctcagtagtcccctctcctagccactctagcccctattaactctgcattaagcattccacataataaaattaaaggttccggttaaaaaaaaaaaaaaaaaaaaa

SEQ ID NO: 939 - DNA, 8737 bp, Homo sapiens
acctccgcacgagacccagcggcccgggttggagcgtccagccctgcagcggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatattgaaaggcgcccgctgctcgctctttctctcggagggtgcagagctgggttccttgggaggaagttgtagtggtgatgatgatgatgataatgatgatgatgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggggcgggggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaagggaccattgcaacttttgttaatttaattttttttttttttttttttttttttttttttggagggagaaaactgatgtcttctatgcatccgattcttaacaaaactgcagggagcttgaaaaaatgcagactgtacaaacgcttacaaaaaaaaaaactgtgaactgacttaagatcagagtttacttttcagatcaaattgtttatggttttacaaatgtgatttctacttgccaactttttttttgtaacttgttcccttatacctccttgattgaataccagacagcctagacctcagtacaaaaggtattgaaacatttttgatacataacagacctcagtcttttttaaaaattaatatattttcaggcgtatttttgtacagtgaaaagggaacattcttgctgtgttttttcagtaagactttcaggcacttcttcccttttgatttcttttttttcctctgttttttagcatgcaagtatgttggtacgttatgtcctggtttaaaaaggattaaaattttaaaataatccttgcatctaaaggccttgtggtttaaaaaaaaaaagcaaacttttttttgtacagctatagtagagatttgttcaatatttgtaggtaaagatttattgaaaatggtgatatagacctcagagctgttatcttagtttaaagattgtatatgtactgtactatagtaggactttatgtatctcatacgctgtgatgtggatggggccccagatggaaggtttgaaactggattctcgatttttagcaaaaaagaaaaaaaaaaggcacatagtttaaaaagtttctcattttgtgcaatataatctaaataaagtacagaccatctgcatattttgtagcaaatggtggcaaagcagactcaatgcactgtcgacatcattgcctgtttttttttttttttttttgtgctggaagtctgtatcttgacaattttaataaatcagctggaactgatagaaactcgcatcgccaatagtctctatggaagtcaaactggaggtcctgttgtcgcagagcattcggtggtgaggctgttgtgtgcgcggatgaggggaggtggcaggagagaattctacatttagggggttaggctgaaaagtgttcaattagcaggctgatttctttttcctcttccgctagttgtgaaagacaggggaagggtgttctttctctctgccctccctttccatctccagctccccatttcctttctcacctcctcctccactccctgcctcttctccccacccatcctggcgggcgggctgcgcggaggctcgggagctggccggggaggggcggatggaggggcctgggttgccagctcccttggtcggggtcctgctcgctggggcttgtgtgttctctgcggcgggccgcgtccccgctgagcctcgcggtgacagccgcctttggcagcgagcgctcggggcacttctatccccgcctctcaaagggtggggacagccgtttccagatttgaattttttctgttctttatttttaacgctgcatcttcgcgtgtgctcagaggtggttgttggcggagaacgccgccgcagtgtttgacctctagcggtgaagggggaaggggaagaggaaaggagagaagtggtcggtgtctgtttccttctgtcccccggggccgtggagctgtcggagggaaggaggacggtgcggggccgcagggggcgcggggcgcggcgggacccaggctacgagcgggagggaggcgggagtcgggggaagacgcggcaggccggccgagggcaccccgaggaacatggcatggcctctgtgcgatccgagtcgcggtctccggggtgcctgggagggccgaaccactggtgagggcgtggggagcagggggtggcagagggcacccgggcggtagtccgggacgcgcaaggcagagccctgacgctccgggtccccgtgcctggctcttcttgcctcgccaccgcgtgctcctgggcgcgccccgccgcgggcccttgaggcgcgcggagacaccagcgctggcttcccgggcccgcgggccggggagggaagcctcggggctgcggggtgagaggaagaaagcaaacccggggagcaggcggctgccgcacccgcgcaccccgggccctcaccacgccctccccgcgcgccggctcaggggctgccccggaatcagctccccggggccgccgcaacgaaggtggatccgcatcttgattgttctccgggagcctcctgggggctccggcggcggcgcgggcgcgacccatcccgctggcgctccccgctcgctgaaccccgtttgcctgtccacaccccctcgctccccaccatttttcctgaccggcctgtgtccccgagccctcgcggcaggcccgagcaggcgatcgcggccgggcacgcgcgccccgggctcccgccccccttccgagcatccgccgcctcttttctgctgggtctgggaggagggaggctgggaggccgctcggggcccagcgtgccagccccggagttcagcctcccgagctgcggcgcccgcagcggaggaggttttcagtggctgattgaaactcactgcaaaatcaccacgactctttcacctactgagatgattgaccgaggtttggccttccatttttactgagatttggcgagaccgaatggaagcgtccgcacagtaactgcagctgctaggccagaggggccccggcgcccttcccgcctcccctcccgcttgcttttgccttactcgatcttaccaccacccctcccccggccccccgactgagaactcgggcctctcacccgccccccagcctcccgctctgggcgagcctcctccccagcccccacccctgggatgcgaagccagcaagcttttgctgcagatggacaggtttcttttctgtggctttttcctttcgataaaccatcagatttcagtagtacatttgggaaaagaaggggctgatggcgttaaccaggttctcaatatagaactggatttctggagttgtttaccttaccccacaccccctcaacatgtagactaatgcagccattggtggtacatttattttagccacggataattgaaccagcggtttacaattgacacgtgctccgtgctggtgattttatgtggcagccctctgctgcagttccgaaacttgttggcaacgtaaacccattgataggctgatctatgtattttgaaagcctgaaaacttggcatgtcttttctgttttaatcatagatgaatcttggacattttctgtggtgaggtggaaactttaagtaaattagtaaagtaataatttggcttcagaatgggaagagatagtcaagattttttttttttaaagccatgtggcctaacttgatacaaaaataaaagtaattgtttggcaatctaaatttaaaacctgttagaactcaggacaggcgcttcaatgcgctttttaacaatatttaaggctgttttgatgagtgcgttgtgagaatcatcttaatgaattctttattgagtgtctaaaacatagtataatacacatggtattcttgccactggatagtcttcaataaaagtttaattgatttttttttgttggtctcttaagtaagtcttatttttaactaagcattgacagaatatcttaaaatggtaacctgggggtggcgggtgggtgctgtgtgcacggcagcctagccagtggggatcctgctgtttattataagtagttcacagactctgatggcattttggtaagctttccatctttaagaaattgaaccagcattctcttattaattctttaaactgtggaagtaatttccagttcttacactctgatacgcatcccttttatttaaaaaaaaaaaaaatgctaataaaaggcagtgtacttaaactgtgctttgcaaatattgtgtatgttatgaatgactacagacactgggcaaattatttgtagaatgattatcctttagctagagaaagaaatcattacaactcttttgggcagagatgtttctttttaatgttaatcaaggggaagtgatttaaatatgcataaatgtagcagtcagggtgatttagttgcttttttcatgaaagaaaaagactcaaaagacaagacttatttttctcttctgggacttgaaatcataatcatctgatattagtacagtacaagaaatttacatttgttttttacttcagaatttaagtgacttttgcccaaggaatttgagaaataaggcaaataagttgctctattttaaagtagtcattcaatataaatatattatatcaatcttaacttttttattctctgatatgattaataatatgtatattcttacttttcttctaatgggcatatgtatccttgtggacactttgagagaggttttcttggactctcccatttatagaatctttatactcttttactgtgtggttccctgcttttaacagatttctgaggcaaatatatttgtgcttttttcttatgtaggaagaccagcgaaaatagtttactgagttgtcaattttatcagtagataagaaactttctttattacagtttcagggaagattttttcaggatatttctcagttattctaagggccaaattttgtaaaatttccattaggaatgtcagtttcaaataccctttgtatagcctaagcctgtgaggataacaagaatgagccttacctatcctaacacagggatttacaagttcccaaagtaaccgtctccatgtaactcttgacatacttttctgagatttggcttatttttattattggttatttctcactgttcattctatttgatttattctacaacatccccttttatttaatgatctggaaaattctgctctttgataacaactcaggatttttttgttcagttttggtttttgccccttcctgtggagcctacattttcaaccacaataaagatgaaacaaaatttatgaaactgagctctcttccattttacttactgctggcttttttttttttttttttccttgattcctaccataccttcgtttttttcattgtacttttttaacactacctatatccattagctgcctaattagttttatctgttccatgtggatgcagtgagtttataagagaatttcacaaacaagtagttttttagtgaacttaaaataaacagaattttaaaggagacctatttttatactcaataaaagcacaaaagtgcagaaagtataaaacggcttacaaagggagacacaagctcataatgttccatgtataaaagtaataactttattgggtagagatattcttacaagatctagcacctctgccagtgcacagataggactgttttaaatgatttgggaacttttggttgcctgcagttgtgaacagagaacttctctacagagaaacaaaccactaaaagcaatatgaccgagttgagatgtggtttccaatgagcaattggtgaatttaagcaacctggatgtgcatatgtggaggctcccgtctcactgtttgatcaaacttcttttatgtagtcacgtagacttgattttttctgctgtgaaaatgaaaaaataaagcaatatgacaaaaagtttaaaaatgcataaaaaataggatttcctctaggctcctcgaagagatttttttaatatgatgcttgtcttactttcttagacacgttacatttccccttccaaaaaaaaaaaaaaggacaactggaagtaatttatcatataaagaattttgatcaaatagatattgacaaagggccctctgtcacatttttcttcatccagcttttgttcaaaaacagtatgcctcctcccttgaatcacatagggagaaacgttatactccattctcattaatttcccattttgtctacttttactcttgtacatatgttgtgggtttaagagtcttttgcatttgttctgtgacacctttttttgaattgactgttttaaaacggaggcctattttttccggtttgggactcctagtggttatggcatcccataatgcttcgtgacggccaccaggacagaaccacctgatgttttagagcagttttcagcatgacactgttaacaagtgtgtattttccaaggccacatgaaacttactttcttagccactccaggtttgggagcagaaaagctgaaaaacccttttgtgtagaagtctgagtggtttgtgggggggaccttttttagagtttgcatgccagcgcacggcctattgctgtgaaacagagagaaggtaaagctacctgaggcagtgcgctggaggatgaagtgtttgatagcactaggggggaaagaaaatgcatggcaaagtttcgtcttctcgtagactatctagcatgcagagtgtagtgtgttgaaacggtgtatgacattgctgtatcaaagttgtaaaattaagcattatttattgaaaactatgtatttttttgtaaaaacctgatcacatagagaatatcagtggcttgtgcttgtgcttcgatctaaccagcttcttgacccacccccccttggtatgcagtgttaatgctcagggttgaaaatagtacactccaatgtctcttttgcaagagtttttcacagaggattacatttgttcaaaagactctaataaaattgtgtgatcaatcttcaaaaaaaaaaaaaaaaaaa

SEQ ID NO: 940 - DNA, 1718 bp, Homo sapiens
ccgccatccgccctcccggcctggcctgcccttgcgcccggctccccagtgcccgccgcccgcccgccgcgctcccgcgctccgttccgcccaggccgcgcccagctggaatgcagagatcgccgcccggctacggcgcacaggacgacccgcccgcccgccgcgactgtgcatgggccccgggacacggggccgccgctgacacgcgcggcctcgccgccggccccgccgccctcgccgcgcccgccgcgcccgcctcgccgcccagcccgcagcgcagtcccccgcgcagccccgagccggggcgctatggcctcagcccggccggccgcggggaacgccaggcggcagacgagtcgcgcatccggcggcccatgaacgccttcatggtgtgggcaaaggacgagcgcaagcggctggctcagcagaacccggacctgcacaacgcggtgctcagcaagatgctgggcaaagcgtggaaggagctgaacgcggcggagaagcggcccttcgtggaggaagccgaacggctgcgcgtgcagcacttgcgcgaccaccccaactacaagtaccggccgcgccgcaagaagcaggcgcgcaaggcccggcggctggagcccggcctcctgctcccgggattagcgcccccgcagccaccgcccgagcctttccccgcggcgtctggctcggctcgcgccttccgcgagctgcccccgctgggcgccgagttcgacggcctggggctgcccacgcccgagcgctcgcctctggacggcctggagcccggcgaggctgccttcttcccaccgcccgcggcgcccgaggactgcgcgctgcggcccttccgcgcgccctacgcgcccaccgagttgtcgcgggaccccggcggttgctacggggctcccctggcggaggcgctcaggaccgcgccccccgcggcgccgctcgctggcctgtactacggcaccctgggcacgcccggcccgtaccccggcccgctgtcgccgccgcccgaggccccgccgctggagagcgccgagccgctggggcccgccgccgatctgtgggccgacgtggacctcaccgagttcgaccagtacctcaactgcagccggactcggcccgacgcccccgggctcccgtaccacgtggcactggccaaactgggcccgcgcgccatgtcctgcccagaggagagcagcctgatctccgcgctgtcggacgccagcagcgcggtctattacagcgcgtgcatctccggctaggccgccggcgccgcccgggtccctgcagcgcttcctcccgcagcccccgcgaccgatccgaccgcgtcgctgccgctctgctctctcatacgcgtgtatgtttggttccatgtcacagccccctaggagccagtgatgctcggccttgcgcccgttccacctcccaggccacccttcctgggcttctgggccacctgccctcggggggcccctgcgagggtgcctggagttcccacgtgtcccggggcttttccaggaagcccgagcccaggacctgttggcagagttgccagggttacatttttgaagcacctgctccttttcttgcagtgtattttctacaaccagattgtattaatattttttactttgcccttttaaaaaatatacctaatacaatatatttaatttttaattaaactcttaaacttttcttccaaaaaaaaaaaaaaa

SEQ ID NO: 941 - DNA, 1109 bp, Homo sapiens
  modified_base (829)..(829): a, c, t, g, unknown or other
cggcgggctgggcccgcgcacagcgcccgcatgtacaacatgatggagacggagctgaagccgccgggcccgcagcaaacttcggggggcggcggcggcaactccaccgcggcggcggccggcggcaaccagaaaaacagcccggaccgcgtcaagcggcccatgaatgccttcatggtgtggtcccgcgggcagcggcgcaagatggcccaggagaaccccaagatgcacaactcggagatcagcaagcgcctgggcgccgagtggaaacttttgtcggagacggagaagcggccgttcatcgacgaggctaagcggctgcgagcgctgcacatgaaggagcacccggattataaataccggccccggcggaaaaccaagacgctcatgaagaaggataagtacacgctgcccggcgggctgctggcccccggcggcaatagcatggcgagcggggtcggggtgggcgccggcctgggcgcgggcgtgaaccagcgcatggacagttacgcgcacatgaacggctggagcaacggcagctacagcatgatgcaggaccagctgggctacccgcagcacccgggcctcaatgcgcacggcgcagcgcagatgcagcccatgcaccgctacgacgtgagcgccctgcagtacaactccatgaccagctcgcagacctacatgaacggctcgcccacctacagcatgtcctactcgcagcagggcacccctggcatggctcttggctccatgggttcggtggtcaagtccgaggccagctccagcccccctgtggttacctcttcctcccactccagggcgccctgccagnccggggacctccgggacatgatcagcatgtatctccccggcgccgaggtgccggaacccgccgcccccagcagacttcacatgtcccagcactaccagagcggcccggtgcccggcacggccattaacggcacactgcccctctcacacatgtgagggccggacagcgaactggaggggggagaaattttcaaagaaaaacgagggaaatgggaggggtgcaaaagaggagagtaagaaacagcatggagaaaacccggtacgctccacaaaaaaaaaaa

SEQ ID NO: 942 - DNA, 2537 bp, Homo sapiens
ctccgcgggcagccaacattgatttcctccgggccgagggcgagggcccgggcggcggcgggctgcagccgcggcagggcgagagcatgtccaagccggtggaccacgtcaagcggcccatgaacgccttcatggtgtggtcgcgggctcagcggcgcaagatggcccaggagaaccccaagatgcacaactcggagatcagcaagcgcttgggcgccgagtggaaactgctcacagagtcggagaagcggccgttcatcgacgaggccaagcgtctacgcgccatgcacatgaaggagcaccccgactacaagtaccggccgcggcgcaagcccaagacgctgctcaagaaggacaagttcgccttcccggtgccctacggcctgggcggcgtggcggacgccgagcaccctgcgctcaaggcgggcgccgggctgcacgcgggggcgggcggcggcctggtgcctgagtcgctgctcgccaatcccgagaaggcggccgcggccgccgccgctgccgccgcacgcgtcttcttcccgcagtcggccgctgccgccgccgctgccgccgccgccgccgccgcgggcagcccctactcgctgctcgacctgggctccaaaatggcagagatctcgtcgtcctcgtccggcctcccgtacgcgtcgtcgctgggctacccgaccgcgggcgcgggcgccttccacggcgcggcggcggcggctgcagcggcggccgccgccgccggggggcacacgcactcgcaccccagcccgggcaacccgggctacatgatcccgtgcaactgcagcgcgtggcccagccccgggctgcagccgccgctcgcctacatcctgctgccgggcatgggcaagccccagctggacccctaccccgcggcctacgctgccgcgctatgaccccgcggggccgcctcgcgaggaccggtgtgcacacgtgtacatatgtataggtacgagcgctgcggcctccccgtgcgccctcccgcgaccgggggcccggtttgtatgtacatagaatgtataggtgccaggtagaggcagagaggccaggcggggcaggagtggccaagcgcgcaagggcgcgggcgagcaggcctgtgaattcgcaggatcatttcagacccgcacttcggcagccaactcgaaagcaggcggttgtgtgcggcagcagttggcgtttgctttgcacttcggaacctgttgcgttttgacccacggaggtggaggagtaactttttgacatgttggcctttccagttttgttggaagtttcatggtcggttttgtttttgtttctcattcttcttcctcgcccctcagccccccaacccccaaccccctcccggtccgtgttgcatgcacgctgttcaaatgtgaggtctgaaatggctggcacacgggaaaagctgcttgtgtcattcgtttctgggagtgggatggctctgagcagcctcgcctccctgtttgtactatttgaactttgcagatctctgttctctcaagcagaactcccaaccagatccattcttgaccagtgaccggctcgaatctggccttttgtgtgagatgatcacggtttcttttgtttatcacgccatttgcaaatcagagcaagagctctttctcaagggcaagaaacgcaaacaagaaatatttgtgagatgaaagttgtcaattggattttcttcctaaacaaacaacaacaacaaactactagaagtctccctgagtccactcgcttggatttctgacacagtttacaaaaaaggaaaaaggcactgctcctattttcccttatggctgagttcaccttaagattgtaaatgtgtatatgtcagtgaaaacattgaggcttggaaaatgtgttattttcgttgccctaagtttgagtcgactttagactcaaaaacattttgagcgaatatcaaagttaacttttaaaaattgcgaaactatttcagaatcgcaattttatcgaagattaaatcagacttttttgtctggtaattatatatttattatttagcaaaactgaagaaaaaaagcacagaattgtttcaacagatgtctctcattttcagctagcatttctctcccaagttgagctggtttaatgtgttttggatttccctcctcaattggcttattttttagatcacctgcaattcatttgcaaattgcaataaaacacattttagaaaaaaggaaccttcaattattagctttgtttctttttaaatgtatatattttgactaatgtttgtgaatgaagttggctaacatgtatttagtttcattttggctttatgtaatataaagtttttaaaattttaaatatggttttaacctttatgtgtaaatgattttctagtgtgaccttctaatttaatattagacgtctaaggtatatctgtaaattagaatccgactatcactctgttcattttttttgaacaaagagtttaaataaagcctgaaccagggaaaagaaaaaaaaaaaaaaaaaaaaaaaaaaaa

SEQ ID NO: 943 - DNA, 2074 bp, Homo sapiens
atgcgacctgttcgagagaactcatcaggtgcgagaagcccgcgggttcctgctgatttggcgcggagcattttgataagcctacccttcccgccggactcgctggcccacaggcccccaagctccgctccgacggagtcccagggccttttcaccgtggccgctccagccccgggagcgccttctcctcccgccacgctggcgcaccttcttcccgccccggcaatgtacagccttctggagactgaactcaagaaccccgtagggacacccacacaagcggcgggcaccggcggccccgcagccccgggaggcgcaggcaagagtagtgcgaacgcagccggcggcgcgaactcgggcggcggcagcagcggtggtgcgagcggaggtggcgggggtacagaccaggaccgtgtgaaacggcccatgaacgccttcatggtatggtcccgcgggcagcggcgcaaaatggccctggagaaccccaagatgcacaattctgagatcagcaagcgcttgggcgccgactggaaactgctgaccgacgccgagaagcgaccattcatcgacgaggccaagcgacttcgcgccgtgcacatgaaggagtatccggactacaagtaccgaccgcgccgcaagaccaagacgctgctcaagaaagataagtactccctgcccagcggcctcctgcctcccggtgccgcggccgccgccgccgctgccgcggccgcagccgctgccgccagcagtccggtgggcgtgggccagcgcctggacacgtacacgcacgtgaacggctgggccaacggcgcgtactcgctggtgcaggagcagctgggctacgcgcagcccccgagcatgagcagcccgccgccgccgcccgcgctgccgccgatgcaccgctacgacatggccggcctgcagtacagcccaatgatgccgcccggcgctcagagctacatgaacgtcgctgccgcggccgccgccgcctcgggctacgggggcatggcgccctcagccacagcagccgcggccgccgcctacgggcagcagcccgccaccgccgcggccgcagctgcggccgcagccgccatgagcctgggccccatgggctcggtagtgaagtctgagcccagctcgccgccgcccgccatcgcatcgcactctcagcgcgcgtgcctcggcgacctgcgcgacatgatcagcatgtacctgccacccggcggggacgcggccgacgccgcctctccgctgcccggcggtcgcctgcacggcgtgcaccagcactaccagggcgccgggactgcagtcaacggaacggtgccgctgacccacatctgagcaccggcctgcgctcgtccacccttgttccccacccccacccccactcccgccccgcacccccaagttgggacgccttgtttagctttgcttgcctgggactgttgccttgtaccgatgatggggagggctgaaagttttgctgtagctgtcgggttttgtacaaaagcaaaaataagtcaggagcagcgaaaatgggacttctagagagctctcttgccccacgccgctgctcctttcacctttgtaggctgggaatcgctgtgttatttgcaaagaaaaaacagcccccactcctcctcctgagttccagggttattctgttacatttgaaaatgttgtcttgttagtttgcagttagccaaggagtgaatgggagaaacatagtatcgggtgaggccagctggagaactgcaacgcctacgcccccagtcgtgtcgcgtctgttttcctcgtggttttttggggcgctgaccgctccaagcagcgcggcagctaaagccaatgttaatttatagccaggtgtgcgtgtgtctcccgcctcgccgcccctggccgcgggacagcttctgtccaatcatgttgagttggtgatttctgccgtgatctgtttgatatttcttcgcgctaatgtgttcagatttcgtttgggtagtggggaggggctactttgtttcagggttttcaagcttttactcttaattcctaaatgagatcaataaattttataacc

SEQ ID NO: 944 - DNA, 2787 bp, Homo sapiens
gggggagggatgactaaagacaacggctgtaagagaactccacaagagagtcagaacgaaaatgtgcaacaagtgcggcggctcctaccatggcaggtgattcgaggactcagcacgaggcgagagtagggaccaggaagagccggaaaacccgcctgtgattggccgtccacgggtatcggtcgttgtgattgggtgaggcccagacagacagctgcgttttgaaccgcgtagggttctgggtagcaaaggccttgcaaggctcttaaccgaaagggggagggggaaggtcgccaacaaacggctgagctcacaatcctggccggggcgtccccctcccccatggagagagccagacccgagccgccgcctcagccgcgcccgttgcgtcccgctccgcccccgctgccggtcgagggcacctccttttgggcagcagccatggagccccctccgtcgtctcccacactgagcgcggcagccagtgcgaccttggcctcgtcgtgcggggaggcagtggcgtccggcttacagcccgcggtgcggcggctgctgcaggtgaagccagagcaggtgttgctgctaccacagcctcaggcccagaacgaggaagccgctgcctcgtccgcgcaggcgcggctgttgcagttcaggcccgacctgcggctcctgcagccgccgacagcgtcagacggcgccacctccaggcccgagttgcacccggtgcagcccctggcgctgcatgtcaaggccaagaagcagaagctggggcccagcctggatcagtcagtggggcctcgaggggccgtcgaaaccggtcctagagcctccagggtggtcaagttggaaggccccgggccggccctcggctacttccgaggggacgagaagggcaagctggaggcggaggaggtcatgagagactcgatgcaaggcggggcaggcaaaagcccggcagccatccgagaaggtgtgatcaaaacggaggaacccgagagactcctcgaggactgcaggctcggcgcggagcccgcgtccaatggcctggttcatggcagcgcggaggtcatcttggccccaacgtccggtgcctttgggccgcaccagcaagaccttaggatccctttgacgctccacacggtcccccctggggcccggatccagtttcagggagctccgccttcagagctgataagattgaccaaggtccccctgacaccagtgcctactaaaatgcagtccctactggagccttctgtaaaaattgaaaccaaagatgtcccgctcaccgtgttgccctcagatgcaggcataccagatactcccttcagtaaggacagaaatggtcatgtgaagcgacccatgaacgcatttatggtttgggcaaggatccaccgaccagcactagccaaagctaacccagcagccaacaatgcagaaatcagtgtccagcttgggttagagtggaacaaacttagtgaagaacaaaagaaaccctattacgatgaagcacaaaagattaaggaaaagcacagagaggaatttcctggttgggtttatcagcctcgtccagggaagcgaaaacgattccctctaagtgtttccaatgtattttctggtaccacacagaatatcatctctacaaatcctacaacagtttatccttaccgctcacctacgtactctgtggtaattcccagcctacagaatcccatcactcatccagttgtacatgcccttacagtcggcctccctttggctatggaaattttccgagttcaatgccagaatgccttagttattatgaagacaggtacccaaaacatgagggtatcttttcaactttaaatagagactattcttttagagactactcaagtgaatgcacacacagtgaaaattctcggagttgtgagaacatgaatggaacttcttactataacagtcatagccacagtggggaagaaaacttaaaccctgtgcctcagctggacattggaaccttggagaatgtcttcacagccccgacatcaactccttctagcatccagcaagtcaatgtcaccgacagtgatgaggaggaagaagaaaaagtgctcagggatttataattttaaaacaaatatgcacagaaaataaacatttcttaaaatatattctgggtcagttggtatgagaaaaaaaaaagcctagaattctttgttgaaagttttcagtcgtgatttgaggagttaaaaccaaatgcaatttatgtcttcataaaattttgattagtgaaactagagtctggatgtttcattgtaggaatatttaagttattaagtagtttaattttaatggctgaaatttgcatcaacatgtattattattactttatcctggaacatgcaaaatactgaagcctcacagttgtatgtgaggggaaaggggaaataaatctagcatagtgtgatttttattttatctcaggatacattttttaaatgattttttgtttgctttttatgtaatacttatggatgttgtcaatttttgatgtaacattttgaaagtattttgacaactcctagtgaacttggacttggttgctaaatttaacttacactaataaccaattataagttccaaatgtgttttaatggcacctgggtgattcttcagctaaatttagtcatttctgtttctaaatatttttatcattttaaaatattttttttccatttggcatacatcgttctttgttgtaattaaataaacatagataaaattgttaaaaaaaaaaaaaaa

SEQ ID NO: 945 - DNA, 4912 bp, Homo sapiens
attggggtctgctctaagctgcagcaagagaaactgtgtgtgaggggaagaggcctgtttcgctgtcgggtctctagttcttgcacgctctttaagagtctgcactggaggaactcctgccattaccagctcccttcttgcagaagggagggggaaacatacatttattcatgccagtctgttgcatgcaggctttttggcttcctaccttgcaacaaaataattgcaccaactccttagtgccgattccgcccacagagagtcctggagccacagtcttttttgctttgcattgtaggagagggactaagtgctagagactatgtcgctttcctgagctaccgagagcgctcgtgaactggaatcaactgcttcagggaaaaagaaaaaaaaaaaaaaaagacttgcctgggaggccgcgagaaacttgcattggaagcttcagcaaccagcattcgagaaactcctctctactttagcacggtctccagactcagccgagagacagcaaactgcagcgcggtgagagagcgagagagagggagagagagactctccagcctgggaactataactcctctgcgagaggcggagaactccttccccaaatcttttggggacttttctctctttacccacctccgcccctgcgaggagttgaggggccagttcggccgccgcgcgcgtcttcccgttcggcgtgtgcttggcccggggaaccgggagggcccggcgatcgcgcggcggccgccgcgagggtgtgagcgcgcgtgggcgcccgccgagccgaggccatggtgcagcaaaccaacaatgccgagaacacggaagcgctgctggccggcgagagctcggactcgggcgccggcctcgagctgggaatcgcctcctcccccacgcccggctccaccgcctccacgggcggcaaggccgacgacccgagctggtgcaagaccccgagtgggcacatcaagcgacccatgaacgccttcatggtgtggtcgcagatcgagcggcgcaagatcatggagcagtcgcccgacatgcacaacgccgagatctccaagcggctgggcaaacgctggaagctgctcaaagacagcgacaagatccctttcattcgagaggcggagcggctgcgcctcaagcacatggctgactaccccgactacaagtaccggcccaggaagaaggtgaagtccggcaacgccaactccagctcctcggccgccgcctcctccaagccgggggagaagggagacaaggtcggtggcagtggcgggggcggccatgggggcggcggcggcggcgggagcagcaacgcggggggaggaggcggcggtgcgagtggcggcggcgccaactccaaaccggcgcagaaaaagagctgcggctccaaagtggcgggcggcgcgggcggtggggttagcaaaccgcacgccaagctcatcctggcaggcggcggcggcggcgggaaagcagcggctgccgccgccgcctccttcgccgccgaacaggcgggggccgccgccctgctgcccctgggcgccgccgccgaccaccactcgctgtacaaggcgcggactcccagcgcctcggcctccgcctcctcggcagcctcggcctccgcagcgctcgcggccccgggcaagcacctggcggagaagaaggtgaagcgcgtctacctgttcggcggcctgggcacgtcgtcgtcgcccgtgggcggcgtgggcgcgggagccgaccccagcgaccccctgggcctgtacgaggaggagggcgcgggctgctcgcccgacgcgcccagcctgagcggccgcagcagcgccgcctcgtcccccgccgccggccgctcgcccgccgaccaccgcggctacgccagcctgcgcgccgcctcgcccgccccgtccagcgcgccctcgcacgcgtcctcctcggcctcgtcccactcctcctcttcctcctcctcgggctcctcgtcctccgacgacgagttcgaagacgacctgctcgacctgaaccccagctcaaactttgagagcatgtccctgggcagcttcagttcgtcgtcggcgctcgaccgggacctggattttaacttcgagcccggctccggctcgcacttcgagttcccggactactgcacgcccgaggtgagcgagatgatctcgggagactggctcgagtccagcatctccaacctggttttcacctactgaagggcgcgcaggcagggagaagggccggggggggtaggagaggagaaaaaaaaagtgaaaaaaagaaacgaaaaggacagacgaagagtttaaagagaaaagggaaaaaagaaagaaaaagtaagcagggctggcttcgcccgcgttctcgtcgtcggatcaaggagcgcggcggcgttttggacccgcgctcccatcccccaccttcccgggccggggacccactctgcccagccggagggacgcggaggaggaagagggtagacaggggcgacctgtgattgttgttattgatgttgttgttgatggcaaaaaaaaaaaagcgacttcgagtttgctcccctttgcttgaagagaccccctcccccttccaacgagcttccggacttgtctgcacccccagcaagaaggcgagttagttttctagagacttgaaggagtctcccccttcctgcatcaccaccttggttttgttttattttgcttcttggtcaagaaaggaggggagaacccagcgcacccctccccccctttttttaaacgcgtgatgaagacagaaggctccggggtgacgaatttggccgatggcagatgttttgggggaacgccgggactgagagactccacgcaggcgaattcccgtttggggcttttttttcctccctcttttccccttgccccctctgcagccggaggaggagatgttgaggggaggaggccagccagtgtgaccggcgctaggaaatgacccgagaaccccgttggaagcgcagcagcgggagctaggggcgggggcggaggaggacacgaactggaagggggttcacggtcaaactgaaatggatttgcacgttggggagctggcggcggcggctgctgggcctccgccttcttttctacgtgaaatcagtgaggtgagacttcccagaccccggaggcgtggaggagaggagactgtttgatgtggtacaggggcagtcagtggagggcgagtggtttcggaaaaaaaaaaagaaaaaaagaaaaaaaaagaaaaaaaaaagatttttttcttctcttaatcggaatcgtgatggtgttggattatttcaatggtggggttaatatagcatgttatcctgtctatcttttaaagatttctgtataagactgttgagcagtttttaaaatagtgtaggataatataaaaagcagatagatggcgctatgtttgattcctacaacgaaattatcaccagctttttttcattcttaactctttaaaggattcaaacgcaactcaaatctgtgctggactttaaaaaaacaattcaggaccaaattttttctcagtgtgtgtgtttattccttataggtgtaaatgagaagacgtgtttttttccttcaccgatgctccatcctcgtatttctttttccttgtaaatgtaatcagatgccattttatatgtggacgtatttatactggccaaacatattttttcttttgtccctttttttctttcctttctttttacttcctttatttctttattccttccttttcctttttttcttttttttttctttttttttttttttttttggtagttgttgttacccacgccattttacgtctccttcactgaagggctagagttttaacttttaattttttatatttaaatgtagacttttgacacttttaaaaaacaaaaaaagacaagagagatgaaaacgtttgattattttctcagtgtatttttgtaaaaaatatataaagggggtgttaatcggtgtaaatcgctgtttggatttcctgattttataacagggcggctggttaatatctcacacagtttaaaaaatcagcccctaatttctccatgtttacacttcaatctgcaggcttcttaaagtgacagtatcccttaacctgccaccagtgtccaccctccggcccccgtcttgtaaaaaggggaggagaattagccaaacactgtaagcttttaagaaaaacaaagttttaaacgaaatactgctctgtccagaggctttaaaactggtgcaattacagcaaaaagggattctgtagctttaacttgtaaaccacatcttttttgcactttttttataagcaaaaacgtgccgtttaaaccactggatctatctaaatgccgatttgagttcgcgacactatgtactgcgtttttcattcttgtatttgactatttaatcctttctacttgtcgctaaatataattgttttagtcttatggcatgatgatagcatatgtgttcaggtttatagctgttgtgtttaaaaattgaaaaaagtggaaaacatctttgtacatttaagtctgtattataataagcaaaaagattgtgtgtatgtatgtttaatataacatgacaggcactaggacgtctgcctttttaaggcagttccgttaagggtttttgtttttaaacttttttttgccatccatcctgtgcaatatgccgtgtagaatatttgtcttaaaattcaaggccacaaaaacaatgtttgggggaaaaaaaagaaaaaatcatgccagctaatcatgtcaagttcactgcctgtcagattgttgatatataccttctgtaaataactttttttgagaaggaaataaaatcagctggaactgaaccctaaaaaaaaaaaaaaaaaaaaaaaaaaaaaaaaaaaa

SEQ ID NO: 946 - DNA, 4333 bp, Homo sapiens
gagaaaatcaattggtttagaaggtttggactcacttgacaggttcagttggagacgatcataggtggctgctgtgacaaagggaaattgtgcttttccagcatgcttactgaccctgatttacctcaggagtttgaaaggatgtcttccaagcgaccagcctctccgtatggggaagcagatggagaggtagccatggtgacaagcagacagaaagtggaagaagaggagagtgacgggctcccagcctttcaccttcccttgcatgtgagttttcccaacaagcctcactctgaggaatttcagccagtttctctgctgacgcaagagacttgtggccataggactcccacttctcagcacaatacaatggaagttgatggcaataaagttatgtcttcatttgccccacacaactcatctacctcacctcagaaggcagaagaaggtgggcgacagagtggcgagtccttgtctagtacagccctgggaactcctgaacggcgcaagggcagtttagctgatgttgttgacaccttgaagcagaggaaaatggaagagctcatcaaaaacgagccggaagaaacccccagtattgaaaaactactctcaaaggactggaaagacaagcttcttgcaatgggatcggggaactttggcgaaataaaagggactcccgagagcttagctgagaaagaaaggcaactcatgggtatgatcaaccagctgaccagcctccgagagcagctgttggctgcccacgatgagcagaagaaactagctgcctctcagattgagaaacagcgtcagcaaatggagctggccaagcagcaacaagaacaaattgcaagacagcagcagcagcttctacagcaacaacacaaaatcaatttgctccagcaacagatccaggttcaaggtcagctgccgccattaatgattcccgtattccctcctgatcaacggacactggctgcagctgcccagcaaggattcctcctccctccaggcttcagctataaggctggatgtagtgacccttaccctgttcagctgatcccaactaccatggcagctgctgccgcagcaacaccaggcttaggcccactccaactgcagcagttatatgctgcccagctagctgcaatgcaggtatctccaggagggaagctgccaggcataccccaaggcaaccttggtgctgctgtatctcctaccagcattcacacagacaagagcacaaacagcccaccacccaaaagcaaggatgaagtggcacagccactgaacctatcagctaaacccaagacctctgatggcaaatcacccacatcacccacctctccccatatgccagctctgagaataaacagtggggcaggccccctcaaagcctctgtcccagcagcgttagctagtccttcagccagagttagcacaataggttacttaaatgaccatgatgctgtcaccaaggcaatccaagaagctcggcaaatgaaggagcaactccgacgggaacaacaggtgcttgatgggaaggtggctgttgtgaatagtctgggtctcaataactgccgaacagaaaaggaaaaaacaacactggagagtctgactcagcaactggcagttaaacagaatgaagaaggaaaatttagccatgcaatgatggatttcaatctgagtggagattctgatggaagtgctggagtctcagagtcaagaatttatagggaatcccgagggcgtggtagcaatgaaccccacataaagcgtccaatgaatgccttcatggtgtgggctaaagatgaacggagaaagatccttcaagcctttcctgacatgcacaactccaacatcagcaagatattgggatctcgctggaaagctatgacaaacctagagaaacagccatattatgaggagcaagcccgtctcagcaagcagcacctggagaagtaccctgactataagtacaagcccaggccaaagcgcacctgcctggtggatggcaaaaagctgcgcattggtgaatacaaggcaatcatgcgcaacaggcggcaggaaatgcggcagtacttcaatgttgggcaacaagcacagatccccattgccactgctggtgttgtgtaccctggagccatcgccatggctgggatgccctcccctcacctgccctcggagcactcaagcgtgtctagcagcccagagcctgggatgcctgttatccagagcacttacggtgtgaaaggagaggagccacatatcaaagaagagatacaggccgaggacatcaatggagaaatttatgatgagtacgacgaggaagaggatgatccagatgtagattatgggagtgacagtgaaaaccatattgcaggacaagccaactgataagggtcaaaagattgttgtgaccttaggacttaaagaagccctaactggttcatccttaccagtggccaagcacattaactttctcatacactgactgttactttaactgttagtcttaaatagttgggacatcagctgactaatagacctcagcctcaaaaggcttggaaagaaaaaacaaatacaacaagcaaacaacaatatcaacaacaagagattgaaataagctatgggtaaaataatgccagtaattcagctgctacatccaagcactgaagtcttacccgtcaacttttttttttttttaaataaactttatggctgtttgttctacaatgttctagaaattctcactcaggtacacagtgccaacaagtggcttgtgaatgtgttttgttgttttgtgctacaatttttaaaaagaaaaaagttttgttttgttttttggggtttctgggttttttccttttctttttctttcctttcattttttttctttgtaatgcacctgacagaaaaaaaagaaaaatgaatttctctttacttctctccaccttctccatctctctactttaaagatggaagtctgtgcatgaggggaaagagggaaaaagagcctgtttttaacttccttgctatccaccacaaaataagcaattattttctttagaggactttatctattgcacaccacactacatctttgagcaagtgccaaatttgtactgaagtgttgaccaagttcattttttctctttactttttccttttccttcttaagttaggacagtgttaaatcttagacaatcccttgaaaaacctgaaataccagcagctggtgagatttgacttttttttttaatggaaactgtaggtgctgttctcaggtgaaaagagagagagagagagagacataagaaatttagagaaaaatattttctgatcttggatttttgtgtgtatgtatgtatgtgattatggtactaataataggaataacgttggaccattgtgagttaaacccacatctggggatgaaatcccacatcctcccaagtgactggtctagaaataatcttgaccttgactttgcacttcaaatgacaacttaaccaagtatagggctcagaaattatatttttaaatgtctgattattattggatggatcaggtggccctgtgtaatagaggtgtgcatgtataacatggaagctactagcaaactgctcccagatgtcctttctccctggtcagttggttccattaacgtttgctacttagtgatttttgtttttcctgttgatattttgagcaaaacaatcattgttttcattgaatatatttggccattttttcagacaaatagaattagcttatttcttcaacattccatcctttcccgatcaggaaatgaaactgatgattttataaggtatttttcacccctccatgaagtgaggtggaggcctttagcatttcagaagtgtgggccatatgtagttcatgccataaaaagtaggatttaattaaaagtcattgcagcccaataaaatggagcctggctgcacccagggatccttgccactgctcttcccttgctgtcagattaatccactgaagtccaactttggttcaagcagagtatttgcaaagagcaacaactgaatgtgatgggactgcttatgtagattttgccagccaaatgccaaggcagttgtagggcctgtacaaataaatgcaaaatcatttcaagtcaattgccattatttgtattgaagtatcagatagatagtaaatactgcaactagtagcttgatgtgctatagttttcactccagtcatcattttcctatctcaccccccgaaacaccaccctaaagttggatttttacatataaataaaaaaagaatcccttttaaaaaaaaaaaaaaaaaa

SEQ ID NO: 947 - DNA, 8865 bp, Homo sapiens
gtcactttcatgaattcaaaggcaatttaccagtgatttctgggtgctggggctgatattttttgtgcatatttaagaatgtcttccaagcaagccacctctccatttgcctgtgcagctgatggagaggatgcaatgacccaggatttaacctcaagggaaaaggaagagggcagtgatcaacatgtggcctcccatctgcctctgcaccccataatgcacaacaaacctcactctgaggagctaccaacacttgtcagtaccattcaacaagatgctgactgggacagcgttctgtcatctcagcaaagaatggaatcagagaataataagttatgttccctatattccttccgaaatacctctacctcaccacataagcctgacgaagggagtcgggaccgtgagataatgaccagtgttacttttggaaccccagagcgccgcaaagggagtcttgccgatgtggtggacacactgaaacagaagaagcttgaggaaatgactcggactgaacaagaggattcctcctgcatggaaaaactactttcaaaagattggaaggaaaaaatggaaagactaaataccagtgaacttcttggagaaattaaaggtacacctgagagcctggcagaaaaagaacggcagctctccaccatgattacccagctgatcagtttacgggagcagctactggcagcgcatgatgaacagaaaaaactggcagcgtcacaaattgagaaacaacggcagcaaatggaccttgctcgccaacagcaagaacagattgcgagacaacagcagcaacttctgcaacagcagcacaaaattaatctcctgcagcaacagatccaggttcagggtcacatgcctccgctcatgatcccaatttttccacatgaccagcggactctggcagcagctgctgctgcccaacagggattcctcttcccccctggaataacatacaaaccaggtgataactaccccgtacagttcattccatcaacaatggcagctgctgctgcttctggactcagccctttacagctccagaagggtcatgtctcccacccacaaattaaccaaaggctaaagggcctaagtgaccgttttggcaggaatttggacacctttgaacatggtggtggccactcttacaaccacaaacagattgagcagctctatgccgctcagctggccagcatgcaggtgtcacctggagcaaagatgccatcaactccacagccaccaaacacagcagggacggtctcacctactgggataaaaaatgaaaagagagggaccagccctgtaactcaagttaaggatgaagcagcagcacagcctctgaatctctcatcccgacccaagacagcagagcctgtaaagtccccaacgtctcccacccagaacctcttcccagccagcaaaaccagccctgtcaatctgccaaacaaaagcagcatccctagccccattggaggaagcctgggaagaggatcctctttagatatcctatctagtctcaactcccctgccctttttggggatcaggatacagtgatgaaagccattcaggaggcgcggaagatgcgagagcagatccagcgggagcaacagcagcaacagccacatggtgttgacgggaaactgtcctccataaataatatggggctgaacagctgcaggaatgaaaaggaaagaacgcgctttgagaatttggggccccagttaacgggaaagtcaaatgaagatggaaaactgggcccaggtgtcatcgaccttactcggccagaagatgcagagggaggtgccactgtggctgaagcacgagtctacagggacgcccgcggccgtgccagcagcgagccacacattaagcgaccaatgaatgcattcatggtttgggcaaaggatgagaggagaaaaatccttcaggccttccccgacatgcataactccaacattagcaaaatcttaggatctcgctggaaatcaatgtccaaccaggagaagcaaccttattatgaagagcaggcccggctaagcaagatccacttagagaagtacccaaactataaatacaaaccccgaccgaaacgcacctgcattgttgatggcaaaaagcttcggattggggagtataagcaactgatgaggtctcggagacaggagatgaggcagttctttactgtggggcaacagcctcagattccaatcaccacaggaacaggtgttgtgtatcctggtgctatcactatggcaactaccacaccatcgcctcagatgacatctgactgctctagcacctcggccagcccggagcccagcctcccggtcatccagagcacttatggtatgaagacagatggcggaagcctagctggaaatgaaatgatcaatggagaggatgaaatggaaatgtatgatgactatgaagatgaccccaaatcagactatagcagtgaaaatgaagccccggaggctgtcagtgccaactgaggagtttttgtttgctgaattaaagtactctgacatttcacccccctccccaacaaagagttattaaagagcccgcatgcatttgtggctccacaattacatcagcagaatggtcttaattgtttcgtaaagtgtgagacagattaagttttccctgatttttcatgaacttgagttttttgttgttattgttattgttgttgttgttgtttttttaatttaggtgaagacatattaaatatgagacaccaggacttgaaacttatctcaacccgtagatgtcttacaagtcttatatttttgtcttactttttttttcttttggatgttgataaaggtttaagttactgttttagatggggttaaacattctcactcaggtatgctgtgccggcctacaggttgtgaatgtgtttttattctgaattattttagaaaacaactgaggatttcatattgtgaaacagaacaagtccacggcgtgtgcagctgcatgtagagcatattcaaaaggcctcggaattccaattttccatttgtagagttaaactttgaatgtgccaaactttttcgtaacttttgaatcttaatattttgaaagtcttaaaggagacactgcaaagtcttagacaatctttggcatcttaaaataaaatagcaaaccaacatttttttttccagaaaatggtaaggtactcaggaatctggagacaagatattgtaaggaatgaacaaggttgccacagtgcatggacccaattgtgtttgcctgttgacgtgccatcagtgcgtgatgtggtatgacatacacacaccagagcaaccgccacaccagatatcgacagagtggtcttctctgcctgagaccacctctcactacatccattatccctttgcctttaaccctgacattcagtcttaacacattttatcttaaataatttattcattccagaatgtcaagggtccacttgctatttattttttttcaattgttggtggcattaatttaataattcttgtttttcaccttccttccccgaagaacttttccgtccttttcacctccttctcctgtgtacatagtgattttatgtccccagaacgcctggaagcatttctgaaaccaagatattattaaaaacctattattgtttttaatcatgagtatgtatctggctgcagggctgtgtattgggatataggtatatagtcttacacttaaacaggtatgcccctgaggttcactgtgacctcaagtcttttgccagaattttcccctaattcagttcacaagtggtagggtctgcatcagtggcatttccccctgaattccattcagcagcaaggttcaacagtggtgactgccaggcaggagagtcctgcggccaaacctgaagcccaaggctcgtgggccatgcaggaatctcagtgaagctgtcatgggctggcacctttacactgagttgccttgtcccagctggcacatctagggagttcattgcaaaatccccaggatgcaaaaagccacatgacagcctcagagcaaagatggtggcaaatagtcatgatacatctagagaatgaaagaaaactgtaagggaggagaaggaggggaatacattccctatatgggatgttcctactgttaactctggggaacagatagctccgggggcagcagatgagttcctctggctgactctatctgtagccacatggggacctgcctacgtgtgaacaaaatgaactgcacttatcacacaaggatttctttgaagacatgctactggggtgggaagcagtgaggttttattccccatctcctaactacagggagctctgccatgtcattttggccttcctgaaactaggacaggttgtctatcggggggcttcccccagagaggtttagtgggagaatgtcagtgaatgggatagttcacctcatgggacaacccagaatctgatcaccaggacataggaatggccccatcagatttcttgagccattttgtcacttggaagaaaatagtgtacctttgtatttatttaagagtgctcaaggcctaatagcaataaacaggtctagccaagaaattacaagctattctgttagctgggagtgctctctataagctgattaaggtactgataggaactctttgttattcatgttggttggggattagaaatttgtttttgtacatttatttcaaatgaggaggaggtcattttttctctcaaaaaatgagtatttattattgtcttactgatttctttgattatatacctctcctcctcagttcactcttgttttttttctttctctttggcttttgcttttgctctctctcacttctttcttattttgttgcattggtagagtgttgtatggctagcattgtattgtatgtaattaattttgcacaaaagcaaacatttagcatagtaggttaattttgtttgtttttatgaccatgccaaaataatattctgggctggtggagaacaaaggactgttctttaggactgaaacttgattttgctcatagtaagtaaaaaaaaacaaaaaacacacacactcacagatgttgtttcgtaagtgttataagcactggatataaatggtattttttatcacttctgactaatgtgaaactgttgtacgaaaactacatgaacaaaagtcatctgtttcgactcgtgtgggcttgcctcacagttgccggatttgagtcatttttatgtcttgttatttcatttatttatgcaaaatacatgtgtgtatgaacactttgttttagctccagctctgcctcagtactggggttcatttacttttagccatgttcttaaaaatgaaaggctattcaggaatgatctgattgtaaacgtctttttcattggatcaaacagtaatgctgtatttgaatctaaattttgtgtataagcagtttatttattagccaagtttggctctaaatatccatggaaattaagaatgacaatcatagggatcaattcattttattttcagtggggcttaaacaaagtttatatgactttaccatctcattttagatttttctaattgtgtaaatataacatagaaatagaatttatttttggttcatgaatacttagtgagatataagttatgtatttcctttttgttctctatccatagatgttggtccaaactgaaagttgatgagtcactgtgcctctcggggtagtgagttatcagctacagtgagagagcagtgtttggcctgcagctgggacagcaaaacgtttcaccagggttctcatgcagttcagaacccactgtccacagatccagacatttcccttttttcttacagaaagttgatgattggacatactaaatttccactacagttaggagacagtcagtttgctttgggagtctacataaatcttctaagatagttctgtgaccatttaatagcaagaagcatgaatgccactacaaaggcaaaaatccacctctgagatcggccgttaataaacgtcccgtcatgtcagtttagattcaagaatgttaagcaactttgtttttgcggtgctccctatttcatagtatcttcaaatcaaaaataaaaattatctccattttgttaaagaacttacagggtcagggttctccttgtcacttagaattgggacactgccaggcaatcctctcccaaaaaaaaaaaaaaaaaaaaatagccatatggaatggaaggaaaaggagaaaagaaggaagaaaggaaaaaagtaggaagggagagagaaaaaaaaggtcgctttgcggatacgagccgctaggctgacaacttttctatttcattggcagatatgaagcagtgtcttttccagtaaggtacggaagctttgttgttttcatgtgtacccagctcagccttttagaagcacctcggtttgcttcattaggtatttgatactctccagccttgtcctcaggcctgatttgatttgccagggtcctgacaccaaagcccaggccaagttctaaattcaggtgtgggctcacagtgctattgagcttgtcgaattctggcctcccctgaacattagccccacgggagcctgagggtgtttgaaaagggcgtgatcactctagggctgaaattaaaggctgctttcttttccttctgaagccaggctgcttcttcggagtacaccctcctgagccaggagcacaagcactagcagaaagcagggattgtttcaggaaagcccatttaccctcagtaggaaggcagcctggtcacttgaacagcacagctgaggctgcttctctcaatttactcattttgcaaagaattgacctctaccaactcattagggagaggaaaaagaatcacttagtaattttaaatcatatgagaagtcctgtaccaagtgccaacaactgcaaagaaatgcagctagaggaatgtattgaaattactactgggtcttcctttttaatgagaaaatgacaaaaatggttgctgtagccctgcctgattttgtacacgtttgtctaagaattgagttggcacttaagctcacttctcaaagtataataatattgtatgacctcatttgtcctttcacaaaagcacttgcatcatttccttaagtcatctgctccctgacatgttttcttccctaataaacaacttctgtctgttattcctgccaatgatgttctgtttctgatgccatatcctattgagcgtgcccctgtactaatatcattgaaaatattgatatgcaaacacatttccttttcatccccattctatctttccctttggggacagattgctttccaaaagctcatgaacaaatatttggaatgctggtacctttggggcagaggtaagggtgggcggggtgggggcagaaaggtaatgcttaatgcagataactcttctaatcagtgtccatggcaatatgaacgcttgaagaaaactcagtgacatatcttgctcagtagtttcttattcctgaagaaccacaagcataaagtgaggcctcagtgctggtgctcttggagtatggggaatgtgcaaatatttaactgttttgtatgctgcacattgcaggtctgctcatgtgcattctccctttgtcttcctttgtcatatgtgtttttgcttttttgaaagtgcagtctttattgtaccctcctccagcttgtagcaaattagaatgcttagcatttatgttcattcattattgtatttgccatgtaaaatttttattaccttagacaagcttataagctgttactacataacttatcttactgtaactcttttatttcccccgacgttgtaatttgtttgtgatgtatattgtgaaattgtattctatgttaatttaatcagcacaattcactgacatgctggactgacatgctggctgctgtttcaaagtgtaaagtttgtgtagggctgttgggacaactgcaactctgttgtcaaggtactgtgctttggttcctatagcaacactgggtgtggcccttgaattgctaagggcatttaatacatcctggagcaaattttaactgcagattttctttgtagaaattctatgtataatgcaggtacctacttggcccatggctggtaactatttgggcaattagaaaaaaagaaaaaaacataaaaactagtgtctattgctgctttgaatatgtttgaaagtctgaaaatgtaaatagtttatcaaaaaaaaatcttgtacagtccagtgtaaagtttttaaatgaccttaagggttgccatcacatctttctcacactctcctcttgataataataataataaaaagtttgctaaggattaaagaaatgggaaaaataaaaaaaatctcttcaaatttacaggaatgaatcattgttcttagctttgttgcatacacaaacttcttggattttgttgtgcagtattgacgtgagataaagctcaacattgaataatctttcagtggtacttttcaaagtcttcccctcctctgcctcataattaagggaaaagacaaaattgaaagacacactgtctttatctatcctggtgtatgttggcaccttagctactttttttttttcctttttgcacaaggtgctttcctgatatgttcaacatgccatctttgggtgataatgtatatgccgtgatggggctcaggccccttaggggagtgtctataagaactgcctatttatgctcatttacctcaagactgtcctctctaccctaatctagttgtcatcactccatcttttgtactgctgttgacacttacaaattaaagataaattttgttttatga

SEQ ID NO: 948 - DNA, 3219 bp, Homo sapiens
aagttggacgccccgacccgtgcgagggccaggtccgcgcctgccccgccaggcgaagcgaggcgacccgcgtgcggccatggcttcgctgctgggagcctacccttggcccgagggtctcgagtgcccggccctggacgccgagctgtcggatggacaatcgccgccggccgtcccccggcccccgggggacaagggctccgagagccgtatccggcggcccatgaacgccttcatggtttgggccaaggacgagaggaaacggctggcagtgcagaacccggacctgcacaacgccgagctcagcaagatgctgggaaagtcgtggaaggcgctgacgctgtcccagaagaggccgtacgtggacgaggcggagcggctgcgcctgcagcacatgcaggactaccccaactacaagtaccggccgcgcaggaagaagcaggccaagcggctgtgcaagcgcgtggacccgggcttccttctgagctccctctcccgggaccagaacgccctgccggagaagagaagcggcagccggggggcgctgggggagaaggaggacaggggtgagtactcccccggcactgccctgcccagcctccggggctgctaccacgaggggccggctggtggtggcggcggcggcaccccgagcagtgtggacacgtacccgtacgggctgcccacacctcctgaaatgtctcccctggacgtgctggagccggagcagaccttcttctcctccccctgccaggaggagcatggccatccccgccgcatcccccacctgccagggcacccgtactcaccggagtacgccccaagccctctccactgtagccaccccctgggctccctggcccttggccagtcccccggcgtctccatgatgtcccctgtacccggctgtcccccatctcctgcctattactccccggccacctaccacccactccactccaacctccaagcccacctgggccagctttccccgcctcctgagcaccctggcttcgacgccctggatcaactgagccaggtggaactcctgggggacatggatcgcaatgaattcgaccagtatttgaacactcctggccacccagactccgccacaggggccatggccctcagtgggcatgttccggtctcccaggtgacaccaacgggtcccacagagaccagcctcatctccgtcctggctgatgccacggccacgtactacaacagctacagtgtgtcatagagctggaggcgccccgtccggtcagccctcgcgccctctccttcttgtgccttgagtggcagaggagccgtccagccacaccagctttcctcccaccgctcagggcagggaggtctgaactgcggccccagagcctttggcctaagctggactctccttatccgagtgccgcctctatccccttccccacgttccagcccctgcagcccacattttaagtatattccttcaagtgagttttcctccagcccctgagagttgctgtctcccagtggaatgttcactgacgtcttttcttggtagccatcatcgaaactaatggggggacagacttgatagccaaggtcccttctggtccagttttctgatttagggttctctcaagattaataaaggaagatggggaaatttgactcattaatgagctcgctaacctacgatctggtgataattttgtgtgcacagcccaaggaccacgaggctttctgcactttctgcacccccttccaaagtgaccacaaaatttcaaagggactcatacaatttgagaaaaaacagtcaacctgatttgagaaattaaccagtatggctaactatatcacagaaaatgggattgagttaaaactattttattttaaatatacattttaaagcagttctttttttttgttaatttgtttattatacacacacttcaagagaatatgcacagtctaggccgggcacggtggctcacgcctgtaatcccagcactttgggaggccgaggcatgtggatcacctgaggtcaggagtttgagaccagcctagacaacatggtgaaaccttgtctctatgaaaaatacaaaatttgctgggagtggtggtgcatgcctgtaatcccagctacttggaaggctgaggcaggagaatgtcttgaacctaggaggtggaggttgcagtgagctgagattgcaccattgcactccagcctgtgcaacaagagtgaaactccatttcaagaaaaaaaaaaaaaaaagaatatgcacagtctgaatgtataccaggagtgtgagagacacatgcccacttcatgcaactcctaaactcaaagtctaaatcagatatttttattaacaatgacaacttgttgccaactccctgtttctaatgaccaaagacccagggtacctaaaaggactttgcaaccaagcaaagtcactgtcttcaaatctggatacacactttcccctctgtagattcaaaaggtgcttccttcccggctgtctccagcttccttactctcttttctgggatttctttttctcttctttctgctcttcctccactgctgaactggtccctaactgaaacagcccctgacttatcccaagcatgcttcctttagctgctgtgagaatttgtcttcctcaccagccaggtcctcaggcaaagtcctcagccagtgctttagagcaacttcccgcaaatcagaaactcactgtgattccaaaaatgtttctgagccctggacccctgcccccaaaatattttcatctttcccccaaacctcctttaaaggagcatgcataacagtgtgctgaaagacagttgttggttttttgattttagcatattatttcctgtatgaaatatgttttatataatctcctattatttttatcttatgttttgtattgttgataaatcctttttgtccttctaagatgtcctattgtaaaatcacttataaggtatgattactctttatgctattactttatatgccatttggtaataaatagtaaattgttgatgatatgattgactgatgcgcagtccagagcatgtatgaataatctcataaaacagtatcacagacattaagctaaactgtttcgtttttttgaaagaacaactcatactttggaacagttgtcaatattaatttgttgcaaatatttaatttaaataaacatttttgtaccatgaaaa

SEQ ID NO: 949 - DNA, 3049 bp, Homo sapiens
ggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcgcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacagggcagacccacgggccgcccaccccgcccaccacccccaagacggagctgcagcaggcgggcgccaagccggagctgaagctggagggacgccggccggtggacagcgggcgccagaacatcgacttcagcaatgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggccccagtggctgagctccaagtgcctgctgaagtctgcagggaaacacgcttgctgcccgtggccctcggcctccagatggccacacctctgccgacgacggaccagctccctctcccttctatctttctttttgaggtggtgggattattccacaaagaagggctgccgtttggtccctcttccgtgaggactggcggcaccagcaccttcgctttgcatctcggtagaggagaaacggcagcacagcccaaggaccaaaggagggggtggcaggggccttgcagggcgctgtgaggtccaggccggtcttggcgccgagagcccctgcactcaaggccacattccctcgacaacggctgcacgggctgtccgggatccggggtgtctgtccgcagactgggatgagtctactcgagcatctccgggacctgcctgtcagatctgaggtgtctccttgctggcagagtgcgctcacgcgagggctggctgtgatgaacacatctctcttttatttttatgtttttgataatttttatttttgaagcttaaatgtgtttcttctgaaagctgttaaagatgtatttatgttctgtgttattttatctttaattaatgaggtaattcgggcaaagagtagaatttaagacaaaacggaagctgggaagcttcccttgagggcaggcaggaggtggagttgcagctgttggccggcatcacgttgctcgttgctcggcttatgggaggccgccctggagggcccggaggtcccaaggtccctgggaggactgggcccctcatgcctcgagcttggcaaccgaaaacccgagggaggagaagggacctgccttgtgacatctctgatcaggttggggtgccccagcacccagtaccagtttggggtttgggaagcaggactccgtccctgtccccgactgtgccacgtggtaggacacataggacacaggaattcctgggtccttgcccatgactgtgccatgtggtaggacacaggacacaggaattcctggaaagtggtggcttcagaagtgatcttggctcgcaggcaccagtgccacctaccaagctgtgaaactaaaccttctccactaaacgtcgttagggcctcagttctagacgagtcatacctgattcacctgcactgcttcccctgtgtgctgagcatagagcatacaatagcgcctacttcacggaaacttgtgcctttaaactttgtaaacttaaacacagccgagaagttgcttctttgtactttttctacttttcctacttttttgtagaaaaaaaagataatgcctctgcttctatttctctgggggtgggggtgggggccgggagccgtcgcagacccgtttcatgcagcgtctcccttggcaccgcgttcggaggacgcaccctcactcccctgctgccttcactcctttctgaccaagcaacgctaacttttgtacagatcgatttgataaaattaaacaaagtgctttttatgga

SEQ ID NO: 950 - DNA, 3963 bp, Homo sapiens
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgaagatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatcatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttccaattttaccttctttaaaataggttgttggagctttcctcaaagggtatggtcatctgttgttaaattatgttcttaactgtaaccagtttttttttatttatctctttaatctttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctgcatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctcttttttttttttgtatattattgtttacaataaatatacattgcattaaaaagaaaaaaaaaaaaaaaaaaaaaaaaaaaaaaa

SEQ ID NO: 951 - DNA, 2655 bp, Homo sapiens
acaggtgagcttgacctcacagccacacaactttcacagggtgccaatggctggcagatcatctcttcctcctctggggctacccctacctcaaaggaacagagtggcagcagtaccaatggcagcaatggcagtgagtcttccaagaatcgcacagtctctggtgggcagtatgttgtggctgccgctcccaacttacagaaccagcaagttctgacaggactacctggagtgatgcctaatattcagtatcaagtaatcccacagttccagaccgttgatgggcaacagctgcagtttgctgccactggggcccaagtgcagcaggatggttctggtcaaatacagatcataccaggtgcaaaccaacagattatcacaaatcgaggaagtggaggcaacatcattgctgctatgccaaacctactccagcaggctgtccccctccaaggcctggctaataatgtactctcaggacagactcagtatgtgaccaatgtaccagtggccctgaatgggaacatcaccttgctacctgtcaacagcgtttctgcagctaccttgactcccagctctcaggcagtcacgatcagcagctctgggtcccaggagagtggctcacagcctgtcacctcagggactaccatcagttctgccagcttggtatcatcacaagccagttccagctcctttttcaccaatgccaatagctactcaactactactaccaccagcaacatgggaattatgaactttactaccagtggatcatcagggaccaactctcaaggccagacaccccagagggtcagtgggctacaggggtctgatgctctgaacatccagcaaaaccagacatctggaggctcattgcaagcaggccagcaaaaagaaggagagcaaaaccagcagacacagcagcaacaaattcttatccagcctcagctagttcaagggggacaggccctccaggccctccaagcagcaccattgtcagggcagacctttacaactcaagccatctcccaggaaaccctccagaacctccagcttcaggctgttccaaactctggtcccatcatcatccggacaccaacagtggggcccaatggacaggtcagttggcagactctacagctgcagaacctccaagttcagaacccacaagcccaaacaatcaccttagccccaatgcagggtgtttccttggggcagaccagcagcagcaacaccactctcacacccattgcctcagctgcttccattcctgctggcacagtcactgtgaatgctgctcaactctcctccatgccaggcctccagaccattaacctcagtgcattgggtacttcaggaatccaggtgcacccaattcaaggcctgccgttggctatagcaaatgccccaggtgatcatggagctcagcttggtctccatggggctggtggtgatggaatacatgatgacacagcaggtggagaggaaggagaaaacagcccagatgcccaaccccaagccggtcggaggacccggcgggaagcatgcacctgcccctactgtaaagacagtgaaggaaggggctcgggggatcctggcaaaaagaaacagcatatttgccacatccaaggctgtgggaaagtgtatggcaagacctctcacctgcgggcacacttgcgctggcatacaggcgagaggccatttatgtgtacctggtcatactgtgggaaacgcttcacacgttcggatgagctacagaggcacaaacgtacacacacaggtgagaagaaatttgcctgccctgagtgtcctaagcgcttcatgaggagtgaccacctgtcaaaacatatcaagacccaccagaataagaagggaggcccaggtgtagctctgagtgtgggcactttgcccctggacagtggggcaggttcagaaggcagtggcactgccactccttcagcccttattaccaccaatatggtagccatggaggccatctgtccagagggcattgcccgtcttgccaacagtggcatcaacgtcatgcaggtggcagatctgcagtccattaatatcagtggcaatggcttctgagatcaggcacccggggccagagacatatgggccataccccttaaccccgggatgcaaggtagcatgggtccaagagacatggaagagagagccatgaagcattaaaatgcatggtgttgagaagaatcaggagagggatacaagagaggagatggggtcccggcacccatctgtatcatcagtgcctctttgaaggtgggaaacattagtgaaaattctgttggtgccacgctttgatgagcatttgtttgaccccagtttcttcttacacttcttaccccagcctacccttcctgcatttctcttctcagctcttccatgatggattcccccccctttcctaaagccatcatgccttgataaatatatatgatcattgaaatactttttaacaaaaaacagattctatattattatatatatatatatatataaagatatatagagatgcattcacagggttggctggagaggaagaccattctgtgaccaaaataccttggtcattttttttatattgccttatttccctatggctgagccttgttgtgacacatcaagctt

SEQ ID NO: 952 - DNA, 3688 bp, Homo sapiens
atttgggcggagccctttctgagtcagtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggaggctgaatgaatgtatttcaccagtagcaaatgagatgaaccatcttcctgcacacagccacgatttgcaaaggatgttcacggaagaccagggtgtagatgacaggctgctctatgacattgtattcaagcacttcaaaagaaataaggtggagatttcaaatgcaataaaaaagacatttccattcctcgagggcctccgtgatcgtgatctcatcacaaataaaatgtttgaagattctcaagattcttgtagaaacctggtccctgtacagagagtggtgtacaatgttcttagtgaactggagaagacatttaacctgccagttctggaagcactgttcagcgatgtcaacatgcaggaataccccgatttaattcacatttataaaggctttgaaaatgtaatccatgacaaattgcctctccaagaaagtgaagaagaagagagggaggagaggtctggcctccaactaagtcttgaacaaggaactggtgaaaactcttttcgaagcctgacttggccaccttcgggttccccatctcatgctggtacaaccccacctgaaaatggactctcagagcacccctgtgaaacagaacagataaatgcaaagagaaaagatacaaccagtgacaaagatgattcgctaggaagccaacaaacaaatgaacaatgtgctcaaaaggctgagccaacagagtcctgcgaacaaattgctgtccaagtgaataatggggatgctggaagggagatgccctgcccgttgccctgtgatgaagaaagcccagaggcagagctacacaaccatggaatccaaattaattcctgttctgtgcgactggtggatataaaaaaggaaaagccattttctaattcaaaagttgagtgccaagcccaagcaagaactcatcataaccaggcatctgacataatagtcatcagcagtgaggactctgaaggatccactgacgttgatgagcccttagaagtcttcatctcagcaccgagaagtgagcctgtgatcaataatgacaaccctttagaatcaaatgatgaaaaggagggccaagaagccacttgctcacgaccccagattgtaccagagcccatggatttcagaaaattatctacattcagagaaagttttaagaaaagagtgataggacaagaccacgacttttcagaatccagtgaggaggaggcgcccgcagaagcctcgagcggggcactgagaagcaagcatggtgagaaggctcctatgacttctagaagtacatctacttggagaatacccagcaggaagagacgtttcagcagtagtgacttttcagacctgagtaatggagaagagcttcaggaaacctgcagctcatccctaagaagagggtcaggatcacagccacaagaacctgaaaataagaagtgctcctgtgtcatgtgttttccaaaaggtgtgccaagaagccaagaagcaaggactgaaagtagtcaagcatctgacatgatggataccatggatgttgaaaacaattctactttggaaaaacacagtgggaaaagaagaaaaaagagaaggcatagatctaaagtaaatggtctccaaagagggagaaagaaagacagacctagaaaacatttaactctgaataacaaagtccaaaagaaaagatggcaacaaagaggaagaaaagccaacactagacctttgaaaagaagaagaaaaagaggtccaagaattcccaaagatgaaaatattaattttaaacaatctgaacttcctgtgacctgtggtgaggtgaagggcactctatataaggagcgattcaaacaaggaacctcaaagaagtgtatacagagtgaggataaaaagtggttcactcccagggaatttgaaattgaaggagaccgcggagcatccaagaactggaagctaagtatacgctgcggtggatataccctgaaagtcctgatggagaacaaatttctgccagaaccaccaagcacaagaaaaaagagaatactggaatctcacaacaataccttagttgacccttgtgaggagcataagaagaagaacccagatgcttcagtcaagttctcagagtttttaaagaagtgctcagagacatggaagaccatttttgctaaagagaaaggaaaatttgaagatatggcaaaggcggacaaggcccattatgaaagagaaatgaaaacctatatccctcctaaaggggagaaaaaaaagaagttcaaggatcccaatgcacccaagaggcctcctttggcctttttcctgttctgctctgagtatcgcccaaaaatcaaaggagaacatcctggcctgtccattgatgatgttgtgaagaaactggcagggatgtggaataacaccgctgcagctgacaagcagttttatgaaaagaaggctgcaaagctgaaggaaaaatacaaaaaggatattgctgcatatcgagctaaaggaaagcctaattcagcaaaaaagagagttgtcaaggctgaaaaaagcaagaaaaagaaggaagaggaagaagatgaagaggatgaacaagaggaggaaaatgaagaagatgatgataaataagttgcttctagtgcagtttttttcttgtctataaagcatttaagctgcctgtacacaactcactccttttaaagaaaaaaacttcaacgtaagactgtgtaagatttgtttttaaaccgtacactgtgtttttttgtatagttaaccactaccgaatgtgtcttcagatagccctgtcctggtggtatttagccactaacctttgcctggtacagtatgggggttgtaaattggcatggaaatttaaagcaggttcttgttagtgcacagcacaaattagttgtatatgaggatggtagttttttcaccttcagttgtctctgatgtagcttatacaaaacatttgttgttctgttaactgaatgccactctgtaattgcaaaaaaaaaaaacagttgcagctgttttgttgacattctgaatgcttctaagtaaatacaatttttaaaaaaccgtatgagggaactgtgtagacaaggtaccaggtcagtcttcttccatgtctattagctccacaaagccaatctcaatccctcaaaacaatcttgtcatacttgaaaatatgacactctagtcaaagccttggtaaaataatcagtgtttccaatctgtcctgttacaaaagaaacagattattattgaacttatgcaaataaccattgtcataagaatgtttatgaatagtttccaaattatggcaaattcatgtagagagagaaaagtaactgttttggttttgctcacaaaagtctactttacctaagggctgtcagatataagtaacttaaaagaaagagaagttttcttgacttttgaaaacaaaatatgaaaagaatcggcaatgtttcaaacaaaaagtcataaaagtcactttattcctccatcaaaaaaaaaaaaaaaaaaaaaa

SEQ ID NO: 953 - DNA, 3132 bp, Homo sapiens
aatgttccaagcgcttattggtgaaggctgccgtcgctcgggcggtggcgggctccgggattggcggttgcttggcgggcggtgtcaggctctcggtggcggcggaggcggcggaggccagggaggaagatgtcgtaatgagcgatccacagaccagcatggctgccactgctgctgtgagtcccagtgactacctgcagcctgccgcctccaccacccaggactcccagccatctcccttagccctgcttgctgcaacatgtagcaaaattggccctccagcagttgaagctgctgtgacacctcctgctcccccacagcccacaccgcggaaacttgtccctatcaaacctgcccctctccctctcagccccggcaagaatagctttggaatcttgtcctccaaaggaaatatacttcagattcaggggtcacaactgagcgcctcctatcctggagggcagctggtgttcgctatccagaatcccaccatgatcaacaaagggacccgatcaaatgccaatatccagtaccaggcggtccctcagattcaggcaagcaattcccaaaccatccaagtacagcccaatctcaccaaccagatccagatcatccctggcaccaaccaagccatcatcaccccctcaccgtccagtcacaagcctgtccccatcaagccagcccccatccagaagtcgagtacgaccaccacccccgtgcagagcggggccaatgtggtgaagctgacaggtgggggcggcaatgtgacgctcactctgcccgtcaacaaccttgtgaacgccagtgacaccggggcccctactcagctcctcactgaaagccccccaaccccgctgtctaagactaacaagaaagcaaggaagaagagccttcctgcctcccagccccctgtggctgtggctgagcaggtggagacggtgctgatcgagaccaccgcggacaacatcatccaggcaggaaataacctgctcattgttcagagccctggtgggggccagccagctgtggtccagcaggtccaggtggtgccccccaaggccgagcagcagcaggtggtacagatcccccagcaggctctgcgggtggtgcaggcggcatctgccaccctccccactgtaccccagaagccctcccagaactttcagatccaggcagctgagccgacacctactcaggtctacatccgcacgccttccggtgaggtgcagacagtccttgtccaggacagccccccagcaacagctgcagccacctctaacaccacctgtagcagccctgcatcccgtgctccccatctgagtgggaccagcaaaaagcactcagctgcaattctccgaaaagagcgtcccctgccaaagattgccccagccgggagcatcatcagcctgaatgcagcccagttggcggcagctgcccaggcaatgcagaccatcaacatcaatggtgtccaggtccagggcgtgcctgtcaccatcaccaacacaggcgggcagcagcagctgacagtgcagaatgtttctgggaacaacctgaccatcagtgggctgagccccacccagatccagctgcaaatggaacaagccctggccggagagacccagcccggggagaagcggcgccgcatggcctgcacgtgtcccaactgcaaggatggggagaagaggtctggagagcagggcaagaagaagcacgtgtgccacatccccgactgtggcaagacgttccgtaagacgtccttgctgcgtgcccatgtgcgcctgcacactggcgagcggccctttgtctgcaactggttcttctgtgggaagaggttcacacggagtgacgagctccaacggcatgctcgcacccacacaggggacaaacgcttcgagtgcgcccagtgtcagaagcgcttcatgaggagtgaccacctcaccaagcattacaagacccacctggtcacgaagaacttgtaaggccaactgcggcgggaggccctgaagatgcagtcccccacctgtgtcctccctgggcccctggtggaaaggagccctgtggctgccttgggcctgccctcagccccactcctgttctgcaactgtccccacaggaaggggctctgttccctgtattgtcctccttctgaagccccttggctctgccttggcccttcccctcaccacgagctcccggcctgcccagactgtggacactggccgtgcccaatgagacgttctaaaccaggacgcgtgggaacccttatttccaaaggaaaaacatgcatttcactccgtcgaggagcaaagtgagcccctaccccccaccccgatccccgctcccaacactgccggagtcgcgtcatgccatgccccctctcctgcacctccctggccctgccggccactgtggacgccctggggcttggcacccacctctggagaaactcggggccacctccactccatgtgcccagccccgccacaacctctcctccagcacattccagctctatttaaaaagtaaagacacccaccgactcctgatccccctctttttctatggagaacgttgccttatactctacttcagatgatgaacactgtgtactgtgtgtgctttaaagaagttttatttaattgctcccttcttcctttccttgttattcacctccctgatgcctgctttcagttgagggttgggggcaatgatgagcatatgaattttttctcactctagcaattcccttttctaaatgacacagcatttaaactcaaatctggattcagataacagcacctgcacatcctgcacctcctccctctcccttcacctcacccctgcccggcccaagctctacttgtgtacagtgtatattgtataatagacaattgtgtctactacatgtttaaaaacacattgcttgttatttttgaggcttttaaattaaacaaaaatccaactttatttttagttgtaactgcttgaggtatgttttatgaattaagtgacagatttgttatcctttattaacgtactttgttggtcagcactgggctgacaaaaattttttcttgctaataaatttagttgcctgaggcaaaatcttcaaaaaaaaaaaaaaaaaaaaaa

SEQ ID NO: 954 - DNA, 3548 bp, Homo sapiens
agccggggcccccgccgccgccggagcgacaggtgatttggcttctgcacagttaggaggagcaccaaaccgatgggaggttttgtcagccacacctacaactataaaagatgaagctggtaatctagtccagattccaagtgctgctacttcaagtgggcagtatgttcttccccttcagaatttgcagaatcaacaaatattttccgttgcaccaggatcagattcatcaaatggtgcagtgtccagtgttcaatatcaagtgataccacagatccagtcagcagatggtcagcaggttcaaattggtttcacaggctcttcagataatgggggtataaatcaagaaagcagtcaaattcagatcattcctggctctaatcaaaccttacttgcctctggaacaccttctgctaacatccagaatctcataccacagactggtcaagtccaggttcagggagttgcaattggtggttcatcttttcctggtcaaacccaagtagttgctaatgtgcctcttggtctgccaggaaatattacgtttgtaccaatcaatagtgtcgatctagattctttgggactctcgggcagttctcagacaatgactgcaggcattaatgccgacggacatttgataaacacaggacaagctatggatagttcagacaattcagaaaggactggtgagcgggtttctcctgatattaatgaaactaatactgatacagatttatttgtgccaacatcctcttcatcacagttgcctgttacgatagatagtacaggtatattacaacaaaacacaaatagcttgactacatctagtgggcaggttcattcttcagatcttcagggaaattatatccagtcgcctgtttctgaagagacacaggcacagaatattcaggtttctacagcacagcctgttgtacagcatctacaacttcaagagtctcagcagccaaccagtcaagcccaaattgtgcaaggtattacaccacagacaatccatggtgtgcaagccagtggtcaaaatatatcacaacaggctttgcaaaatcttcagttgcagctgaatcctggaacctttttaattcaggcacagacagtgaccccttctggacaggtaacttggcaaacgtttcaagtacaaggggtccagaacttgcagaatttgcaaatacagaatactgctgcccaacaaataactctgacgcctgttcaaaccctcacacttggtcaagttgcggcaggtggagccttcacttcaactccagttagtctaagcactggtcagttgccaaatctacaaacagttacagtgaactctatagattctgctggtatacagctacatccaggagagaatgctgacagtcctgcagatattaggatcaaggaagaagaacctgatcctgaagagtggcagctcagtggtgattctaccttgaataccaatgacctaacacacttaagagtacaggtggtagatgaagaaggggaccaacaacatcaagaaggaaaaagacttcggagggtagcttgcacctgtcccaactgtaaagaaggtggtggaagaggtaccaatcttgggaaaaagaagcaacacatttgtcatataccaggatgtggtaaagtctatgggaagacctcacatctgagagctcatctgcgttggcattctggagaacgcccttttgtttgtaactggatgtactgtggtaaaagatttactcgaagtgatgaattacagaggcacagaagaacacatacaggtgagaagaaatttgtttgtccagaatgttcaaaacgctttatgagaagtgaccaccttgccaaacatattaaaacacaccagaataaaaaaggtattcactctagcagtacagtgctggcatctgtggaagctgcgcgagatgatactttgattactgcaggaggaacaacgcttatccttgcaaagattcaacaaggttctgtttcagggataggaactgttaatacttccgccaccagcaatcaagatatccttaccaacactgaaatacctttacagcttgtcacagtttctggaaatgagacaatggagtaaatattacacaaatacttattcattgtggttatttttatacagtagtgagaagaatattgttcctaagttcttagatatctttttattgatgtgcaaaaatttttggattgacagtaacttggttatacatgacactgaaatgccttactttgtatgatattccatagtatattaaaaatggtaaaattgcatgggttttgtaggtacttttggaatctagaagaaatgaaattttaccaagttatataaagagaaaattgaatttaacaatgcgaatggtagtctaaccaaatgcatcaatcctgtgtggtttagtgtaaaaatgagaacatgttggtatttatctattgtaagataaaaaagctggtgggtgaaagaaatcatgttatgataaaaaattttgtaattttcttgatgactggaatttttattatgcataactgacaaatcaagtttccaagcaaatgttacatagtgtaggctttacttagcttatcaatttgtcattttgaagctaattattttaattaggttaactatgtacaatattttaagcattactcttgtaagattttgaaaactacattttaacatggaactctagggatagtcaccttttaaatcctgttgaaaagccatgtttaagatttaatttgccaaaataatgtcttgttaatattctttcaataacgaagttgggcaatataaccaatgtttaaaaaagtttaaaatgtataagttgaggcatttgggtggtaagagaatgttatagtgaattatcccttttcttgactattggaggaccaaaaaataaggtgtattgcgtcttagcagtgattttatccaatcttgtttccaaaaaccatggtctcccagggccttaaaagccatcatgtaaattaccagtaaagtgtaacatatgcaaacataacaaaatcacttccatagtgacgatactccaaccatatggatattagtcatagaagaactagaggttttatgatatttttttaagtcttttttttttgtctaggtagtcagtctgcacttaaatatcaatcattttccttttttgcttcttcccttaaaatttatatgtatccagtacatttaattgagaagcgtatgttttttattatgctgtattttctttttattttttaattattgtttatattttcaattcaaaaatgtacaaaataaagttacattgctggtctgtgtaagagctatacagttttcctaaatgtatacctgtaactgcagcagttcacctatttgcaaaaatttggaattctgttcatttgttattcttaagaccacctcaaatttaaaggctaccttattgtacgtttaaagtgtattataacagtgtggtagttaataaaacactatttttttttcttttgaaaaaaaaaaaaaaaaaaaaaaaaaaaaaaaaaaaaaaaaaaaa

SEQ ID NO: 955 - DNA, 5811 bp, Homo sapiens
agctgctacgccacagcccagcggcggccattcgcggaaaaagaggcagagcctgtgccagctacagcctcctccgagccaccgcgggcgggcgggaccggcctctcctcccgcctcgcccccacccccacccacctctatcccagtgtctccgtctgagggtttgtcctgttaatgcgggatgagcgatcagaagaaggaggaggaggaggaggcggcagcggcagcggcgatggctacagaaggagggaaaacctctgagccagagaataacaataaaaaacccaaaacctcaggctcccaggactctcagccctctcctctggctttactggcagctacttgcagcaaaatagggactcctggtgaaaatcaagcaactggacaacaacaaattattatagatccaagtcaaggattggtgcaacttcaaaatcaaccacaacagctagaactggtaacaacgcaacttgctggaaacgcttggcaacttgttgcctccactcctcctgcttcaaaagagaataacgtttctcaaccagcctctagttcgtctagttcttccagcagtaataacgggagtgcatctcctacaaaaactaaatcaggtaattcttccacccctggtcaatttcaagtcatacaagtacaaaatccaagtggtagtgtacagtaccaagtaattccacaacttcagacagtggaaggtcaacaaattcaaatcaatccaactagtagttcatctctacaggatttgcagggtcaaattcagctcatttctgcaggtaataatcaagctatactcacagctgctaacaggacagcttctgggaatattcttgctcaaaacctggcaaatcagacagttccggtccaaattagacctggtgtttcaataccactgcagttacagactcttcctggtactcaggctcaagttgtaacaaccctaccaattaacattggaggagtgactctagctttgccagtgataaacaacgtggctgccggaggagggactgggcaggttggccagcctgctgctactgctgatagtgggacttccaatgggaatcaattagtttccacacccaccaacaccactacttctgccagtactatgccagaatctccctcctcctccactacctgcacaaccactgcttcaacgtctttgacaagcagtgacacattagtgagctcagcagatactggccagtatgcaagcacatcagccagtagttctgaacgcaccattgaagaatctcaaacacctgctgctactgagtctgaagcccagagctccagtcagcttcagcctaatggaatgcagaatgcacaggatcaatcaaattctcttcagcaggtgcaaattgtaggccaacctatcttacagcagatccagatccaacagcctcagcaacagatcattcaggctattccaccacagtcgtttcaactccagtcagggcagacgattcagaccatccagcagcagcctttacagaatgttcaacttcaagcagtaaatccgactcaggtgcttatcagggctccaactttaacaccttcagggcaaatcagttggcaaactgtacaggttcagaatattcagagtctttcaaatttgcaagttcagaatgctgggttatcccaacaattaaccatcaccccagtgtcttcaagtggtggcacaactcttgctcagattgctcctgtggctgttgctggtgccccaataactttgaatactgcccagcttgcatcagtgcctaaccttcagacagtgagcgttgccaacctgggtgctgcaggtgttcaagtgcagggagttcccgttacaatcactagtgttgcaggtcagcagcaaggacaagatggagtaaaagtccagcaagctactatagctcctgtaactgtagcagttggaggaattgctaatgccacgataggtgctgttagtcctgaccaactcacacaagtgcatttgcagcaaggccagcagacttctgatcaagaggtacaacctggcaagaggcttcgaagagttgcctgttcctgtcctaattgtagggaaggagaaggaagaggcagtaatgaaccaggaaaaaagaagcagcatatctgtcatattgaaggatgtggtaaagtttatggcaaaacatctcatttacgagcacatcttcgctggcatactggagaaagaccttttatatgcaactggatgttttgtggcaaaagattcacacggagtgatgagctccagagacatagaagaacccatacaggtgaaaagagatttgaatgcccggaatgttctaaaaggtttatgcggagtgatcatctctccaaacatgtcaaaacgcaccagaataaaaaaggtggtgggacagctcttgccattgttacctcgggagaactggactcatctgttacagaggtgcttggctccccaagaattgtcacagttgcagccatttctcaagattcgaatccagcaactcccaatgtttcaaccaacatggaagaattctgaaaagttatttataacagagacctctagtgctgcacttgtttacacacctttgaaaatctggaaatgggctggtcaagtggattacagagtaggaaattatgttttcattcttggcttctttaagtattccagggtttggggtcaacacgtgaagtgttgaattttaaaaaatacaaaaagcagactgatgtactggaaacagaaaagtatttcctccatactataagttgtagttgtttggaaatatatcacataacctttatacagaatcttcccatctcttaatatcatgtgttaacatgtttaaaaagaccttagtagtttgcaggctggaccttaattggacttattttctttgaaagtactttgttataaattcagtcagtaataatttacgtgtattctttttctctatagcacagaaaacagatagttaactgatgatagggataatactgtatttccttagcttgatttttggaaaatcaaccgaaaatagtttggccgtcttttctaaatgttagaaattcttcaacagttgaattaggtaagttccaaaacagtaatctgagatgcatctcagatctttattaccactacattatagtagtgtgtatgcagacaatcagtgaagtccaattactttctccatttggagacacaagaggaacatagagttaaatcttaggttaaattttaggttgacaccttaggaaaatgctgggaaaaaaatggttaaaacaaaactcatcatagcttcagaaaaataaaatgaggcatcttaacatgcaatgttctaaagttaggattgattatattcctaaccctaggttgaaccacaaaatttcatttaaaatgtttatatttggaaatatttgcatagagtgtaaattgttctgtagtttcatattttgtaaatatgagttatgttgacaatgtgcagaattctttatgctttgatgtggtagccaaagaaagaattacacttttttccaaggccagcagaaaattctcttttaactacattgtaattcttgttttcctctactaaaaattggccagtcccattttatttctagtgctatgtaagaaggtaattaggaattataacacagtaatgtttttatgttacatcaataactgaattttccctaaaaattagcctaatatataatagatatattatgaagcaaaacttttatttttgaaaaggcagaataattttcagtgaagtaagtgactaaagaaaaaaactatattattgtttatgcaagggtcttacaggaaagggtctttttttttttttttttgagatggagtctcgctctcttgcccaggctggagtgcaatggcacgatctcagcttactgcaaccgccgcctcccaggttcaagcgattctcctgtcttagcctcctgagtagctgggattaacaggcgcctgccaccatgcctggctaatttttgtatttttagtagagacagggtttcgccatgttggccaggctggtttcaaactcctgacctcaggtgatctgcccacctcggcctcccagagtgctgggattacaggcatgagccaccatgcccggctaggaaagggtcttactaggaaagatggccaaaagtttcatatgaaaaaaattggattataaaccagtaacttaaatattaataaggatattttatgttttaaaaaagtatttacacagaatcataatcagtgaaattgaccatttgaaaactaaaagtttttacctacctgctcaatttattaacatcattgctttggggactgtttgaatataggtacgtgttttcttgtgcattctctataatttcaggaaaagtactaatgcgaattctcttccaaaattgtgatgtttcttgtatttttgatgaaggagaaatactgtaatgatcactgtttacactatgtacactttaggccagccctttgtagcgttatataaaactgaaggtcttttgtgctttcagtttgtataaaaaagctttgagattaaaggaaaaaaaaaatttttacactgtggttataaatttcaagtttcttaaagcttttgtagacttgtaacagagtctttaaatttaagttggattttgtaaattgttttgtatattttatttaatgtactcttaacaactgatgtatctggctttaaaacatcagaattggtttgttgttttgtttggtacagaggagcatttggtagtgttcattttaattttattatataggagctgaaacatcaaatatatattttatctatcattatgctacacaatcagtgctataaatttttttatgcaaagaaactttcttaatgttttaatcatgtttcctcagagtgacactttttgttgttgttaataccaagtatgaacactctgcatcattattccatgaaccagttctaatgcaaacctatgtatgtccattagaaatggaagttattttttaatcaacaatgaggcctattataaatttatcagatgaatctagatagctttatagcatataaaatatgttaatttgtgttagcaggtgcacatttcaccactgaaattagaaatattttgacagtctgttctgcataccattctgagtctacttttctgtctttagaagaatcgtaaatttcagtgtcctttatttgactcagtgggatatagctgttataagtaatagggcacagatgtgcagtagagtcttgtttaatggcatttcactgttcattccctttaccaccgttataaaacttttctttattgtaattatcagtgcaaagctatgtatttatcatggtaaaactccagtgttagaatagttttttcttacagtatactttctttggttaggtttgtgtatgtgttgctgattacattagaacttgatgttaagtcatttatcacactctcatgagagcagtaataaaagtgtgtaatctaggagaaaaagttaatttgtcaaacttagataagcatgatgtttaggtcctatttttcaattttataactgttttattgcaacaatatttgtatttaagtctccattttaatgccttgtggtgtttttttatgcatgtcactaagttgtcatcccacataaattgatgtgcagcatagggtattaaatctacataatgattttaaaacagaaatagttgatggtaaaatgtaaatgttttgcaaaaattccttataaaaagttttgtagtaacatttcacttgtaaattttttttgtaaaaaaaaaaaaa

SEQ ID NO: 956 - DNA, 2995 bp, Homo sapiens
ttctcccattctccctccctctcccttttctctctctaccccccccaccccccggctcagctctctccatctgcctggctccttgggacccgttccccagcctcaggatggcgtcctccctgcttgaggaggaagttcactatggctccagtcccctggccatgctgacggcagcgtgcagcaaatttggtggctctagccctctgcgggactcaacaactctgggcaaagcaggcacaaagaagccgtactctgtgggcagtgacctttcagcctccaaaaccatgggggatgcttatccagccccctttacaagcactaatgggctcctttcacctgcaggcagtcctccagcacccacctcaggctatgctaatgattaccctcccttttcccactcattccctgggcccacaggcacccaggaccctgggctactagtgcccaaggggcacagctcttctgactgtctgcccagtgtctacacctctctggacatgacacacccctatggctcctggtacaaggcaggcatccatgcaggcatttcaccaggcccaggcaacactcctactccatggtgggatatgcaccctggaggcaactggctaggtggtgggcagggccagggtgatgggctgcaagggacactgcccacaggtccagctcagcctccactgaacccccagctgcccacctacccatctgactttgctccccttaatccagccccctacccagctccccacctcttgcaaccagggccccagcatgtcttgccccaagatgtctataaacccaaggcagtgggaaatagtgggcagctagaagggagtggtggagccaaacccccacggggtgcaagcactgggggtagtggtggatatgggggcagtggggcagggcgctcctcctgcgactgccctaattgccaggagctagagcggctgggagcagcagcggctgggctgcggaagaagcccatccacagctgccacatccctggctgcggcaaggtgtatggcaaggcttcgcacctgaaggcccacttgcgctggcacacaggcgagaggcccttcgtctgcaactggctcttctgcggcaagaggttcactcgttcggatgagctggagcgtcatgtgcgcactcacacccgggagaagaagttcacctgcctgctctgctccaagcgctttacccgaagcgaccacctgagcaaacaccagcgcacccatggagaaccaggcccgggtccccctcccagtggccccaaggagctgggggagggccgcagcacgggggaagaggaggccagtcagacgccccgaccttctgcctcgccagcaaccccagagaaagcccctggaggcagccctgagcagagcaacttgctggagatctgagccgggtggaaggtctcccaccccagggctgccctgacagtctctcttggctctctagaccactgcttgccaatcactctctttaccccatgcatgccatccttcggggctctctccctctgtctccctcctggccattctgggcttgggtatctccttgcatgcctcctcagctcaccttctctcttcaccatgagactggctttccacaaactctcatctcaggccctccccttgtgcctgatacctgcactccggcttcctagactctggccctgccacaccaacacactttctatttgggctcccaacactatttctccatctcactccttgacatgtacccctttctgcttctcaagcttatttcctgctgtccctcagcctccaggcttcagtcttcccaacttcttacaccattgctttccattctccagaactcttttttcctttttacaaacacaatgataatgataatttattgccccctggtggcctcttcatcaggggtattggggttagtgacctggccagagggtgccaagaggggggcagaccagtggggatctgatcccaaagatggggtgaccccagggtcagggaggctgcccccaggcctgtatatttaacccctatgtaccaggagtaatgaatagtaataattctatttatgtaagttatgatgacgggtcaggtagagtgagctggggagggaagtggatccatttctgctaaggaaattctagtcaaatgcatctctgtatagacaaaatgttagtggagaagatcttgttaatagaatgtctatcatcagaatctcagttgatagggtttctcttgtaatgaagtctctacaaattgggttagctacatctctgctaaacagttgatggggtatctcttgattagggggatccctaatatccccagccccagccagaagctgtgaaacctcaagtcctatggaggggagaaggactggaatgtaccccatctcccttgactgcagagcaggttcctccactgccccaccccttagacaccatgaccccatcaggttaatcccctgttgccatggttatggagagcttgcagctgccatcttagatgtgctctttggggaagcccatctaacaggaggacattggtttgggggtgcacctcctgaagaatgggtggggaaggctttctctaggatcagattcaaataagtatgtattgagtgcctactctgtgcaaggcactatgctagatctggtgcctagaagccctgagaaagaacttaaagagctaggaggacagaggcccccaagctgatctggtggtgcatccacgcacccccaccctgggactttggatgctcccatctccacctccagtgacttttaaagccgcttcgtgcctttcctgtaacgttggatcctccttttctgtcccctgctgtctcaaggccccaagttaaagggttaaagccgctggagcttggggagagaacattgtggaatggaagggatcatgccctttgtggagtcttttttttttaatttaataaataaaagttggatttgaaaaaaaaaaaaaaaaaaaaaaaa

SEQ ID NO: 957 - DNA, 1423 bp, Homo sapiens
gactatctcccagcggcaggcccttcgataaaatcaggaacttgtgctggccctgcaatgtcaagggagggggctcacccagggctcctgtagctcagggggcaggcctgagccctgcacccgccccacgaccgtccagcccctgacggggcaccccatcctgaggggctctgcattggcccccaccgaggcaggggatctgaccgactcggagcccggctggatgttacaggcgtgcaaaatggaagggtttcccctcgtcccccctccatcagaagacctggtgccctatgacacggatctataccaacgccaaacgcacgagtattacccctatctcagcagtgatggggagagccatagcgaccattactgggacttccacccccaccacgtgcacagcgagttcgagagcttcgccgagaacaacttcacggagctccagagcgtgcagcccccgcagctgcagcagctctaccgccacatggagctggagcagatgcacgtcctcgatacccccatggtgccaccccatcccagtcttggccaccaggtctcctacctgccccggatgtgcctccagtacccatccctgtccccagcccagcccagctcagatgaggaggagggcgagcggcagagccccccactggaggtgtctgacggcgaggcggatggcctggagcccgggcctgggctcctgcctggggagacaggcagcaagaagaagatccgcctgtaccagttcctgttggacctgctccgcagcggcgacatgaaggacagcatctggtgggtggacaaggacaagggcaccttccagttctcgtccaagcacaaggaggcgctggcgcaccgctggggcatccagaagggcaaccgcaagaagatgacctaccagaagatggcgcgcgcgctgcgcaactacggcaagacgggcgaggtcaagaaggtgaagaagaagctcacctaccagttcagcggcgaagtgctgggccgcgggggcctggccgagcggcgccacccgccccactgagcccgcagcccccgccgggccccgccaggcctccccgctggccatagcattaagccctcgcccggcccggacacagggaggacgctcccggggcccagaggcaggactgtggcgggccgggcctcgcctcacccgccccctccccccactccaggccccctccacatcccgcttcgcctccctccaggactccaccccggctcccggacgccagctgggcgtcagaccccaccggggcaaccttgcagaggacgacccggggtactgccttgggagtctcaagtccgtatgtaaatcagatctcccctctcacccctcccacccattaacctcctcccaaaaaacaagtaaagttattctcaatccatcaaaaaaaaaaaaaaaaaa

SEQ ID NO: 958 - DNA, 1493 bp, Homo sapiens
ggcaaacagcccgcccggcaccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccccgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgaggcagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtccctctgggatttctttgtcatgtacagactccctgggatcctcatgttttgggtgacaggacctatggaccactatactcggggaggcagggtagcagttcttccagaatcccaagagcttctctgggattttcttgtgatatctgattccccagtgaggcctgggacgtttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctccaagaaaaaaaaaaaaaaaaaaaaaa

SEQ ID NO: 959 - DNA, 1116 bp, Homo sapiens
cagaattgtcaatttattaatgaaatatgacgtgtgttgaacaagacaagctgggtcaagcatttgaagatgcttttgaggttctgaggcaacattcaactggagatcttcagtactcgccagattacagaaattacctggctttaatcaaccatcgtcctcatgtcaaaggaaattccagctgctatggagtgttgcctacagaggagcctgtctataattggagaacggtaattaacagtgctgcggacttctattttgaaggaaatattcatcaatctctgcagaacataactgaaaaccagctggtacaacccactcttctccagcaaaaggggggaaaaggcaggaagaagctccgactgtttgaataccttcacgaatccctgtataatccggagatggcatcttgtattcagtgggtagataaaaccaaaggcatctttcagtttgtatcaaaaaacaaagaaaaacttgccgagctttgggggaaaagaaaaggcaacaggaagaccatgacttaccagaaaatggccagggcactcagaaattacggaagaagtggggaaattaccaaaatccggaggaagctgacttaccagttcagtgaggccattctccaaagactctctccatcctatttcctggggaaagagatcttctattcacagtgtgttcaacctgatcaagaatatctcagtttaaataactggaatgcaaattataattatacatatgccaattaccatgagctaaatcaccatgattgctaaatatactttcatatttcatggtttactggcatcggaaatctctacaagttttaatgatttctccctccctctctttttttcctcctctgaagaaatttaggatttttctcttaaagcaaatactaaagaggaaaaaaaattaactttattgttgcttttatcaaagagtatgtaatctatactaacttgttgggaaattctgccaatgaacaacttttttataataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 960 - DNA, 918 bp, Homo sapiens
tcctttggtgccttgtgaccagggccctgatggttcattagatggagccttcgagtcttagggagttgccgcagggtccccacagcggctcccgacggttgtgaaccagcatccatcctccacggattccggcaacccgcctggccctggacgtgtctcaactggcccgcgtgaggggccgccccggaaatgacgcgctgccccgctggccaagcggaagtggagatggcggagctgtacgtgaagccgggcaacaaggaacgcggctggaacgacccgccgcagttctcatacgggctgcagacccaggccggcggacccaggcgctcgctgcttaccaagagggtagccgcaccccaggatggatcccccagagtccccgcatcagagacttctcctgggcctcccccaatggggcctccacctccttcaagtaaggctcccaggtccccacctgtggggagtggtcctgcctctggcgtggagcccacaagtttcccagtcgagtctgaggctgtgatggaggatgtgctgagacctttggaacaggcattggaagactgccgtggccacacaaggaagcaggtatgtgatgacatcagccgacgcctggcactgctgcaggaacagtgggctggaggaaagttgtcaatacctgtaaagaagagaatggctctactggtgcaagagctttcaagccaccggtgggacgcagcagatgacatccaccgctccctcatggttgaccatgtgactgaggtcagtcagtggatggtaggagttaaaagattaattgcagaaaagaggagtctgttttcagaggaggcagccaatgaagagaaatctgcagccacagctgagaagaaccataccataccaggcttccagcaggcttcataatcctcggttccccagact

SEQ ID NO: 961 - DNA, 10491 bp, Homo sapiens
aacttgggcagaggtcaggggtcacgcgaggtcagtccgtcgggagggctagggagatggtcacgaaacctgaagtcaagagttaaggcttgttggcttctggtgtgattcccttcagtacggcggcaccgtggaagtgcagactttcacagggggtgtggtctcagctcacacaggtgctccagaggctggtggacctgagcggaggctgggacgccctggtgggccccgggccctggaaggcgggtcccggtggccggtggcccagaatgaggccagctcccagcatgccctgcagccggacgccagcccctcggccagcagtactggtgataacaacccagtcattcttcaggcatccaagggggagcctgggagtgggaccatgcagagcagcccctcccctgctcaccctcagctcccagtcctacagacacagatggtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggccgagatcgagactcggattgctgagctgcggaaggagggtttctggtcactgaagaggctgcctaaggtgccagagccccctcgccccaaaggtcactgggactatttgtgcgaagagatgcagtggctctctgctgactttgctcaggagcgccgttggaaacggggtgtggcccggaaggtggtgcgcatggtgatccggcaccacgaggagcagcggcagaaagaggaacgggcccggagggaggagcaggccaagctgcgtcgaattgcttccaccatggccaaggatgtcaggcagttctggagcaatgtggagaaggtggtgcaattcaagcaacagtcccggcttgaggaaaagcgcaaaaaagccctggacctgcatttggacttcattgtggggcaaactgaaaagtactcggaccttctgtctcagagcctcaaccagccattaacctccagcaaagcaggctcttccccttgcctcggctcttcctcagctgcctccagtcctccaccccctgcttctcgcctggatgatgaagatggggactttcaaccccaagaggatgaggaagaggatgatgaggaaacgattgaagttgaagaacaacaggaaggcaatgatgcagaggcccagaggcgtgagattgagctgcttcgccgtgagggagaattgccactggaagagctgctccgttcccttccccctcagctgttggaagggccttccagcccctctcaaaccccctcatctcatgatagtgacacccgagatgggcctgaagaaggtgctgaagaagagccccctcaggtgttggagataaagcccccaccctctgctgtcacacagcgcaacaaacagccttggcatccagatgaagatgatgaagagtttactgccaacgaagaggaagcggaggatgaagaggatactatagcagctgaggaacagttggaaggggaggtggatcatgccatggagctgagcgagttggctcgagaaggtgagctttccatggaggagctattgcagcagtatgcaggagcctatgccccaggctctgggagcagtgaagatgaggatgaagatgaggttgatgctaatagctctgactgtgaaccagaggggcccgtggaagcggaagagcctcctcaggaggatagtagcagtcagtcagactctgtggaggaccggagtgaggatgaggaagatgaacattcagaggaggaagaaacaagtggaagttcagcatcagaggaatctgagtctgaagagtctgaggatgcccaatcacagagccaagcagatgaagaggaggaagatgatgattttggggtggagtacttgcttgccagggatgaagagcagagtgaggcagatgcaggcagtgggcctcctactccagggcccactactctaggtccaaagaaagaaattactgacattgctgcagcagctgaaagtctccagcccaagggttacacgctggccacgacccaggtaaagacgcccattcccctgcttctgcggggccagctccgggagtaccagcacattgggctagactggctggttaccatgtatgagaagaagcttaatggcattcttgctgatgagatggggcttgggaagaccatccagaccatctctctgcttgcccacttggcttgtgagaaaggtaactggggtccccatttaatcattgttcccaccagcgtgatgttgaactgggagatggagttgaaacgttggtgccccagctttaaaatcctcacttactatggagcccagaaagagaggaagctcaagcggcagggctggaccaagcccaatgcctttcatgtgtgtatcacatcttacaagctggtgctgcaggaccaccaggccttccgtcgcaagaactggcgctatctcattctggatgaggcgcagaacatcaagaacttcaagtcacagcgctggcagtcactcctcaacttcaacagccagagacgcctgctcctgacaggaactcccttgcagaacagcctcatggagctgtggtccttgatgcactttttgatgccccatgtcttccagtctcatcgcgagttcaaggagtggttctctaatcccctaactggcatgattgagggcagccaagagtataatgaaggtctagtcaaacgcctccacaaggttttgaggccttttttactgcgccgagttaaggtggatgttgagaagcagatgcccaaaaagtacgagcatgttatccgctgcaggctctccaagcgtcaacgctgtctctatgatgacttcatggcacagaccacaactaaggagacactagccacaggccatttcatgagcgtcatcaacattttgatgcagctgagaaaagtttgcaatcatccaaatctgttcgaccctcgaccggttacctcccctttcatcaccccaggcatctgcttcagcaccgcctctctggtgctaagggccacggatgtccatcccctccagcggatagacatgggtcgatttgaccttattggcctggaaggtcgtgtctctcgatatgaggcagacacatttctgccccggcaccgcctctctcgccgggtactgttagaagtggctactgctcctgaccccccaccccggcccaagccagtcaagatgaaggtcaacaggatgctgcagccagtacctaagcaagaaggccggacagtggtggtggtgaacaacccacgggcgcccctgggccctgtcccagttcgacctcctccaggtcctgagctctcagcccagcccacccctggcccagtcccccaagtgctgccagcatcactgatggtttcagcctcacctgccgggcccccgcttattcctgcatctcggcctcctggccctgtcctcttgcctccactgcagcccaacagtggttctctcccccaggtgttgccatcccccctgggggtcctgagtgggacctcacggcctcccacgccaaccttgtccctaaagccaacaccacctgccccagttcgcctgagcccagccccacctccaggctcctctagcctgttgaagcccctgacagtgccaccaggctacaccttccctcctgctgctgccaccaccacttctaccaccacggcaactgctaccaccacagcagtgccagctccgactcctgcaccacagcgcctcattctatctcccgatatgcaggctcgcctgccctcaggcgaagtggtcagcatcgggcagttagcctcactggcacaacgtccagtggctaatgcagggggaagcaaacctctcaccttccaaatccagggcaacaagctgactttgactggtgcccaggtgcgccagcttgctgtggggcagccccgcccgctgcaaaggaatgtggtgcacctcgtgtcagcaggggggcagcaccatctcatcagccagcctgcccatgtggccctcatccaggccgtggccccgacccctggccctacccctgtctctgtgctgccttcttcgacccccagcaccacccctgcccctactggcctcagccttccgcttgctgctaaccaggtgccaccaaccatggtgaataatacaggcgtggtgaagattgtagtgagacaagcccctcgggatggactgactcctgttcctccattggccccagcaccccggcctccgagctctgggcttccagctgtgttgaatccacgccccacgttaacccctggccggctacccacacctactctgggtactgctcgagcccccatgcccacacccactctggtgaggcctcttctcaagctggtccacagtccttcacctgaagtcagtgcttcagcccccggagctgcccccttgaccatctcttctcctctccacgtgccatcctcactccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctccaacccctgtgttggctccatcatcaactcaaactatgctaccagccccggttccgtcacctctcccgagcccggcttctacgcagacactggccctagccccagctttagcacccactcttggaggctcatctccatctcagacactctctttgggaacggggaacccccagggaccctttccaactcagacattgtcattaactccagcatcatccctggtaccaactccagcccagacactgtctttggcaccaggaccaccactgggtccaactcagacgctgtctctggctccagcaccccctctggctccagcttctccagtgggcccagccccagctcacacgctgactttggctccagcatcgtcatctgcttcactcctggccccagcttcagtgcagacactgaccttgagccctgccccagttcctaccctgggcccggccgcagctcagaccttggcgctggccccagcctccacacagtccccagcttcccaggcatcttcccttgtggtttcggcatctggtgccgctcccttgcctgtcaccatggtatcccggctgcctgtttccaaggatgagcctgacacactgacattgcgctctggtccccccagccctccctccactgctacctcgtttggtggcccccggcctcgacgccagccccccccaccacctcgttcccctttttatctggactccctggaggaaaagcggaagcggcagcggtctgaacgcctggaacggattttccaacttagtgaggctcatggggccctggcacctgtgtatgggactgaagtcctggatttctgtaccctgccccaacctgttgccagccccatcggccctcgttctcctggccccagccaccccaccttttggacttataccgaggctgcccaccgggctgtactgtttccccagcagcgactagaccagctgtcagaaatcattgagaggttcatctttgtcatgcctcctgtggaggcacctcccccttccctgcatgcctgccacccacctccttggctggccccacgtcaggcagccttccaggagcaattggcctctgagctctggccccgggctcgtcctttgcaccgtattgtgtgtaacatgcgcacccagttccctgacttaagactcatccagtatgattgcggaaagttgcagacgttggcagtgctgttgcggcagctcaaggcagagggccaccgagtgctcatcttcacccagatgacccgaatgctggatgtattggagcagtttctcacctaccatggccatctctacctgcgcctggatggatctactagagttgaacagagacaggccttgatggaacggttcaatgcagacaaacgcatattctgcttcatcctttcaactcggagtgggggtgtgggcgtgaacctgacaggagcagacactgttgttttttatgacagcgactggaatcccaccatggatgctcaggcccaggaccgctgtcaccgaattggccagacccgggatgtccacatatataggcttatcagtgaacggacagtggaggagaacatcctaaaaaaggcaaatcagaagagaatgttgggggacatggccattgagggaggcaacttcaccacagcctatttcaaacagcagaccatccgagagctgtttgatatgcccctggaggaaccttctagctcatccgtgccctctgcccctgaagaggaggaagagactgtggccagcaagcagactcatattctggagcaggcattgtgtcgggcagaagatgaagaggatatccgtgcagccacccaggccaaggctgaacaggtggctgagcttgcagaatttaatgagaacgatgggtttcctgctggtgagggagaggaagctggccggcctggggctgaggatgaggagatgtcccgggctgagcaggaaattgctgccctcgtagaacagctgacccccattgagcgctatgccatgaaattcctggaggcctcactggaggaggtgagccgagaggagctcaaacaggcagaagagcaagtggaagctgcccgcaaagacctggaccaagccaaggaggaggtgttccgcctaccccaagaggaggaggaggggccgggggctggggatgagagttcctgtgggactggtggaggcacccaccggcgcagtaaaaaggccaaagcccctgagaggccggggactcgtgtcagtgagcgtcttcgtggagcccgggctgagactcaaggggcaaaccacactcctgtcatatccgcccatcaaactcgcagcaccaccacaccaccccgctgcagtcctgccagggagcgagttcccaggccagcacctaggcctcgacccactccagcttcagctccggctgcaattcctgcccttgttcctgtcccagtttctgccccagtacccatttcagccccaaatccaataaccattctccctgtccatatcttgccttctcctccccctccttcacagattcctccttgttcttctcctgcctgcacccctcctcctgcctgtacccctccaccagctcatacaccgcctccagcccaaacctgtcttgtaactccttcctctcctctcttgcttggtccaccttctgtgcccatctctgcctcagtcactaatctccccttgggcttgaggcctgaggcagagctgtgtgcccaggcattggcatctccagagtccctggagctggcttctgtggccagttcagaaacctcctcactttctcttgtgccccctaaagatctgttgccagttgctgtggagatcctgcctgtgtcagagaagaacctttctctcaccccttctgcacccagcctgaccttggaggctggcagcatccccaatggtcaagagcaggaggcaccagattctgctgaggggaccacccttacagtgctgcctgaaggtgaggagttgcccctgtgtgtgagtgagagcaatggcctggagctcccaccctcagcagcatctgatgagccacttcaggagccactggaggctgacaggacctcggaagagctgacagaggccaagaccccaacctccagcccagagaagccacaggaactcgttacagctgaggttgcagctccatccacctcatcttcagccacttcctcgcctgagggtccttcacctgcccgacctcctcggcgtcgcaccagtgctgatgtggaaattaggggtcaagggactggtcggccaggacaaccaccaggccccaaagtgcttcgaaagctgccaggacggctggtaactgtggtagaggaaaaggaactggtgcggcggcggcggcagcagcggggagctgccagcaccctagtgcctggggtctctgagactagtgccagcccgggaagcccgtctgtccgcagcatgtcagggccagaatcctcccctcccattggtgggccctgtgaagctgctccttcatcctcactgcccactccaccccagcagcccttcattgctcgccgtcacattgagctgggggtgactggtggtggcagccccgagaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgactctgttaaccactacttgaagtcttgagggggaaagcctccagggagacataggggccttctcccttcttcccaccaaagtagggggtaggcaactggttgtcatggaaatggggatcatcacagtccccttccccttcaccccacgtggctgggcagtgttaagggtggcaagatagtctctgtccccacccccttgtacttgattccccagctgtctttcacacagccccccacccttaggggaagggggaggggcttctctacaatgaggtttttttcttttttttttttttttaagaagaaaaaataataaacttagtttctgtatgagcaaaaaaaaaaaaaaaaaa

SEQ ID NO: 962 - DNA, 4922 bp, Homo sapiens
agcagagctgcggccgggggaacccagtttccgaggaacttttcgccggcgccgggccgcctctgaggccagggcaggacacgaacgcgcggagcggcggcggcgactgagagccggggccgcggcggcgctccctaggaagggccgtacgaggcggcgggcccggcgggcctcccggaggaggcggctgcgccatggacgagccacccttcagcgaggcggctttggagcaggcgctgggcgagccgtgcgatctggacgcggcgctgctgaccgacatcgaagacatgcttcagcttatcaacaaccaagacagtgacttccctggcctatttgacccaccctatgctgggagtggggcagggggcacagaccctgccagccccgataccagctccccaggcagcttgtctccacctcctgccacattgagctcctctcttgaagccttcctgagcgggccgcaggcagcgccctcacccctgtcccctccccagcctgcacccactccattgaagatgtacccgtccatgcccgctttctcccctgggcctggtatcaaggaagagtcagtgccactgagcatcctgcagacccccaccccacagcccctgccaggggccctcctgccacagagcttcccagccccagccccaccgcagttcagctccacccctgtgttaggctaccccagccctccgggaggcttctctacaggaagccctcccgggaacacccagcagccgctgcctggcctgccactggcttccccgccaggggtcccgcccgtctccttgcacacccaggtccagagtgtggtcccccagcagctactgacagtcacagctgcccccacggcagcccctgtaacgaccactgtgacctcgcagatccagcaggtcccggtcctgctgcagccccacttcatcaaggcagactcgctgcttctgacagccatgaagacagacggagccactgtgaaggcggcaggtctcagtcccctggtctctggcaccactgtgcagacagggcctttgccgaccctggtgagtggcggaaccatcttggcaacagtcccactggtcgtagatgcggagaagctgcctatcaaccggctcgcagctggcagcaaggccccggcctctgcccagagccgtggagagaagcgcacagcccacaacgccattgagaagcgctaccgctcctccatcaatgacaaaatcattgagctcaaggatctggtggtgggcactgaggcaaagctgaataaatctgctgtcttgcgcaaggccatcgactacattcgctttctgcaacacagcaaccagaaactcaagcaggagaacctaagtctgcgcactgctgtccacaaaagcaaatctctgaaggatctggtgtcggcctgtggcagtggagggaacacagacgtgctcatggagggcgtgaagactgaggtggaggacacactgaccccacccccctcggatgctggctcacctttccagagcagccccttgtcccttggcagcaggggcagtggcagcggtggcagtggcagtgactcggagcctgacagcccagtctttgaggacagcaaggcaaagccagagcagcggccgtctctgcacagccggggcatgctggaccgctcccgcctggccctgtgcacgctcgtcttcctctgcctgtcctgcaaccccttggcctccttgctgggggcccgggggcttcccagcccctcagataccaccagcgtctaccatagccctgggcgcaacgtgctgggcaccgagagcagagatggccctggctgggcccagtggctgctgcccccagtggtctggctgctcaatgggctgttggtgctcgtctccttggtgcttctctttgtctacggtgagccagtcacacggccccactcaggccccgccgtgtacttctggaggcatcgcaagcaggctgacctggacctggcccggggagactttgcccaggctgcccagcagctgtggctggccctgcgggcactgggccggcccctgcccacctcccacctggacctggcttgtagcctcctctggaacctcatccgtcacctgctgcagcgtctctgggtgggccgctggctggcaggccgggcagggggcctgcagcaggactgtgctctgcgagtggatgctagcgccagcgcccgagacgcagccctggtctaccataagctgcaccagctgcacaccatggggaagcacacaggcgggcacctcactgccaccaacctggcgctgagtgccctgaacctggcagagtgtgcaggggatgccgtgtctgtggcgacgctggccgagatctatgtggcggctgcattgagagtgaagaccagtctcccacgggccttgcattttctgacacgcttcttcctgagcagtgcccgccaggcctgcctggcacagagtggctcagtgcctcctgccatgcagtggctctgccaccccgtgggccaccgtttcttcgtggatggggactggtccgtgctcagtaccccatgggagagcctgtacagcttggccgggaacccagtggaccccctggcccaggtgactcagctattccgggaacatctcttagagcgagcactgaactgtgtgacccagcccaaccccagccctgggtcagctgatggggacaaggaattctcggatgccctcgggtacctgcagctgctgaacagctgttctgatgctgcgggggctcctgcctacagcttctccatcagttccagcatggccaccaccaccggcgtagacccggtggccaagtggtgggcctctctgacagctgtggtgatccactggctgcggcgggatgaggaggcggctgagcggctgtgcccgctggtggagcacctgccccgggtgctgcaggagtctgagagacccctgcccagggcagctctgcactccttcaaggctgcccgggccctgctgggctgtgccaaggcagagtctggtccagccagcctgaccatctgtgagaaggccagtgggtacctgcaggacagcctggctaccacaccagccagcagctccattgacaaggccgtgcagctgttcctgtgtgacctgcttcttgtggtgcgcaccagcctgtggcggcagcagcagcccccggccccggccccagcagcccagggcaccagcagcaggccccaggcttccgcccttgagctgcgtggcttccaacgggacctgagcagcctgaggcggctggcacagagcttccggcccgccatgcggagggtgttcctacatgaggccacggcccggctgatggcgggggccagccccacacggacacaccagctcctcgaccgcagtctgaggcggcgggcaggccccggtggcaaaggaggcgcggtggcggagctggagccgcggcccacgcggcgggagcacgcggaggccttgctgctggcctcctgctacctgccccccggcttcctgtcggcgcccgggcagcgcgtgggcatgctggctgaggcggcgcgcacactcgagaagcttggcgatcgccggctgctgcacgactgtcagcagatgctcatgcgcctgggcggtgggaccactgtcacttccagctagaccccgtgtccccggcctcagcacccctgtctctagccactttggtcccgtgcagcttctgtcctgcgtcgaagctttgaaggccgaaggcagtgcaagagactctggcctccacagttcgacctgcggctgctgtgtgccttcgcggtggaaggcccgaggggcgcgatcttgaccctaagaccggcggccatgatggtgctgacctctggtggccgatcggggcactgcaggggccgagccattttggggggcccccctccttgctctgcaggcaccttagtggcttttttcctcctgtgtacagggaagagaggggtacatttccctgtgctgacggaagccaacttggctttcccggactgcaagcagggctctgccccagaggcctctctctccgtcgtgggagagagacgtgtacatagtgtaggtcagcgtgcttagcctcctgacctgaggctcctgtgctactttgccttttgcaaactttattttcatagattgagaagttttgtacagagaattaaaaatgaaattatttataatctgggttttgtgtcttcagctgatggatgtgctgactagtgagagtgcttgggccctcccccagcacctagggaaaggcttcccctccccctccggccacaaggtacacaacttttaacttagctcttcccgatgtttgtttgttagtgggaggagtggggagggctggctgtatggcctccagcctacctgttccccctgctcccagggcacatggttgggctgtgtcaacccttagggcctccatggggtcagttgtcccttctcacctcccagctctgtccccatcaggtccctgggtggcacgggaggatggactgacttccaggacctgttgtgtgacaggagctacagcttgggtctccctgcaagaagtctggcacgtctcacctcccccatcccggcccctggtcatctcacagcaaagaagcctcctccctcccgacctgccgccacactggagagggggcacaggggcgggggaggtttcctgttctgtgaaaggccgactccctgactccattcatgcccccccccccagcccctcccttcattcccattccccaacctaaagcctggcccggctcccagctgaatctggtcggaatccacgggctgcagattttccaaaacaatcgttgtatctttattgacttttttttttttttttttctgaatgcaatgactgttttttactcttaaggaaaataaacatcttttagaaacaaaaaaaaaaaa

SEQ ID NO: 963 - DNA, 4325 bp, Homo sapiens
gccctttctgtgcggcgcccgggcgcaacgcaaacatggcggcgggtggcacccgtcggtgaggcggtgccgggcgggggttgtcgggtgtcatgggcggtggcgacggcaccgcccccgcgtctccctgagcgggacggcagggggggcttctgcgctgagccgggcgatggacgacagcggcgagctgggtggtctggagaccatggagaccctcacggagctgggcgacgagctgaccctgggagacatcgacgagatgctgcaatttgtcagtaatcaagtgggagagttccctgacttgttttcagaacagctgtgtagctcctttcctggcagtggtggtagtggtagcagcagcggcagcagtggcagcagcagcagcagcagcaatggcaggggcagcagcagcggagctgtggacccttcagtgcaacggtcattcacccaggtcacattaccttccttctctccctcggcggcctccccacaggctccaactctgcaagtcaaggtttctcccacctcagttcccaccacacccagggcaactcctattcttcagccccgcccccagccccagcctcaacctcaaactcagctgcaacaacagacggtaatgatcacgccaacattcagcaccactccgcagacgaggatcatccagcagcctttgatataccagaatgcagctactagctttcaagtccttcagcctcaagtccaaagcctggtgacatcctcccaggtacagccggtcaccattcagcagcaggtgcagacagtacaggcccagcgggtgctgacacaaacggccaatggcacgctgcagacccttgccccggctacggtgcagacagttgctgcgccacaggtgcagcaggtcccggtcctggtccagcctcagatcatcaagacagattcccttgttttgaccacactgaagacagatggcagccctgttatggctgcggtccagaacccggccctcaccgccctcaccacccctatccagacggctgcccttcaagtaccaaccctggtgggcagcagtgggaccattctgaccacaatgcctgtaatgatggggcaagagaaagtgcccattaagcaggtacctgggggagtcaagcagcttgagccccccaaagaaggagaaaggcggacaacccataatatcattgagaaacgatatcgctcctccatcaatgacaaaatcatcgaattgaaagacctggtcatggggacagacgccaagatgcacaagtctggcgttctgaggaaggccattgattacatcaaatacttgcagcaggtcaatcataaactgcgccaggagaacatggtgctgaagctggcaaatcaaaagaacaagcttctaaagggcatcgacctaggcagtctggtggacaatgaggtggacctgaagatcgaggactttaatcagaatgtccttctgatgtcccccccagcctctgactcagggtcccaggctggcttctctccctactccattgactctgagccaggaagccctctattggatgatgcaaaggtcaaagatgagccagactctcctcctgtggcgctgggcatggtagaccgctcacggattcttctgtgtgtcctcaccttcctgtgcctctcctttaaccccctgacttccctgctgcagtggggaggggcccacgactctgaccagcacccacactcaggctctggccgcagtgtcctgtcattcgagtcaggttctgggggctggtttgactggatgatgcctactcttctcttatggctggtaaatggtgtgattgtcctgagcgtctttgtgaagctgctggttcatggggagccagtgatccggccacactcgcgctcctcggtcaccttctggaggcaccggaaacaggcagatctggatctcgccagaggagattttgcagctgctgccggcaacctacaaacctgcctggcagttttgggccgggcactgcccacctcccgcctggacctggcctgcagcctctcctggaacgtgatccgctacagcctgcagaagctacgcctggtgcgctggctgctcaagaaagtcttccagtgccggcgggccacgccagccactgaggcaggctttgaagacgaagctaagaccagcgcccgggatgcggctctggcctatcaccggctgcaccagctgcacatcacagggaagcttcctgcaggatccgcctgttccgatgtacacatggcgttgtgtgccgtgaacctggctgaatgtgcagaggagaagatcccaccgagcacactggttgagatccatctgactgctgccatggggctcaagacccggtgtggaggcaagctgggcttcctggccagctacttcctcagccgagcccagagcctgtgtggccccgagcacagtgctgttcctgactccctgcgctggctctgccaccccctgggccagaagtttttcatggagcggagctggtctgtgaagtcagctgccaaggagagtctatactgtgcccagaggaacccagctgaccccattgcgcaggtccaccaggccttctgcaagaacctgctggagcgagctatagagtccttggtgaaacctcaggccaagaagaaggctggagaccaggaagaagagagctgtgaattctccagtgctctggagtacttgaaattacttcattcttttgtggactctgtgggggttatgagccccccactctccaggagctccgtgctcaagtccgccctgggtccagacatcatctgtcggtggtggacgtctgcaatcactgtggccatcagctggctccagggagacgatgcagctgtgcgctctcattttaccaaagtggaacgcatccccaaggccctggaagtgacagagagccccctggtgaaggccatcttccatgcctgcagagccatgcatgcctcactccctgggaaagcagatgggcagcagagttccttctgccattgcgagagggccagtggccacctatggagcagcctcaacgtcagtggggccacctctgaccctgccctcaaccacgtggtccagctgctcacctgtgacctgctactgtcgctacggacagcgctctggcaaaaacaggccagtgccagccaggctgtgggggagacctaccacgcgtcaggcgctgaactggcgggcttccaacgggacctgggcagcctgcgcaggctggcacacagcttccgcccagcataccgcaaggtgttcctgcatgaagccaccgtgcgcctgatggcaggagccagccccacccgcacccaccagctgctggaacacagcctgcggcggcgcaccacgcagagcaccaagcacggagaggtggatgcctggcccggccagcgagagcgggccaccgccatcctgctggcctgccgccacctgcccctctccttcctctcctccccgggccagcgggcagtgctgctggccgaagctgcccgcaccctggagaaggtgggcgaccggcgctcctgcaacgactgccagcagatgattgttaagctgggtggtggcactgccattgccgcctcctgaccaccaggctcagcccacccctccacctctctctcgatttctctctctccccctcagcatcttcccgctgagagtggtggggaagagccttgtcttcttagctgtcacctgccgaggcttctgggccactcaggccagtgcacccctgggcagagccccttaaagctgctgtcactagatgcccatggtccagggcctggtgggcgtgagaggataggtggcagggcagaaactgggcagccctgacttgatagcagcagggggagctcccaagctgccaagcccctgcctccagccttcctgagtttctctctcctgaaccctactctctcctttttgcttcctcagtttttatcaggctttctctgggggacagcagtctctgagcaccagggagcagttgccctcaggcctgtgcccagcatgccctcccctttttatacgaatgttttctaccagtgtgcttgggtttgccatgatgcgaggctgagttgctgtagcgtcttgattctctccctgggtctgcgttccctcccctgggcctgactgagcctgctcattgtttttccctttattacacaggacagccaggggaggaggggggcccagccctgggaggctggtgggaggcagggggcaggcctgcggatgcatgaaataatgttggcattattttttaattttttaaaaaataaatggtatcttatttaaaaaaaaaaaaaaaaaaaaa

SEQ ID NO: 964 - DNA, 4343 bp, Homo sapiens
aatggggagcggaggtgccggaaccacggaccaatggggcgggggcgctggggctcaccatataaggagcggcctcgccataaaaggaaacattgtatctctttatatggggggaagggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacagaaaaaaaaaaaaaaaaaaaaaaaaaa

SEQ ID NO: 965 - DNA, 897 bp, Homo sapiens
gttgagggggtgttgagggcggagaaatgcaagtttcattacaaaagttaacgtaacaaagaatctggtagaagtgagttttggatagtaaaataagtttcgaactctggcacctttcaattttgtcgcactctccttgtttttgacaatgcaatcatatgcttctgctatgttaagcgtattcaacagcgatgattacagtccagctgtgcaagagaatattcccgctctccggagaagctcttccttcctttgcactgaaagctgtaactctaagtatcagtgtgaaacgggagaaaacagtaaaggcaacgtccaggatagagtgaagcgacccatgaacgcattcatcgtgtggtctcgcgatcagaggcgcaagatggctctagagaatcccagaatgcgaaactcagagatcagcaagcagctgggataccagtggaaaatgcttactgaagccgaaaaatggccattcttccaggaggcacagaaattacaggccatgcacagagagaaatacccgaattataagtatcgacctcgtcggaaggcgaagatgctgccgaagaattgcagtttgcttcccgcagatcccgcttcggtactctgcagcgaagtgcaactggacaacaggttgtacagggatgactgtacgaaagccacacactcaagaatggagcaccagctaggccacttaccgcccatcaacgcagccagctcaccgcagcaacgggaccgctacagccactggacaaagctgtaggacaatcgggtaacattggctacaaagacctacctagatgctcctttttacgataacttacagccctcactttcttatgtttagtttcaatattgttttcttttctctggctaataaaggccttattcatttca

SEQ ID NO: 966 - DNA, 1946 bp, Homo sapiens
gcttctgagcggaaactgaaagtgaaatagggagctggctaccagcgttgagtcccctgtaaagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggggcagcgtctgtcctgtgtgccggcagcgctttctgctcaagaatctccggcccaatcgacagctagccaacatggtgaacaaccttaaagaaatcagccaggaggccagagagggcacacagggggaacggtgtgcagtgcatggagagagacttcacctgttctgtgagaaagatgggaaggccctttgctgggtatgtgcccagtctcggaaacaccgtgaccacgccatggtccctcttgaggaggctgcacaggagtaccaggagaagctccaggtggcattaggggaactgagaagaaagcaggagttggctgagaagttggaagtggaaattgcaataaagagagcagactggaagaaaacagtggaaacacagaaatctaggattcacgcagagtttgtgcagcaaaaaaacttcctggttgaagaagaacagaggcagctgcaggagctggagaaggatgagagggagcagctgagaatcctgggggagaaagaggccaagctggcccagcagagccaggccctacaggagctcatctcagagctagatcgaaggtgccacagctcagcactggaactgctgcaggaggtgataattgtcctggaaaggagtgagtcctggaacctgaaggacctggatattacctctccagaactcaggagtgtgtgccatgtgccagggctgaagaagatgctgaggacatgtgcagtccacatcactctggatccagacacagccaatccgtggctgatactttcagaagatcggagacaagtgaggcttggagacacccagcagagcatacctggaaatgaagagagatttgatagttatcctatggtcctgggtgcccagcactttcactctggaaaacattactgggaggtagatgtgacaggaaaggaggcctgggacctgggtgtctgcagagactctgtgcgcaggaaggggcactttttgcttagttccaagagtggcttctggacaatttggttgtggaacaaacaaaaatatgaggctggcacctacccccagactcccctccaccttcaggtgcctccatgccaagttgggattttcctggactatgaggctggcatggtctccttctacaacatcactgaccatggctccctcatctactccttctctgaatgtgcctttacaggacctctgcggcccttcttcagtcctggtttcaatgatggaggaaaaaacacagcccctctaaccctctgtccactgaatattggatcacaaggatccactgactattgatggctttctctggacactgccactctccccattggcaccgcttctcagccacaaaccctgcctcttttccccatgaactctgaaccacctttgtctctgcagaggcatccggatcccagcaagcgagctttagcagggaagtcacttcaccatcaacattcctgccccagatggctttgtgattccctccagtgaagcagcctccttatatttggcccaaactcatcttgatcaaccaaaaacatgtttctgccttctttatgggacttaagttttttttttctcctctccatctctaggatgtcgtctttggtgagatctctattatatcttgtatggtttgcaaaagggcttcctaaaaataaaaaataaaatttaaaaaactgtgaaaaaaaaaaaaaaaaa

SEQ ID NO: 967 - DNA, 2825 bp, Homo sapiens
gtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaaccaaaaaaa

SEQ ID NO: 968 - DNA, 1271 bp, Homo sapiens
cactttgtcaccaactgctgccaactcgccaccactgctgccgacctcgcaaccactgctttgtctctgaagtgagactgctcctggtgccatgaacggagacgacacctttgcaaagagacccagggatgatgctaaagcatcagagaagagaagcaaggcctttgatgatattgccacatacttctctaagaaagagtggaaaaagatgaaatactcggagaaaatcagctatgtgtatatgaagagaaactataaggccatgactaaactaggtttcaaagtcaccctcccacctttcatgtgtaataaacaggccacagacttccaggggaatgattttgataatgaccataaccgcaggattcaggttgaacatcctcagatgactttcggcaggctccacagaatcatcccgaagatcatgcccaagaagccagcagaggacgaaaatgattcgaagggagtgtcagaagcatctggcccacaaaacgatgggaaacaactgcaccccccaggaaaagcaaatatttctgagaagattaataagagatctggacccaaaagggggaaacatgcctggacccacagactgcgtgagagaaagcagctggtgatttatgaagagatcagtgaccctgaggaagatgacgagtaactcccctgggggatacgacacatgcccttgatgagaagcagaacgtggtgacctttcacgaacatgggcatggctgcggctccctcgtcatcaggtgcatagcaagtgaaagcaagtgttcacaacggtgaaacttgagcgtcatttttcttagtgtgccaagagttcgatgttagtgtttccattgtattttcttacagtgtgccattctgttagatactatccttataattgatgagcaagacatactgaatgcatatttcggtttgtgtatccatgcacctacgtcagaaaacaagtattgtcaggtattctctccatagaacagcactatcctcatctctccccagatgtgactactgagggcagttctgagtgtttaatttcagactttttcctctgcatttacacacacacacacacacacacgcacacacacacaccaagtaccagtataagcatctcccatctgcttttcccattgccatgcgtcctggtcaagcccccctcactctgtttcctgttcagcatgtactcccctcatccgattcccctgtatcagtcactgacagttaataaacctttgcaaacgttcaaaaaaaaaaaaaaaaaa

SEQ ID NO: 969 - DNA, 1466 bp, Homo sapiens
gcatgctctgactttctctctctttcgattcttccatactcagagtacgcacggtctgattttctctttggattcttccaaaatcagagtcagactgctcccggtgccatgaacggagacgacgcctttgcaaggagacccacggttggtgctcaaataccagagaagatccaaaaggccttcgatgatattgccaaatacttctctaaggaagagtgggaaaagatgaaagcctcggagaaaatcttctatgtgtatatgaagagaaagtatgaggctatgactaaactaggtttcaaggccaccctcccacctttcatgtgtaataaacgggccgaagacttccaggggaatgatttggataatgaccctaaccgtgggaatcaggttgaacgtcctcagatgactttcggcaggctccagggaatctccccgaagatcatgcccaagaagccagcagaggaaggaaatgattcggaggaagtgccagaagcatctggcccacaaaatgatgggaaagagctgtgccccccgggaaaaccaactacctctgagaagattcacgagagatctggaaatagggaggcccaagaaaaggaagagagacgcggaacagctcatcggtggagcagtcagaacacacacaacattggtcgattcagtttgtcaacttctatgggtgcagttcatggtacccccaaaacaattacacacaacagggacccaaaaggggggaacatgcctggacccacagactgcgtgagagaaaacagctggtgatttatgaagagatcagcgaccctgaggaagatgacgagtaactcccctcagggatacgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttagcgtttacgttgtattttcttacactgtgtcattctgttagatactaacattttcattgatgagcaagacatacttaatgcatattttggtttgtgtatccatgcacctaccttagaaaacaagtattgtcggttacctctgcatggaacagcattaccctcctctctccccagatgtgactactgagggcagttctgagtgtttaatttcagattttttcctctgcatttacacacacacgcacacaaaccacaccacacacacacacacacacacacacacacacacacacacacaccaagtaccagtataagcatctgccatctgcttttcccattgccatgcgtcctggtcaagctcccctcactctgtttcctggtcagcatgtactcccctcatccgattcccctgtagcagtcactgacagttaataaacctttgcaaacgttcaaaaaaaaaaaaaaaaaa

SEQ ID NO: 970 - DNA, 1290 bp, Homo sapiens
ctctctctttcgattcttccatactcaagagtacgcacggtctgattttctctttggattcttccaaaatcagagtcagactactccctgtgccatgaacggagatgacacctttgcaaggagacccacggttggtgctcaaataccagagaagatacaaaaggccttcgatgatattgccaaatacttctctaaggaagagtgggaaaagatgaaagtctcggagaaaatcgtctatgtgtatatgaagagaaagtatgaggccatgactaaactaggtttcaaggccatcctcccatctttcatgcgtaataaacgggtcacagacttccaggggaatgattttgataatgaccctaaccgtgggaatcaggttcaacgtcctcagatgactttcggcaggctccagggaatcttcccgaagatcatgcccaagaagccagcagaggaaggaaatgtttcgaaggaagtgccagaagcatctggcccacaaaacgatgggaaacagctgtgccccccgggaaaaccaactacctctgagaagattaacatgatatctggacccaaaaggggggaacatgcctggacccacagactgcgtgagagaaagcagctggtgatttatgaagagatcagcgatcctgaggaagatgatgagtaactccccttggggatatgacacatgcccatgatgagaagcagaacgtggtgacctttcacgaacatgggcatggctgtggacccctcgtcatcaggtgcatagcaagtgaaagcaagtgttcacaacagtgaaaagttgagcgtcatttttcttagtgtgccaagagtacgatattagcgtttccattgtattttcttgaagtgtgtcattctgttagatattaacattttcactgatgagcaagacatacttaatgcatattttggtttgtgtatccatgcacctaccttagaaaacaagtattgtcagttacctctgcatggaacagcattaccctcctctctccctagatgtgactactgagggcagttctgagtgtttaatttcagattttttcctctgcatttacacacacacacaaaccacaccacacacacacacacacacacacagacacacaccaagtaccagtataagcatctcccatctgcttttcccattgccatgcgtcctggtcaggcttccctcactctgtttcctggtcagcatgtactcccctcatccgattcccctgtagcagtcactgacagtaaataaacctttgcaaacgttaaaaaaaaaaaaaaaaa

SEQ ID NO: 971 - DNA, 1250 bp, Homo sapiens
acacgccgatttgcccttttgattcttccacaatcagggtgagactgctcccagtgccatgaacggagacgacgcctttgcaaggagacccagggatgatgctcaaatatcagagaagttacgaaaggccttcgatgatattgccaaatacttctctaagaaagagtgggaaaagatgaaatcctcggagaaaatcgtctatgtgtatatgaagctaaactatgaggtcatgactaaactaggtttcaaggtcaccctcccacctttcatgcgtagtaaacgggctgcagacttccacgggaatgattttggtaacgatcgaaaccacaggaatcaggttgaacgtcctcagatgactttcggcagcctccagagaatcttcccgaagatcatgcccaagaagccagcagaggaagaaaatggtttgaaggaagtgccagaggcatctggcccacaaaatgatgggaaacagctgtgccccccgggaaatccaagtaccttggagaagattaacaagacatctggacccaaaagggggaaacatgcctggacccacagactgcgtgagagaaagcagctggtggtttatgaagagatcagcgaccctgaggaagatgacgagtaactcccctcggggatatgacacatgcccatgatgagaagcagaacgtggtgacctttcacgaacatgggcatggctgcggacccctcgtcatcaggtgcatagcaagtgaaagcaagtgttcacaacagtgaaaagttgagcgtcatttttcttagtgtgccaagagttcgatgttggcgtttccgctgtattttcttgcagtgtgccattctgttagacattagcgttttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccattgccatgcgacctggtcaagcccccctcactctgtttcctgttcagcatgtactcccctcatccgattccgttgtatcagtcactgacagttaataaacctttgcaaacgttcaaaaaaaaaaaaaaaaaaaaaaaaaaaaaaaaa

SEQ ID NO: 972 - DNA, 1399 bp, Homo sapiens
cgctctgattgtttcgattcttccaaaatcagagacagagtgctcccggtgccatgaacggagacgatgcctttgtacggagacctagggttggttctcaaataccagagaagatgcaaaagcatccctggagacaagtctgtgaccgtggaatacatttggtgaatctcagtccgttctggaaggtgggaagagagccagccagcagcattaaagctctactgtgtggcaggggagaagctagggccttcgatgatattgccaaatacttctctgagaaagagtgggaaaagatgaaagcctcggagaaaatcatctatgtgtatatgaagagaaagtatgaggccatgactaaactaggtttcaaggccaccctcccacctttcatgcgtaataaacgggtcgcagacttccaggggaatgattttgataatgaccctaaccgtgggaatcaggttgaacatcctcagatgactttcggcaggctccagggaatcttcccgaagatcacgcccgagaagccagcagaggaaggaaatgattcgaagggagtgccagaagcatctggcccacagaacaatgggaaacagctgcgcccctcaggaaaactaaatacctctgagaaggttaacaagacatctggacccaaaagggggaaacatgcctggacccacagagtgcgtgagagaaagcaactggtgatttatgaagagatcagcgaccctcaggaagatgacgagtaactcccctcggggatatgacacatgcccatgatgagaagcagaacgtggtgacctttcacgaacatgggcatggctgcggatccctcgtcatcaggtgtatagcaagtgaaagcaagtgttcacaacagtgaaaagttgagcgtcatttttcttagtgtgccaagagttcgatgttagtgtttctgttgtattttgttacagtgtgccattctgttagatattagcgttttcactgatgagcaagacatacttaatgcatatttcagtttgtgtatccatgcacctacctcagaaaacaagtatcgtcaggtattctctgcatagaacaacactaccctcctctcttcccagatgtgaccactgagggcagttctgagtgtttaatttcagattttttcctctgcatttacacaaacacacacacatgccacacagacacacatgcgcgcgcgcgcgcacacacacacacacacacacacacacacacacacacaccaagtaccagtataggcatctcccaactgcttttccccatgtgtcctggtcaagcccccctcactctgtttcctgttcagcatgtactcccctcatccgattcccctctatcagtcactgccagttaataaacctttgcaaacgttaaaaaaaaaaaaaaa

SEQ ID NO: 973 - DNA, 1281 bp, Homo sapiens
tctgattttggaagaatctaaagagaatatcagagcatgcatactctgaacttggagtagccaatcccaggggacgctttaggcgggaaaatcagagtctccgtcagagtgctcctggtgccatgaacggagacgacgcctttgcaaagagacccagggatgatgctaaagcatcagagaagagaagcaaggccttcgatgatattgccaaatacttctctaaggaagagtgggaaaagatgaaattctcggagaaaatcagctgtgtgcatatgaagagaaagtatgaggccatgactaaactaggtttcaacgtcaccctctcacttttcatgcgtaataaacgggccacagactctcagaggaatgattctgataatgaccgtaaccgtgggaatgaggttgaacgtcctcagatgacttttggcaggctccagagaatcatcccgaagatcatgcccgagaagccagcagaggaaggaagtgattcgaagggagtgccagaagcatctggcccacagaacgatgggaaaaagctgtgcccgccgggaaaagcaagtagctctgagaagattcacgagagatctggacccaaaagggggaaacatgcctggacccacagactgcgtgagagaaagcagctggtgatttatgaagagatcagcgaccctgaggaagatgacaagtaactcccctcagggatacgacacatgcccatgatgagaagcagaacgtggtgacctttcacgaacgtgggcatggctgcggacccctcgtcatcaggtgtatagcaagtgaaagcaagtgttcacaacagtgaaaagttgagcgtcatttttcttagtgtgccaagagttcgatgttggcgtttccgttgtattttcttgcagtgtgccattctgttagacattagcattttcgttgatgagcaagacatgcttaatgcatatttcggcttgtgtatccatgcacctacctcagaaaacaagtattgtcaggtattctctccatagaacagcactaccctcctctctccccagatgtgactactgaggggaggtctgagtgtttaatttccgattttttcctctgcatttacacacacaccacacacgcacacacacacaccaagtaccagtataagcatctcccatctgcttttctccactgccatgtgtcctggtcaagcccccctcactctgtttcctgttcagcatgtactcccctcatccgattcccctctatcagtcactgacagttaataaacctttgcaaacgttc

SEQ ID NO: 974 - DNA, 1340 bp, Homo sapiens
ccaggctccagggacagaaccttctcaaagtgggggtggagactctgattttcccgcctaaagcatcccctgggattggctactttaagttcagagtatgcatgctctgactttctctctcgattcttccatactcagagtcagactgctcctggtgccatgaacggagacgacgcctttgcaaggagacctagggctggtgctcaaataccagagaagatccaaaagtccttcgatgatattgccaaatacttctctaagaaagagtgggaaaagatgaaatccttggagaaaatcagctatgtgtatatgaagagaaagtatgaggccatgactaaactaggcttcaaggccaccctcccacctttcatgcataatacaggggccacagacctccaggggaatgattttgataatgaccgtaaccaagggaatcaggttgaacgtcctcagatgactttttgcaggctccagagaatcttcccgaagatcatgcccaagaagccagcagaggaaggaaatgattcgaagggagtgccagaagcatctggctcacagaacgatgggaaacacctgtgccctccaggaaaaccaagtacctctgagaagattaacaagacatccggacccaaaagggggaaacatgcctggacccacagactgcgtgagagaaagcagctggtgatttatgaagagatcagcgaccctgaagaagacgacgagtaactcccctcggggatacgacatatgcccatgatgagaagcagaacgtggtgacctttcacgaacatgggcatggctgcggacccctcgtcatcaggtgcatagcaagtgaaagcaagtgttcacaacagtgaaaagttgagcgtcgtttttcttagtgtgacaagagttcgatgttagtgtttccattgtattttcttacagtgtgccattctgttagatattagcgttttcattgatgagcaagacatgcttaatgtgtatttcggtttgtgtatccatgcacctacctcagaaagcaagtatagtcaggtattctctccatagaacagcactaccctcctctctccccagatgtgactactgagggcagatctgagtgtttaatttccgattttcccctctgcatttacacaccagacacacaaacacacacacacagacacacacacacacagacacaccaagtaccagtataagcatctcccatatgcttttccccattgccatgagtcctggtcaagccccccttcaatttgtttcctgttcagcatgtactcccctcctctgattccccgtatcagtcactgacagttaatacacctttgcaaacgttc

SEQ ID NO: 975 - DNA, 1253 bp, Homo sapiens
cactttgtcaccaactgctgccaactcgccaccactgctgccgacctcgccaccactgctttgtctctgagtgagagtgctcctggtgccatgaacggagacgacgcctttgcaaagagacccagggatgatgataaagcatcagagaagagaagcaaggccttcaatgatattgccacatacttctctaagaaagagtgggaaaagatgaaatactcggagaaaatcagctatgtgtatatgaagagaaactatgaggccatgactaaactaggtttcaatgtcaccctcccacctttcatgtgtaataaacaggccacagacttccaggggaattattttgataatgaccgtaaccgcaggattcaggttgaacgtcctcagatgacttttggcaggctccagagaatcatcccgaagatcatgcccaagaagccagcagaggaaggaaatgattcgaagggagtgtcagaagcatctggcccacagaacgatgggaaacagctgcgccgccccgggaaaagcaaatacttctgagaagattaataagagatctggacccaaaagggggagacatgcctggacccacagactgcgtgagagaaaccagctggtgatttatgaagagatcagagaccctgaggaagatgatgagtaactcccctgggggatatgacacatgcccatgatgagaagcagaacatggtgacctttcacgaacatgggcatggctgcggaccctcgtcatcaggtgcatagcaagtgaaagcaagtgttcacaacagtgaaaagttgagcgtcatttttcttagtgtgccaagagttcgatgttagtgtttccattgtattttcttacactgtgccattctgttagatactatccttttcaatgatgagcaagacatacttaatgcatatttcggtttgtgtatccatgcacctacgtcagaaaacaagtattgtcatgtattctctgcatagaacagcactatcctcatctctccccagatgtgactactgagggcagtcctgagtgtttaatttcagacttcttcctctgcatttacacaccacacaacacacacacacacacacacacaccaagtaccattataagcatctcccatctgcttttcccattgccgtgcatcctggtcaagcccccctcactctgtttcctgttcagcatgtactcccctcatccgattcccctctatcagtcactgacagttaacaaacctttgcaaacattc

SEQ ID NO: 976 - DNA, 1254 bp, Homo sapiens
ctttcgattcttccatactcagagtacgcacggtctgattttctctttcgattcttccaaaatcagagacagactgctcccggtgccatgaacggagacgatgcctttgcaaggagacctagggctggttctcaaataccagagaagatccaaaaggccttcgatgatattgccaaatacttctctaagaaagagtgggaaaagatgaaatcctcggagaaaatcatctatgtgtatatgaagagaaagtatgaggccatgactaaactaggtttcaaggctaccctcccacctttcatgtgtaatacaggggccacagacctccaggggaatgattttgataatgaccgtaaccacaggaatcaggttgaacgttctcagatgactttcggcaggctccagggaatcttcccgaagatcatgcccaagaagccagcagaggtaggaaatgattcgaaggaagtgccagaagcatctggcttacagaacgatgggaaacagctgtgccccccgggaaaaccaactacctctgagaagattaacaaggcatctggacccaaaagggggaaacatgcctggacccacagactgcgtgagagaaagcagctggtgatttatgaagagatcagcgaccctgaagaagacgacgagtaactcccctcggggatacgacacatgcccatgatgagaagcagaatgtggtgacctttcacgaacgtgggcatggctgcggacccctcgtcatcaggtgcatagcaagtgaaagcaagtgttcacaacagtgaaaagttgagcttcattttttagtgtgccaagagttcgatgttagtgtttccgttgtattttcttatagtgtgcaattctgttagatattaatgttttcattgatgagcaagacatgcttaatgtgtatttcggtttgtgtatccatgcacctacctcagaaaacaagtatagtcaggtattctctccatagaacagcactaccttcctctctccccacatgtgactactgagggcagttctgagtgtttaatttccgattttctcctctgcatttacacacacacacacacacacacacagagacacacacacacaccaagtaccagtataagcatctcccatctgcttttccccattgccatgcgtcctggtcaagcccccctcactctgtttcctgttcagcatgtactcccctcctctgattccccgtatcagtcactgacagttaatacacctttgcaaacgttc

SEQ ID NO: 977 - DNA, 6330 bp, Homo sapiens
cgcttgttcgctcactctcagtgaaaagagttttgaaatgagttctgaatagacagcattttctttgtgcggttggtaaataacacagagcaaagttagcaagttgcagcgcctctgcgttctgattctatggaacctttttgtagggagaagggcaggatgtttttaactgaatgtgacctcaggggaatactagagaaaataataaaatttctgaatggggcagcgtggagaaatcctaagagaaatagcataagagcattttggaacacatccaggaaaagataactttcgacacacctgtagacgttcgccaggtaaaggagtgatggaaactctccagttcagatccagtagcttttagggaaggaactacagttgctgacttaagttgaagaagcatctatttaatgtctggtcaaatcctacaagaaacacagaaatctatgattaaaaagctgagcactttgatatactgcaaagggtagagaaggcaggacggtagaaattttctgcaagaaagaatgaatttcaggatttatcactaaataagacaaagtcatttatttagtccccctgacacagcagggcaaactgagttgacatacaagttacctggagaaaaagagagcaattccaggacttcctcttcagcctaaaagaaggtaccagatctgtgcactggggcgatgtggaagagacctgcttattgcccctgatgtaagctccagtaagaaaagacgtcaagtacaagtactaggaaatcactttatacatctgtttataggaatgacctcaggactttgtgttcatgttatagatggatgcagaggctgaagataaaacgctgcgtactcgctctaaaggaaccgaggtgccaatggattcactaatccaggagctcagtgttgcctatgattgctccatggcaaagaagagaacagctgaagatcaggctttgggggttccagtcaacaaaaggaaatccctgctaatgaagccccgacactacagcccaaaagcagactgccaagaagaccgcagtgacaggacagaggacgatggccccttggaaacacatggtcactctaccgcagaggaaatcatgataaaacctatggatgaaagtcttctttcaactgcacaagaaaactccagtaggaaggaagacagatactcttgttatcaagagctcatggtcaagtctttaatgcacttggggaaatttgaaaaaaatgtatctgttcagactgtaagtgaaaatttaaatgacagtggcatccagtctttaaaagcagagagcgatgaagcagacgagtgctttctgattcattctgatgatggaagagacaagattgatgattctcagccacccttctgctcctctgatgacaatgaaagtaactctgaaagtgcagaaaatggctgggacagtggctccaacttctcagaagaaaccaaaccacctagagtcccaaagtatgttttaacagatcataaaaaagacctattggaagttcctgaaataaaaactgaaggtgacaaatttatcccttgtgagaacaggtgtgattctgaaacagaaaggaaagacccgcagaatgctctcgcagaacccctggatggcaatgcccagccctcattccctgacgttgaggaggaagatagcgagagcctggcagtaatgacggaagagggtagtgacctggaaaaggccaaggggaatttaagtttgctggagcaggcaattgctctgcaggctgagcgaggttgtgttttccataacacctacaaagagctggataggttcctgctggagcacctagcaggggaaaggaggcaaaccaaagttatcgacatgggtggaagacaaatctttaacaataaacattcaccaaggcctgaaaagagggagaccaagtgcccgatccctggatgtgatggcacgggacacgtgacagggctctacccgcaccaccgcagcctttcggggtgcccccacaaagtgcgggttcccctggaaattcttgccatgcatgaaaatgtgctcaagtgtcccacgccgggatgcacaggaaggggtcatgtgaacagcaaccgcaacacccacaggagtctttctggttgtccaattgctgcagctgaaaaattggcaatgtcccaggataaaaatcagcttgattctccccaaactgggcagtgtcctgaccaggcccacaggacaagtttggtgaagcaaattgaattcaatttcccgtcacaagccatcacctctcccagagccacagtgtcaaaagaacaagagaagtttggaaaagtaccatttgattatgccagttttgatgcccaagttttcggtaaacgccctctcatacaaacagtgcaaggacgaaaaacaccaccatttcctgaatcaaagcattttccaaatccagtgaaatttcctaatcgactgcctagtgcaggcgcccacacccagagccctggccgtgccagctcttatagctacggtcaatgtagtgaagacacccacatagcagcagctgctgccatcctgaacctttccacccgctgcagggaagccacagacatcctctccaacaagccacagagtctgcatgccaagggagccgaaatagaagtggatgaaaatggcacattggacttaagcatgaaaaaaaatcgaatcctggacaagtctgcacccctaacttcctctaacacttctattccaactccttcctcttccccattcaaaacaagcagcattctggtcaatgcagcattctatcaggctctttgtgaccaagagggctgggacactcctatcaactatagcaaaactcacgggaagacagaggaggagaaagagaaagacccagtgagctctctagaaaatttagaggaaaaaaagtttcctggagaggcctctataccaagccctaaacccaagcttcatgcaagagatctcaaaaaggaactaatcacctgtccaacaccaggatgtgatggaagtggccacgtgacaggaaactatgcatctcatcgcagtgtttctggatgtcctttagcagataagactctaaaatccctcatggctgccaactctcaggagcttaagtgtccaaccccaggctgcgatggctcggggcacgtgactggaaactatgcttcccacagaagcttgtccggatgccctcgtgcaaggaaaggtggtgtcaaaatgacccctaccaaggaagaaaaagaagaccctgaactgaaatgtcctgtgatagggtgtgatggccaaggtcacatatcaggtaaatacacatcacaccgcacagcttctggctgtcctctggctgccaagagacagaaggagaatcctctcaatggagcctccctctcctggaaactgaacaaacaagagctaccacattgtcccttgccaggctgcaatgggctgggccatgtaaataatgtttttgtcacccaccgaagcttatctggatgtcctctcaatgcacaagttatcaaaaagggcaaggtttctgaagaactcatgaccatcaagctcaaagcaactgggggaatagagagtgatgaagaaattaggcatttggatgaagaaataaaggaactgaatgaatccaaccttaaaattgaagcagatatgatgaaacttcagacccagatcacatctatggagagcaacttaaagacgatagaggaggagaacaaactcatagaacagaacaatgaaagtctgctgaaagagctggcaggtctaagccaagctctcatttcaagccttgctgacatccagcttccacagatgggacctatcagtgagcagaattttgaagcatatgtaaatacactcacagatatgtacagcaatctggaacgggactattccccggaatgcaaagctctactggaaagtatcaaacaggcagtgaagggtatccatgtgtaggatcacagcgctgccgggcaacagaagttaccaacagcagtaaactccagatggatctgttagaggttcatgtactgctaaggcgtggaggttgccgtactgcatttacaatttgcaacattgcactaattttattttccccagctgatataaaaaggaaagaaaaactatgatagacttcttggattaaaagcaatgcagtcaattattagatcttatttattttcatatgtttttcttttatttcttcattgtactctttttttttttgtaaagtatatgtaaaataaatgtgacatttttataatttatttattactaatcaaagagttttttatcttttaactgcattttgaagtctgccgtatttttacaagtgtgtttattaatttattttccaataggatttaaatagaaatgctattctcaagtcatctttcttgctgggttttaatgaggaaacaggaaagggtgaaggaaatccttgtctaaggactgcactatagttgagtttgatttttattgcacacttcttcccccacctttcactgatttttgtatttataaatgaatttgcggtaaggtgagctgcacggaaggaataagaagacaaatggcgcccactagtggggaatccgcactcacaaaagcacaggatgctggaaaacagcctgctcagaatttgttagcaataattaaatatagcaatcagcaaagtattcgacttggctggacggttttcgttaatatgaattatttatttgaaatgttttaaagaaacataagcctttttagtgatgcagatttgtctgtttgtttttcaagtcatatcagatcgttggcaactcgtatcccaagatgaaaaataagacttggtgtgaccagccaggctttcctgccatatgttggtacaatatacaagtgacaatattggtgtagatttgtacttagcaaatacaaacacatccaaatgaaaaattttgtagataccatatcccctgaaatagcatttatcttactgggttgactggaaaggaatggaaaatatagtaacacatgaaaaaatgctactccaatctgaatgattacttcaaacactggcaccttgggtctcacccaccataggaaacaagacaacattcaatttgatagaaatcttgccacaaaacttcaaatgctacaaaatatacacacacactcacacacacaggcatactcacacacagacacacacacacacacacacacagactcatccacacttcaaattgagcccacaatcttgaatttctgaacggatcagagtttcatagtttctatagtaaaggcaatgtctatttcagggattgtaaagtagttaagcattgtttcaaaagtttttttatatttattttttttaaggaaaaggtatagacaaccagctaaactgcctttttggtgtgcacacacatttcatgtgcagacgtgcctctgtgtaaatgtacacatgaacttcatgtgggcttaattttctgtgctataaacaaaagtgtttattttttattaacctcatggatatttagatggaaagtgatggcattcacaggcttgatgtattccactgttattactgttacctgcacaaatgaaaaacaatactcaacagtaattccactcccatgaaactttggtcattgttatgcattaagtggggcttatctttggtttggagttcatttgaactcttgaaccttagtttagtgaagatgaactgtctgttcttaggtagaaacggtgtttatttaaaaatcagttttaaaaaatgagctaccatatgtgctgtctattataaatgggacaccaaacaaaattttctattacagttgtgtacttgcaaacattttgctatacagtacttcatagatgcatacaaatgagctcacttattacaaagacaaacgtttaatttgctaaatattttaacaagtttgttatatattttatttaatttaaaagaaatctcttaccaacctacatatttattactataatttgctatgacttcaggttaatttatttgtgtttgcatagtttgagcaggatgttttgtgaagtatgtttgtatttatttgcctactttgtacttgatgtgttttgtaatgtgcactgaatttgttttcttttcaactatgttaatgatcaatactgtaaattgggtcttttgtaaacaaaaaggcaatgatgtatgcattttttttaatttgaggtagtttgtttgtatactgtttctccaaacacttaatatttcttacatcaaagcaacaaaattgtgttcagtgctgtacatttggtgtatggtaggaaataaaaattgataacgagttttg

SEQ ID NO: 978 - DNA, 4326 bp, Homo sapiens
gctgagcgcggagccgcccggtgattggtgggggcggaagggggccgggcgccagcgctgccttttctcctgccgggtagtttcgctttcctgcgcagagtctgcggaggggctcggctgcaccggggggatcgcgcctggcagaccccagaccgagcagaggcgacccagcgcgctcgggagaggctgcaccgccgcgcccccgcctagcccttccggatcctgcgcgcagaaaagtttcatttgctgtatgccatcctcgagagctgtctaggttaacgttcgcactctgtgtatataacctcgacagtcttggcacctaacgtgctgtgcgtagctgctcctttggttgaatccccaggcccttgttggggcacaaggtggcaggatgtctcagtggtacgaacttcagcagcttgactcaaaattcctggagcaggttcaccagctttatgatgacagttttcccatggaaatcagacagtacctggcacagtggttagaaaagcaagactgggagcacgctgccaatgatgtttcatttgccaccatccgttttcatgacctcctgtcacagctggatgatcaatatagtcgcttttctttggagaataacttcttgctacagcataacataaggaaaagcaagcgtaatcttcaggataattttcaggaagacccaatccagatgtctatgatcatttacagctgtctgaaggaagaaaggaaaattctggaaaacgcccagagatttaatcaggctcagtcggggaatattcagagcacagtgatgttagacaaacagaaagagcttgacagtaaagtcagaaatgtgaaggacaaggttatgtgtatagagcatgaaatcaagagcctggaagatttacaagatgaatatgacttcaaatgcaaaaccttgcagaacagagaacacgagaccaatggtgtggcaaagagtgatcagaaacaagaacagctgttactcaagaagatgtatttaatgcttgacaataagagaaaggaagtagttcacaaaataatagagttgctgaatgtcactgaacttacccagaatgccctgattaatgatgaactagtggagtggaagcggagacagcagagcgcctgtattggggggccgcccaatgcttgcttggatcagctgcagaactggttcactatagttgcggagagtctgcagcaagttcggcagcagcttaaaaagttggaggaattggaacagaaatacacctacgaacatgaccctatcacaaaaaacaaacaagtgttatgggaccgcaccttcagtcttttccagcagctcattcagagctcgtttgtggtggaaagacagccctgcatgccaacgcaccctcagaggccgctggtcttgaagacaggggtccagttcactgtgaagttgagactgttggtgaaattgcaagagctgaattataatttgaaagtcaaagtcttatttgataaagatgtgaatgagagaaatacagtaaaaggatttaggaagttcaacattttgggcacgcacacaaaagtgatgaacatggaggagtccaccaatggcagtctggcggctgaatttcggcacctgcaattgaaagaacagaaaaatgctggcaccagaacgaatgagggtcctctcatcgttactgaagagcttcactcccttagttttgaaacccaattgtgccagcctggtttggtaattgacctcgagacgacctctctgcccgttgtggtgatctccaacgtcagccagctcccgagcggttgggcctccatcctttggtacaacatgctggtggcggaacccaggaatctgtccttcttcctgactccaccatgtgcacgatgggctcagctttcagaagtgctgagttggcagttttcttctgtcaccaaaagaggtctcaatgtggaccagctgaacatgttgggagagaagcttcttggtcctaacgccagccccgatggtctcattccgtggacgaggttttgtaaggaaaatataaatgataaaaattttcccttctggctttggattgaaagcatcctagaactcattaaaaaacacctgctccctctctggaatgatgggtgcatcatgggcttcatcagcaaggagcgagagcgtgccctgttgaaggaccagcagccggggaccttcctgctgcggttcagtgagagctcccgggaaggggccatcacattcacatgggtggagcggtcccagaacggaggcgaacctgacttccatgcggttgaaccctacacgaagaaagaactttctgctgttactttccctgacatcattcgcaattacaaagtcatggctgctgagaatattcctgagaatcccctgaagtatctgtatccaaatattgacaaagaccatgcctttggaaagtattactccaggccaaaggaagcaccagagccaatggaacttgatggccctaaaggaactggatatatcaagactgagttgatttctgtgtctgaagttcacccttctagacttcagaccacagacaacctgctccccatgtctcctgaggagtttgacgaggtgtctcggatagtgggctctgtagaattcgacagtatgatgaacacagtatagagcatgaatttttttcatcttctctggcgacagttttccttctcatctgtgattccctcctgctactctgttccttcacatcctgtgtttctagggaaatgaaagaaaggccagcaaattcgctgcaacctgttgatagcaagtgaatttttctctaactcagaaacatcagttactctgaagggcatcatgcatcttactgaaggtaaaattgaaaggcattctctgaagagtgggtttcacaagtgaaaaacatccagatacacccaaagtatcaggacgagaatgagggtcctttgggaaaggagaagttaagcaacatctagcaaatgttatgcataaagtcagtgcccaactgttataggttgttggataaatcagtggttatttagggaactgcttgacgtaggaacggtaaatttctgtgggagaattcttacatgttttctttgctttaagtgtaactggcagttttccattggtttacctgtgaaatagttcaaagccaagtttatatacaattatatcagtcctctttcaaaggtagccatcatggatctggtagggggaaaatgtgtattttattacatctttcacattggctatttaaagacaaagacaaattctgtttcttgagaagagaatattagctttactgtttgttatggcttaatgacactagctaatatcaatagaaggatgtacatttccaaattcacaagttgtgtttgatatccaaagctgaatacattctgctttcatcttggtcacatacaattatttttacagttctcccaagggagttaggctattcacaaccactcattcaaaagttgaaattaaccatagatgtagataaactcagaaatttaattcatgtttcttaaatgggctactttgtcctttttgttattagggtggtatttagtctattagccacaaaattgggaaaggagtagaaaaagcagtaactgacaacttgaataatacaccagagataatatgagaatcagatcatttcaaaactcatttcctatgtaactgcattgagaactgcatatgtttcgctgatatatgtgtttttcacatttgcgaatggttccattctctctcctgtactttttccagacacttttttgagtggatgatgtttcgtgaagtatactgtatttttacctttttccttccttatcactgacacaaaaagtagattaagagatgggtttgacaaggttcttcccttttacatactgctgtctatgtggctgtatcttgtttttccactactgctaccacaactatattatcatgcaaatgctgtattcttctttggtggagataaagatttcttgagttttgttttaaaattaaagctaaagtatctgtattgcattaaatataatatgcacacagtgctttccgtggcactgcatacaatctgaggcctcctctctcagtttttatatagatggcgagaacctaagtttcagttgattttacaattgaaatgactaaaaaacaaagaagacaacattaaaacaatattgtttctaattgctgaggtttagctgtcagttctttttgccctttgggaattcggcatggtttcattttactgcactagccaagagactttacttttaagaagtattaaaattctaaaattcaaaaaaaaaaaaaaaaaa

SEQ ID NO: 979 - DNA, 4576 bp, Homo sapiens
tggcagccagtgtcggggtggcggctgggaatgggggccgctccggacttccgctgccaactacaagggggcgggtccgaggggggttagccgaagttgtaggcggggcgcgaggttctagtacccgagctcatactagggacgggaagtcgcgaccagagccattggagggcgcggggactgcaaccctaatcagagcccaaatggcgcagtgggaaatgctgcagaatcttgacagcccctttcaggatcagctgcaccagctttactcgcacagcctcctgcctgtggacattcgacagtacttggctgtctggattgaagaccagaactggcaggaagctgcacttgggagtgatgattccaaggctaccatgctattcttccacttcttggatcagctgaactatgagtgtggccgttgcagccaggacccagagtccttgttgctgcagcacaatttgcggaaattctgccgggacattcagcccttttcccaggatcctacccagttggctgagatgatctttaacctccttctggaagaaaaaagaattttgatccaggctcagagggcccaattggaacaaggagagccagttctcgaaacacctgtggagagccagcaacatgagattgaatcccggatcctggatttaagggctatgatggagaagctggtaaaatccatcagccaactgaaagaccagcaggatgtcttctgcttccgatataagatccaggccaaagggaagacaccctctctggacccccatcagaccaaagagcagaagattctgcaggaaactctcaatgaactggacaaaaggagaaaggaggtgctggatgcctccaaagcactgctaggccgattaactaccctaatcgagctactgctgccaaagttggaggagtggaaggcccagcagcaaaaagcctgcatcagagctcccattgaccacgggttggaacagctggagacatggttcacagctggagcaaagctgttgtttcacctgaggcagctgctgaaggagctgaagggactgagttgcctggttagctatcaggatgaccctctgaccaaaggggtggacctacgcaacgcccaggtcacagagttgctacagcgtctgctccacagagcctttgtggtagaaacccagccctgcatgccccaaactccccatcgacccctcatcctcaagactggcagcaagttcaccgtccgaacaaggctgctggtgagactccaggaaggcaatgagtcactgactgtggaagtctccattgacaggaatcctcctcaattacaaggcttccggaagttcaacattctgacttcaaaccagaaaactttgacccccgagaaggggcagagtcagggtttgatttgggactttggttacctgactctggtggagcaacgttcaggtggttcaggaaagggcagcaataaggggccactaggtgtgacagaggaactgcacatcatcagcttcacggtcaaatatacctaccagggtctgaagcaggagctgaaaacggacaccctccctgtggtgattatttccaacatgaaccagctctcaattgcctgggcttcagttctctggttcaatttgctcagcccaaaccttcagaaccagcagttcttctccaacccccccaaggccccctggagcttgctgggccctgctctcagttggcagttctcctcctatgttggccgaggcctcaactcagaccagctgagcatgctgagaaacaagctgttcgggcagaactgtaggactgaggatccattattgtcctgggctgacttcactaagcgagagagccctcctggcaagttaccattctggacatggctggacaaaattctggagttggtacatgaccacctgaaggatctctggaatgatggacgcatcatgggctttgtgagtcggagccaggagcgccggctgctgaagaagaccatgtctggcacctttctactgcgcttcagtgaatcgtcagaagggggcattacctgctcctgggtggagcaccaggatgatgacaaggtgctcatctactctgtgcaaccgtacacgaaggaggtgctgcagtcactcccgctgactgaaatcatccgccattaccagttgctcactgaggagaatatacctgaaaacccactgcgcttcctctatccccgaatcccccgggatgaagcttttgggtgctactaccaggagaaagttaatctccaggaacggaggaaatacctgaaacacaggctcattgtggtctctaatagacaggtggatgaactgcaacaaccgctggagcttaagccagagccagagctggagtcattagagctggaactagggctggtgccagagccagagctcagcctggacttagagccactgctgaaggcagggctggatctggggccagagctagagtctgtgctggagtccactctggagcctgtgatagagcccacactatgcatggtatcacaaacagtgccagagccagaccaaggacctgtatcacagccagtgccagagccagatttgccctgtgatctgagacatttgaacactgagccaatggaaatcttcagaaactgtgtaaagattgaagaaatcatgccgaatggtgacccactgttggctggccagaacaccgtggatgaggtttacgtctcccgccccagccacttctacactgatggacccttgatgccttctgacttctaggaaccacatttcctctgttcttttcatatctcttgcccttcctactcctcatagcatgatattgttctccaaggatgggaatcaggcatgtgtcccttccaagctgtgttaactgttcaaactcaggcctgtgtgactccattggggtgagaggtgaaagcataacatgggtacagaggggacaacaatgaatcagaacagatgctgagccataggtctaaataggatcctggaggctgcctgctgtgctgggaggtataggggtcctgggggcaggccagggcagttgacaggtacttggagggctcagggcagtggcttctttccagtatggaaggatttcaacattttaatagttggttaggctaaactggtgcatactggcattggcccttggtggggagcacagacacaggataggactccatttctttcttccattccttcatgtctaggataacttgctttcttctttcctttactcctggctcaagccctgaatttcttcttttcctgcaggggttgagagctttctgccttagcctaccatgtgaaactctaccctgaagaaagggatggataggaagtagacctctttttcttaccagtctcctcccctactctgcccctaagctggctgtacctgttcctcccccataaaatgatcctgccaatctaatgtgagtgtgaagctttgcacactagtttatgctacctagtctccactttctcaatgcttaggagacagatcactcctggaggctggggatggtaggattgctggggatttttttttttttaaacagggtctcactctgttgcccaggctagagtgcaatggtgcaatcacagctcactgcagcctcaacctcctgggttcaagcaatcctcctacctcagcctcctgggtagctagcaccatggcatgcgccaccatgccctattttttttttttaaagacagggtcttgctatattgcccaggctggtcttgaactgggctcaagtgatcctcacgccttggcctcccaaagtgctgggattataggcatgagccactgtgcttggccaggatttttttttttttttttttgagatggagtttctctcttgttgtccaggctggagtgcaatggtgtgatctcggctcactgcaacctccgccttccgggttcaagtgactctcctgcctcagcctccccagtagctgggattacagatctgcaccaccatgcccagctaattttgtatttttagtagagacggggtttctccatgttggtcaggctggtctcgaactcctgacctcaagtgatctgtccacctcggcctcccagagtgctgggattacaggcgtgagccactgttcccagcaggaatttcttttttatagtattggataaagtttggtgtttttacagaggagaagcaatgggtcttagctctttctctattatgttatcatcctcccttttttgtacaatatgttgtttacctgaaaggaaggtttctattcgttggttgtggacctggacaaagtccaagtctgtggaacttaaaaccttgaaggtctgtcataggactctggacaatctcacaccttagctattcccagggaaccccagggggcaactgacattgctccaagatgttctcctgatgtagcttgagatataaaggaaaggccctgcacaggtggctgtttcttgtctgttatgtcagaggaacagtcctgttcagaaaggggctcttctgagcagaaatggctaataaactttgtgctgatctggaaaaaaaaaaaaaaaaaaaaaaaaaaaa

SEQ ID NO: 980 - DNA, 4953 bp, Homo sapiens
ggtttccggagctgcggcggcgcagactgggagggggagccgggggttccgacgtcgcagccgagggaacaagccccaaccggatcctggacaggcaccccggcttggcgctgtctctccccctcggctcggagaggcccttcggcctgagggagcctcgccgcccgtccccggcacacgcgcagccccggcctctcggcctctgccggagaaacaggatggcccaatggaatcagctacagcagcttgacacacggtacctggagcagctccatcagctctacagtgacagcttcccaatggagctgcggcagtttctggccccttggattgagagtcaagattgggcatatgcggccagcaaagaatcacatgccactttggtgtttcataatctcctgggagagattgaccagcagtatagccgcttcctgcaagagtcgaatgttctctatcagcacaatctacgaagaatcaagcagtttcttcagagcaggtatcttgagaagccaatggagattgcccggattgtggcccggtgcctgtgggaagaatcacgccttctacagactgcagccactgcggcccagcaagggggccaggccaaccaccccacagcagccgtggtgacggagaagcagcagatgctggagcagcaccttcaggatgtccggaagagagtgcaggatctagaacagaaaatgaaagtggtagagaatctccaggatgactttgatttcaactataaaaccctcaagagtcaaggagacatgcaagatctgaatggaaacaaccagtcagtgaccaggcagaagatgcagcagctggaacagatgctcactgcgctggaccagatgcggagaagcatcgtgagtgagctggcggggcttttgtcagcgatggagtacgtgcagaaaactctcacggacgaggagctggctgactggaagaggcggcaacagattgcctgcattggaggcccgcccaacatctgcctagatcggctagaaaactggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaagtgcctttgtggtggagcggcagccctgcatgcccatgcatcctgaccggcccctcgtcatcaagaccggcgtccagttcactactaaagtcaggttgctggtcaaattccctgagttgaattatcagcttaaaattaaagtgtgcattgacaaagactctggggacgttgcagctctcagaggatcccggaaatttaacattctgggcacaaacacaaaagtgatgaacatggaagaatccaacaacggcagcctctctgcagaattcaaacacttgaccctgagggagcagagatgtgggaatgggggccgagccaattgtgatgcttccctgattgtgactgaggagctgcacctgatcacctttgagaccgaggtgtatcaccaaggcctcaagattgacctagagacccactccttgccagttgtggtgatctccaacatctgtcagatgccaaatgcctgggcgtccatcctgtggtacaacatgctgaccaacaatcccaagaatgtaaacttttttaccaagcccccaattggaacctgggatcaagtggccgaggtcctgagctggcagttctcctccaccaccaagcgaggactgagcatcgagcagctgactacactggcagagaaactcttgggacctggtgtgaattattcagggtgtcagatcacatgggctaaattttgcaaagaaaacatggctggcaagggcttctccttctgggtctggctggacaatatcattgaccttgtgaaaaagtacatcctggccctttggaacgaagggtacatcatgggctttatcagtaaggagcgggagcgggccatcttgagcactaagcctccaggcaccttcctgctaagattcagtgaaagcagcaaagaaggaggcgtcactttcacttgggtggagaaggacatcagcggtaagacccagatccagtccgtggaaccatacacaaagcagcagctgaacaacatgtcatttgctgaaatcatcatgggctataagatcatggatgctaccaatatcctggtgtctccactggtctatctctatcctgacattcccaaggaggaggcattcggaaagtattgtcggccagagagccaggagcatcctgaagctgacccaggcgctgccccatacctgaagaccaagtttatctgtgtgacaccaacgacctgcagcaataccattgacctgccgatgtccccccgcactttagattcattgatgcagtttggaaataatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgtggttccagattttttttaatctcctacttctgctatctttgagcaatctgggcacttttaaaaatagagaaatgagtgaatgtgggtgatctgcttttatctaaatgcaaataaggatgtgttctctgagacccatgatcaggggatgtggcggggggtggctagagggagaaaaaggaaatgtcttgtgttgttttgttcccctgccctcctttctcagcagctttttgttattgttgttgttgttcttagacaagtgcctcctggtgcctgcggcatccttctgcctgtttctgtaagcaaatgccacaggccacctatagctacatactcctggcattgcactttttaaccttgctgacatccaaatagaagataggactatctaagccctaggtttctttttaaattaagaaataataacaattaaagggcaaaaaacactgtatcagcatagcctttctgtatttaagaaacttaagcagccgggcatggtggctcacgcctgtaatcccagcactttgggaggccgaggcggatcataaggtcaggagatcaagaccatcctggctaacacggtgaaaccccgtctctactaaaagtacaaaaaattagctgggtgtggtggtgggcgcctgtagtcccagctactcgggaggctgaggcaggagaatcgcttgaacctgagaggcggaggttgcagtgagccaaaattgcaccactgcacactgcactccatcctgggcgacagtctgagactctgtctcaaaaaaaaaaaaaaaaaaaagaaacttcagttaacagcctccttggtgctttaagcattcagcttccttcaggctggtaatttatataatccctgaaacgggcttcaggtcaaacccttaagacatctgaagctgcaacctggcctttggtgttgaaataggaaggtttaaggagaatctaagcattttagacttttttttataaatagacttattttcctttgtaatgtattggccttttagtgagtaaggctgggcagagggtgcttacaaccttgactccctttctccctggacttgatctgctgtttcagaggctaggttgtttctgtgggtgccttatcagggctgggatacttctgattctggcttccttcctgccccaccctcccgaccccagtccccctgatcctgctagaggcatgtctccttgcgtgtctaaaggtccctcatcctgtttgttttaggaatcctggtctcaggacctcatggaagaagagggggagagagttacaggttggacatgatgcacactatggggccccagcgacgtgtctggttgagctcagggaatatggttcttagccagtttcttggtgatatccagtggcacttgtaatggcgtcttcattcagttcatgcagggcaaaggcttactgataaacttgagtctgccctcgtatgagggtgtatacctggcctccctctgaggctggtgactcctccctgctggggccccacaggtgaggcagaacagctagagggcctccccgcctgcccgccttggctggctagctcgcctctcctgtgcgtatgggaacacctagcacgtgctggatgggctgcctctgactcagaggcatggccggatttggcaactcaaaaccaccttgcctcagctgatcagagtttctgtggaattctgtttgttaaatcaaattagctggtctctgaattaagggggagacgaccttctctaagatgaacagggttcgccccagtcctcctgcctggagacagttgatgtgtcatgcagagctcttacttctccagcaacactcttcagtacataataagcttaactgataaacagaatatttagaaaggtgagacttgggcttaccattgggtttaaatcatagggacctagggcgagggttcagggcttctctggagcagatattgtcaagttcatggccttaggtagcatgtatctggtcttaactctgattgtagcaaaagttctgagaggagctgagccctgttgtggcccattaaagaacagggtcctcaggccctgcccgcttcctgtccactgccccctccccatccccagcccagccgagggaatcccgtgggttgcttacctacctataaggtggtttataagctgctgtcctggccactgcattcaaattccaatgtgtacttcatagtgtaaaaatttatattattgtgaggttttttgtcttttttttttttttttttttttggtatattgctgtatctactttaacttccagaaataaacgttatataggaaccgtaaaaa

SEQ ID NO: 981 - DNA, 2761 bp, Homo sapiens
agaggacgcccggtgaaggggctccagcctggcagtttctgcgtgttagcatttctagaatagagtgggtgggaactgacccaagtaaagtcccagagactcgaacactgacgcacaggaaagcctcaagtgggaggagaaatgcaaatcccctactgatgatggcgtcagcggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacag

SEQ ID NO: 982 - DNA, 4314 bp, Homo sapiens
agacaggatattcactgctgtggcaaggcctgtagagagtttcgaagttaggaggactcaagacggtccctccctggacttttctgaaggggctcaaaagatgacacgcgccagagctggaaggcgtcgccaattggtccacttttccctcctccctttttgcggatgagaaaactgaggcccaggtttgggatttccagagcccgggatttcccggcaacgcccgacaaccacattcccccggctattctgacccgccccggttccgggacgctccctgggagccgccgccgagggcctgctgggactcccgggggaccccgccgtcggggcagcccccacgcccggcgccgcccgccgggaacggccgccgctgttgcgcacttgcaggggagccggcgactgagggcgaggcagggagggagcaagcggggctgggagggctgctggcgcgggctcgcgcgctgtgtatggtctatcgcaggcagctgacctttgaggaggaaatcgctgctctccgctccttcctgtagtaacagccgccgctgccgccgccgccaggaaccccggccgggagcgagagccgcggggcgcagagccggcccggctgccggacggtgcggccccaccaggtgaacggccatggcgggctggatccaggcccagcagctgcagggagacgcgctgcgccagatgcaggtgctgtacggccagcacttccccatcgaggtccggcactacttggcccagtggattgagagccagccatgggatgccattgacttggacaatccccaggacagagcccaagccacccagctcctggagggcctggtgcaggagctgcagaagaaggcggagcaccaggtgggggaagatgggtttttactgaagatcaagctggggcactacgccacgcagctccagaaaacatatgaccgctgccccctggagctggtccgctgcatccggcacattctgtacaatgaacagaggctggtccgagaagccaacaattgcagctctccggctgggatcctggttgacgccatgtcccagaagcaccttcagatcaaccagacatttgaggagctgcgactggtcacgcaggacacagagaatgagctgaagaaactgcagcagactcaggagtacttcatcatccagtaccaggagagcctgaggatccaagctcagtttgcccagctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacattcatcattgagaagcagcctcctcaggtcctgaagacccagaccaagtttgcagccaccgtacgcctgctggtgggcgggaagctgaacgtgcacatgaatcccccccaggtgaaggccaccatcatcagtgagcagcaggccaagtctctgcttaaaaatgagaacacccgcaacgagtgcagtggtgagatcctgaacaactgctgcgtgatggagtaccaccaagccacgggcaccctcagtgcccacttcaggaacatgtcactgaagaggatcaagcgtgctgaccggcggggtgcagagtccgtgacagaggagaagttcacagtcctgtttgagtctcagttcagtgttggcagcaatgagcttgtgttccaggtgaagactctgtccctacctgtggttgtcatcgtccacggcagccaggaccacaatgccacggctactgtgctgtgggacaatgcctttgctgagccgggcagggtgccatttgccgtgcctgacaaagtgctgtggccgcagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtccgtgtcctggtcccagttcaacagggagaacttgccgggctggaactacaccttctggcagtggtttgacggggtgatggaggtgttgaagaagcaccacaagccccactggaatgatggggccatcctaggttttgtgaataagcaacaggcccacgacctgctcatcaacaagcccgacgggaccttcttgttgcgctttagtgactcagaaatcgggggcatcaccatcgcctggaagtttgactccccggaacgcaacctgtggaacctgaaaccattcaccacgcgggatttctccatcaggtccctggctgaccggctgggggacctgagctatctcatctatgtgtttcctgaccgccccaaggatgaggtcttctccaagtactacactcctgtgctggctaaagctgttgatggatatgtgaaaccacagatcaagcaagtggtccctgagtttgtgaatgcatctgcagatgctgggggcagcagcgccacgtacatggaccaggccccctccccagctgtgtgcccccaggctccctataacatgtacccacagaaccctgaccatgtactcgatcaggatggagaattcgacctggatgagaccatggatgtggccaggcacgtggaggaactcttacgccgaccaatggacagtcttgactcccgcctctcgccccctgccggtcttttcacctctgccagaggctccctctcatgaatgtttgaatcccacgcttctctttggaaacaatatgcaatgtgaagcggtcgtgttgtgagtttagtaaggctgtgtacactgacacctttgcaggcatgcatgtgcttgtgtgtgtgtgtgtgtgtgtgtccttgtgcatgagctacgcctgcctcccctgtgcagtcctgggatgtggctgcagcagcggtggcctcttttcagatcatggcatccaagagtgcgccgagtctgtctctgtcatggtagagaccgagcctctgtcactgcaggcactcaatgcagccagacctattcctcctgggcccctcatctgctcagcagctatttgaatgagatgattcagaaggggaggggagacaggtaacgtctgtaagctgaagtttcactccggagtgagaagctttgccctcctaagagagagagacagagagacagagagagagaaagagagagtgtgtgggtctatgtaaatgcatctgtcctcatgtgttgatgtaaccgattcatctctcagaagggaggctggggttcattttcgagtagtattttatactttagtgaacgtggactccagactctctgtgaaccctatgagagcgcgtctgggcccggccatgtccttagcacaggggggccgccggtttgagtgagggtttctgagctgctctgaattagtccttgcttggctgcttggccttgggcttcattcaagtctatgatgctgttgcccacgtttcccgggatatatattctctcccctccgttgggccccagccttctttgcttgcctctctgtttgtaaccttgtcgacaaagaggtagaaaagattgggtctaggatatggtgggtggacaggggccccgggacttggagggttggtcctcttgcctcctggaaaaaacaaaaacaaaaaactgcagtgaaagacaagctgcaaatcagccatgtgctgcgtgcctgtggaatctggagtgaggggtaaaagctgatctggtttgactccgctggaggtggggcctggagcaggccttgcgctgttgcgtaactggctgtgttctggtgaggccttgctcccaaccccacacgctcctccctctgaggctgtaggactcgcagtcaggggcagctgaccatggaagattgagagcccaaggtttaaacttctctgaagggaggtggggatgagaagaggggtttttttgtactttgtacaaagaccacacatttgtgtaaacagtgttttggaataaaatatttttttcataaaaaaaaaaaaaaaa

SEQ ID NO: 983 - DNA, 5171 bp, Homo sapiens
ggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattgaggtgcggcattatttatcccagtggattgaaagccaagcatgggactcagtagatcttgataatccacaggagaacattaaggccacccagctcctggagggcctggtgcaggagctgcagaagaaggcagagcaccaggtgggggaagatgggtttttactgaagatcaagctggggcactatgccacacagctccagaacacgtatgaccgctgccccatggagctggtccgctgcatccgccatatattgtacaatgaacagaggttggtccgagaagccaacaatggtagctctccagctggaagccttgctgatgccatgtcccagaaacacctccagatcaaccagacgtttgaggagctgcgactggtcacgcaggacacagagaatgagttaaaaaagctgcagcagactcaggagtacttcatcatccagtaccaggagagcctgaggatccaagctcagtttggcccgctggcccagctgagcccccaggagcgtctgagccgggagacggccctccagcagaagcaggtgtctctggaggcctggttgcagcgtgaggcacagacactgcagcagtaccgcgtggagctggccgagaagcaccagaagaccctgcagctgctgcggaagcagcagaccatcatcctggatgacgagctgatccagtggaagcggcggcagcagctggccgggaacggcgggccccccgagggcagcctggacgtgctacagtcctggtgtgagaagttggccgagatcatctggcagaaccggcagcagatccgcagggctgagcacctctgccagcagctgcccatccccggcccagtggaggagatgctggccgaggtcaacgccaccatcacggacattatctcagccctggtgaccagcacgttcatcattgagaagcagcctcctcaggtcctgaagacccagaccaagtttgcagccactgtgcgcctgctggtgggcgggaagctgaacgtgcacatgaaccccccccaggtgaaggccaccatcatcagtgagcagcaggccaagtctctgctcaagaacgagaacacccgcaatgattacagtggcgagatcttgaacaactgctgcgtcatggagtaccaccaagccacaggcacccttagtgcccacttcaggaatatgtccctgaaacgaattaagaggtcagaccgtcgtggggcagagtcggtgacagaagaaaaatttacaatcctgtttgaatcccagttcagtgttggtggaaatgagctggtttttcaagtcaagaccctgtccctgccagtggtggtgatcgttcatggcagccaggacaacaatgcgacggccactgttctctgggacaatgcttttgcagagcctggcagggtgccatttgccgtgcctgacaaagtgctgtggccacagctgtgtgaggcgctcaacatgaaattcaaggccgaagtgcagagcaaccggggcctgaccaaggagaacctcgtgttcctggcgcagaaactgttcaacaacagcagcagccacctggaggactacagtggcctgtctgtgtcctggtcccagttcaacagggagaatttaccaggacggaattacactttctggcaatggtttgacggtgtgatggaagtgttaaaaaaacatctcaagcctcattggaatgatggggccattttggggtttgtaaacaagcaacaggcccatgacctactcattaacaagccagatgggaccttcctcctgagattcagtgactcagaaattggcggcatcaccattgcttggaagtttgattctcaggaaagaatgttttggaatctgatgccttttaccaccagagacttctccattcggtccctagccgaccgcttgggagacttgaattaccttatctacgtgtttcctgatcggccaaaagatgaagtatactccaaatactacacaccagttccctgcgagtctgctactgctaaagctgttgatggatacgtgaagccacagatcaagcaagtggtccctgagtttgtgaacgcatctgcagatgccgggggcggcagcgccacgtacatggaccaggccccctccccagctgtgtgtccccaggctcactataacatgtacccacagaaccctgactcagtccttgacaccgatggggacttcgatctggaggacacaatggacgtagcgcggcgtgtggaggagctcctgggccggccaatggacagtcagtggatcccgcacgcacaatcgtgaccccgcgacctctccatcttcagcttcttcatcttcaccagaggaatcactcttgtggatgttttaattccatgaatcgcttctcttttgaaacaatactcataatgtgaagtgttaatactagttgtgaccttagtgtttctgtgcatggtggcaccagcgaagggagtgcgagtatgtgtttgtgtgtgtgtgtgtgtgtgtgtgtgtgtgcgtgtttgcacgttatggtgtttctccctctcactgtctgagagtttagttgtagcagaggggccacagacagaagctgtggtggtttttactttgtgcaaaaaggcagtgagtttcgtgaagcctggaagttggccatgtgtcttaagagtggctggactttgacatgtggctgtttgaataagagaaggacaaagggaggagaaagcacatgtgctccagtgagtcttcgtcactctgtctgccaagcaattgatatataaccgtgattgtctctgcttttcttctgaaatgtagataactgctttttgacaaagagagccttccctctcccccacccctgtgttcttgggtaggaatgggaaaaggggcaacctacaaagattgttggggcaagggaagtcacaagctttcggatgggcggtggcttttcacaaaacatttagctcatcttattctctctttgtcctctctcccctcctgcccgcccgcaccctggaattgccactcagttcctctgggtgtgcacatatgtttggagaaatagaggagagaaaagagggccacgtaactgagagcttacagtgccaatgccgtttgtgttctggccagagtggagtgcgcagccctgactcccaggcgctgagattgttgcctggttacccaggaagctgctgttccggctgcccagcctttctctgagccagcggatgcacagtccgtggccttcttcaggcttattgatgatgctttttgcaaatgttgaatcatggttctgtttctaagttggatcttttttgttttctccttgccaccctaatttgacatcaaaattctctcttgtgcattgggccctgggtcattcaaacccaggtcacctcattccccttctctgttcacacctaatgtcttgaagagtaggtagcagcagtgtgggctgaacctaggccagcttgcttagcgggtcaccctgctgtgaagtcctggcaggtgttggtaatgtgtggaaatgcagtcagcaagtttgctggggagtttgataaaagtataaaacaaaacaaaaaaagcctcggtataattttgttccacgacttcttctgtagctttacaccagaaggaaggaatgggctacagcaggtagtggaggaagaggggggtgagcaggtgtattaaaatagcttacgggtaaggcctaaaaggtcacccctcggccccctctccaaaagaagggcatgggcacccccaggagaggatggccccaaaaaccttatttttatacatgagagtaaataaacatattttttttacaaaaataacttctgaatttatcagtgttttgccgttaaaaatattcctctatagtaaattatttattggaagatgacttttttaaagctgccgtttgccttggcttggtttcatacactgatttatttttctatgccaggcagtagagtctctctgcctctgaggagcaggctacccgcatcccactcagcccctccctacccctcaagatttgatgaaaattccaaccatgaggatgggtgcatcggggaagggtgagaaggagagcctgcctgctcagggatccaggctcgtagagtcactccctgcccgtctcccagagatgcttcaccagcacctgcctctgagacctcgctctctgttccagcaaccctggttggggggtcagacttgatacactttcaggttgggagtggacccaccccagggcctgctgaggacagagcagccaggccgtcctggctcactttgcagttggcactgggttggggaggaagagagctgatgagtgtggcttccctgagctggggtttccctgcttgtccagttgtgagctgtcctcggtgttaccgaggctgtgcctagagagtggagatttttgatgaaaggtgtgctcgctctctgcgttctatcttctctctcctccttgttcctgcaaaccacaagataaaggtagtggtgtgtctcgaccccatcagcctctcacccactcccagacacacacaagtcctcaaaagtttcagctccgtgtgtgagatgtgcaggttttttctagggggtagggggagactaaaatcgaatataacttaaaatgaaagtatactttttataatttttctttttaaaacttggtgaaattatttcagatacatattttagtgtcaaggcagattagttatttagccaccaaaaaaaagtattgtgtacaatttggggcctcaaatttgactctgcctcaaaaaaaagaaatatatcctatgcagagttacagtcacaaagttgtgtattttatgttacaataaagccttcctctgaagggaaaaaaaaaaaaaaaaaaaaaaaaaaaaaaaaaaaaaaaaaaaaaaaaaaaaaaaaaaaaaaaaaaaaaaaaaaaaaa

SEQ ID NO: 984 - DNA, 3993 bp, Homo sapiens
ccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctcaagggaccctgggtgggagcataggaggggtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatgtatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaaaaaaaaaaaaaaaa

SEQ ID NO: 985 - DNA, 4684 bp, Homo sapiens
ggcagaccgtcacgtgacgacgtcgattcgcgtgcggcagtggcgaagttgacaaaccccgcgaaaatcgactctttgcatcgcacattttgttgattttccctcgtttttctttctctctttcccccgtccatccgaaagagggttggaaaaaaacaaaacaaacaaacaaacaaaaaaaaaacctaacgctgttgggacccggaagcggaaagggcatctttgaggtcgatacttccgggtcattgggagagtgcgggattcctgggccgagagcgggtggctgagccgggacctcgcgtgattctcggaacccgaggagaagcggcgtccggggctatggctgtgactctggacaaagacgcttattatcggcgagtgaagagactgtacagcaattggcggaaaggagaagatgagtatgccaacgttgatgccattgttgtatcagtgggtgttgatgaagaaattgtttatgccaaatcaactgccttacagacatggctctttggttatgaactaactgatactatcatggtcttttgtgatgacaaaatcatctttatggccagcaagaaaaaagtggagttcttgaaacagattgccaacactaagggcaatgagaatgctaatggagcccctgccatcacactgctaatacgagaaaagaatgaaagtaataagagtagctttgacaaaatgattgaagccattaaagaaagcaagaatggcaagaagattggagtgttcagcaaagacaaattccctggagagttcatgaagagctggaatgactgcctcaacaaagaaggctttgacaaaatagatatcagtgcagttgtggcatataccatcgctgtaaaggaggatggggagctcaacctaatgaagaaagcagccagcatcacttctgaagtcttcaacaaattcttcaaggaaagagtcatggaaatagttgatgcagatgagaaagttcgacacagcaaactggctgagtctgtggaaaaggccattgaagagaaaaaataccttgctggggcagacccttctactgtggaaatgtgttaccctcctatcattcagagtggtggcaactataatctcaagttcagtgtggtgagtgacaagaatcatatgcactttggggctatcacttgtgccatgggtattcgcttcaagtcttactgctccaaccttgttcgcactttgatggttgatccttctcaagaagttcaagaaaattataactttttgctccagcttcaagaggagctgctgaaggaattaagacatggtgtgaagatatgtgacgtgtataacgctgtcatggacgtggttaaaaagcagaagccagaactgctgaacaaaattaccaaaaacctagggtttgggatgggaattgaattccgtgaaggctccctagtaatcaatagcaaaaatcaatacaaactgaagaaaggaatggttttcagcatcaatttaggattctcagacctgactaacaaggaggggaaaaagccagaagagaaaacctatgccctgttcattggtgacacagtgcttgtggatgaggatggcccagctactgttctcacttctgtgaagaagaaagtgaagaatgtggggattttcctaaagaatgaagatgaggaagaagaggaggaggagaaagatgaggcagaggaccttttgggaagaggttctcgggcagcattacttacagaaagaacaagaaatgaaatgactgcagaagagaagcgaagagcacatcagaaagaactagcggctcaactcaatgaagaagcaaagaggcgattgactgaacaaaagggagaacagcagattcagaaagctcgcaagtctaatgtgtcctataaaaacccatctctgatgcctaaggaaccacatattcgggaaatgaagatctacatcgataagaaatatgagactgtaataatgcccgtgtttggcattgcaacaccgtttcacattgccacaatcaagaatataagtatgtccgtggaaggagattatacttacttgcgaatcaacttttattgcccaggcagtgctctgggcaggaatgaaggcaacatctttcctaaccctgaagcgacttttgtcaaggaaattacataccgagcatcaaatattaaggcacccggagaacagacagtaccagccttgaaccttcagaatgctttccgaattattaaagaagtacagaaacgttataaaactcgagaagctgaagagaaagagaaggaggggattgtaaaacaagactcactggtgatcaatctaaaccggagtaatccgaaactgaaagatctatacattcgcccaaatattgcccaaaagaggatgcaaggctcactggaggcccatgtcaatggcttccgcttcacatctgttcgaggagacaaagtggatattttgtacaataatattaagcatgctttgttccagccctgtgatggagaaatgattattgtcttgcactttcacctcaagaatgccatcatgtttgggaagaagcggcacacggatgtgcagttctacacagaagtgggagagataaccacggacttggggaaacatcagcatatgcatgaccgagatgacctctatgctgagcagatggaacgagaaatgaggcacaaactgaaaacagcctttaaaaatttcattgagaaagtagaggctctaactaaggaggaactggaatttgaagtgccttttagggacttgggatttaacggagctccctataggagtacctgcctccttcagcccactagtagtgcgctggtaaatgctacggaatggccaccttttgtggtgacattggatgaggtagagctgatccactttgagcgggtccagtttcacctgaagaactttgatatggtaatcgtctacaaggactacagcaagaaagtgaccatgatcaacgccattcctgtagcctctcttgaccccatcaaggaatggttgaattcctgcgacctgaaatacacagaaggagtacagtccctcaactggactaaaatcatgaagaccattgttgatgaccctgagggcttcttcgaacaaggtggctggtctttcctggagcctgagggtgaggggagtgatgctgaagaaggggattcagagtctgaaattgaagatgagacttttaatccttcagaagatgactatgaagaggaagaggaggacagtgatgaagattattcatcagaagcagaagagtcagactattctaaggagtcattgggtagtgaagaagagagtggaaaggattgggatgaactggaggaagaagcccgaaaagcggaccgagaaagtcgttacgaggaagaagaagaacaaagtcgaagtatgagccggaagaggaaggcatctgtgcacagttcgggccgtggctctaaccgtggttccagacacagctctgcaccccccaagaaaaagaggaagtaacttctgaactttggccctgagctccattcttcctccagccaacccctgaaaattttacatgacatagaaactgtatttttcctttcgttttcatttgaagttttgccatttgtgtttatgggtttagggggccatttgtgtggaccaatctactcggggaattccaggcccaccaggacacgtgccaatggccccattcagatggcaagggaggaggtgttcttgaagacaggaggaggctcccgctgttaataaatattgtttcattcttctctcttcctgtcaccttctgccaagacattgatggcttctgacatcttatttggtgtctcaaagctgtatttccaagacagtggtacaaggtgacccttaattacccgtatcatggttcttgaccagcacattcaatcctccaacctaccctactgccatgaccttccgcacatctctaagttttatctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttatatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgtttttgtaaattca

SEQ ID NO: 986 - DNA, 1164 bp, Homo sapiens
cgcaccatctgcacccccacattctcctcgcgggaagcgcagcagtgcctccaagggttcttaaagcagagatgaataatacggcagctagtccaatgtctactgcaacttcaagtagtggaaggagtacagggaagtctataagctttgcaacagaattacagagtatgatgtattctttaggtgatgctagaaggcctcttcatgaaacagcagttttggtagaagatgtggtacacactcagttaattaatctgttacagcaagctgctgaagtttctcagctgcggggagcaagggtaatcactcctgaagatcttctgtttttgatgcgcaaagataagaaaaaacttagaagactgctaaaatacatgtttatccgagactacaaatcaaagattgtcaaaggcatcgatgaggatgatcttctcgaagacaaattgagtggcagcaataatgcgaacaaaagacaaaagattgctcaggacttcctcaactctattgaccagacaggagaacttttagcaatgtttgaagatgacgaaattgatgaagttaaacaagaaagaatggagagagcagaaagacaaactcgaattatggattcagctcaatatgcagaattctgtgaaagtcgacaattaagtttctccaaaaaagcttccaaatttcgagactggttggactgcagcagtatggagataaaacccaatgttgtcgcaatggaaatcttagcatatttagcgtatgaaactgtggcacagttagtggatctggctcttcttgtgaggcaagacatggtaaccaaggcaggggaccccttcagccatgccatttctgcaaccttcattcagtatcacaactctgctgagagcactgcagcctgtggtgttgaggctcacagcgatgccatccagccctgccacatcagagaggccattcgacgctacagccacaggattggcccactttccccattcacaaatgcctaccgcaggaatgggatggcttttctagcctgctgatgtgacaactgtgatgtgcctgcaacaacaggaaaggcaatgttatattaaggtgatttcttgtgaacaaaataaaatacaaatttacctttcttttatctgacaaaaaaaaaaaaaaaaaaaaaaaaaaaaaaaaaaa

SEQ ID NO: 987 - DNA, 1499 bp, Homo sapiens
tatttacttcctgcgggtgcacaggctgtggtcgtctatctccctgttgttcttcccatcggcgaagatggccctggagacggtgccgaaggacctgcggcatctgcgggcctgtttgctgtgttcgctggtcaagactatagaccagtttgaatatgatggttgtgacaattgtgatgcatatctacaaatgaagggtaaccgagagatggtatatgactgcactagctcttcctttgatggaatcattgcgatgatgagtccagaggacagctgggtctccaagtggcagcgagtcagtaactttaagccaggtgtatatgcggtgtcagtcactggtcgcctgccccaaggaatcgtgcgggagctgaaaagtcgaggagtggcctacaaatccagagacacagctataaagacctagcaagatgcaaggctgccagcatctttgctctccacctcctgcctctgcttatttcttgttctggaactaaatgaacagaacttcaaatacttcctaccctccaattcagactcagctgactgttgagagagcagcacatcattttatcattttatcttctttggactacaggtggggtgggagggatttgggttggtggattaacagatggaattgaggagagagtaggatgctgattttcctacccgtggcccaggtctgtgccttccccatgccaaggactctaggtcaaatgtcaataaatatgaacctcgagaaagttctgaaggccatgacacctgccttgcctccctcttccattctcttaggcacagtaatagcttatttgccctataagaaccttcccagagcagcagaggcccttctactccctcttgactgtctcagcctctgggattgcagcctttgtagtgtgcttccttgcttcctatcagagggtgctgatccagaggctcagtaaccccatcaacttggtggccctggtgtctcacacttgtatccttctgccctcgagacctggcacagcagtatcccttgaagaaatcctgaggctttgtagagtgctccttgaccatgtttaataattcttccctcccctgcttgtctattttcttctcttcacggctcttcctataccttaggccagtctcaagcactcactggagacccttgggccttgggcgaccattgagtcctagtctcccttgtttgtgcccctgtaggaggtaggtccttttctcctccggcctagtaggggaccttgggtaacatcccatttttcggccaaggtgagttgttttaggataaaaaaatttaccacaaattctcatttaaatttccacagaaatcctgttcgtatccccattttgatttccctaagttccttgttctccctctaaaaagagaatgattgcaccctgcctgtttacctcaggattgttgtgattgtagaaacgaagctatgtgaaaattatataagtattataaaggtgaaatacttttgctctcaaaaaaaaaa

SEQ ID NO: 988 - DNA, 3798 bp, Homo sapiens
gtgcagaggtggcagttccgggcgccggggaggtgtagagaacagattcggaaactggggaggtctagcatgtggcgtaggagggggtcctcactccgcttcgcgattgccaaaacgagcctgccggaagcgccctaaggggttttcttctcccagggaaccagcggggaaactgaggctcggggtggagcgcaggattgtgggacgcgccaaggctgctgtctttcccagcagcagcggaagatgtcggacagcgaggacagcaacttttccgaggaggaggacagcgagcgcagcagtgacggcgaggaggccgaggtagacgaagagcggcggagtgcagcgggcagtgagaaagaagaagagcctgaggacgaagaggaggaggaagaggaggaggaatacgatgaggaagaggaggaagaagatgatgaccgaccccccaagaaaccccgccatggaggcttcattctggacgaggctgatgttgacgatgagtatgaggacgaggaccagtgggaggatggagcagaggacattctagagaaagaagagattgaagcctccaatatcgataatgttgtcctggatgaagatcgttctggggctcgccgcctgcaaaacctctggagggaccagcgagaagaagaactgggcgagtattacatgaagaaatacgccaagtcatctgtgggagagacggtgtatggaggatctgatgagctctcagacgacatcacccagcagcagctgctcccaggagtcaaggatcccaatctgtggactgtcaaatgtaagattggggaggaacgggccacggccatttccttgatgcgcaagttcattgcctaccagttcacagacacgcccctgcagatcaagtcagtagtggcaccagagcatgtgaagggctacatctacgtggaggcctacaagcagacccacgtgaagcaggccattgagggggtgggcaacctgcggcttggctactggaaccagcagatggtgcccatcaaggagatgacagacgtgctcaaagtggtgaaggaggtggccaacctgaaaccaaagtcctgggtccgcctcaagcggggcatctacaaggatgacattgctcaggtggactacgtggagcccagccagaacaccatctccctgaagatgatcccacgcatcgactacgatcgcatcaaggcccgcatgagcttgaaagactggtttgccaaaaggaagaagtttaagcggcctccacagaggctgtttgatgctgagaagatcaggtccctggggggtgatgttgcctctgatggtgacttcctcatctttgaggggaaccgttacagccggaagggctttctgttcaagagcttcgccatgtctgctgtgatcacggagggtgtgaagccaacactctctgagctggaaaagtttgaggaccagccagagggcattgacctggaggtggtgactgagagcacagggaaggagcgggagcacaacttccaacctggggacaacgtggaggtctgtgagggtgagctcatcaacctgcagggcaagatcctcagcgtggatggcaacaagatcaccatcatgcccaagcatgaggacctcaaggacatgttggagttcccagcccaggaacttagaaaatacttcaagatgggggaccacgtgaaggtgattgctggccgattcgagggcgacacaggcctcattgtgcgggtggaggagaatttcgttatcctgttctctgacctcaccatgcatgagctgaaggtgctcccccgggacctgcagctctgctcagagacagcatcaggtgtggatgttgggggccagcatgaatggggcgagctggtgcagctggatccccagactgtgggtgtcatcgtgcgactagaacgggagaccttccaggtgctgaacatgtacgggaaggtggtgactgtcagacatcaggctgtgacccggaagaaggacaaccgctttgctgtggccttggactcagagcagaacaacatccatgtgaaagacatcgttaaggtcattgatggcccccactcaggccgagaaggggagattcgccatctcttccgaagcttcgccttcctacattgcaagaaactggtggagaacgggggcatgtttgtctgcaagacccgccacctggtgctggctgggggctcaaagccccgtgatgtgaccaacttcaccgtgggtggctttgcgcctatgagtccccggatcagcagccccatgcaccccagtgctggaggtcagcgtggcggctttggtagcccaggtggcggcagtggtggcatgagcaggggccggggccggagggacaacgaactcatcggccagaccgtgcgcatctcccaggggccctacaaaggctacatcggtgtggtgaaagatgccacagagtccacggcccgtgtggagctgcactccacctgccagaccatctctgtggaccgtcagcggctcaccacggtgggctcacggcgcccgggcggcatgacctcgacctatgggaggacgcccatgtatggctcccagacgcccatgtatggctctggctcccgaacacccatgtacggctcacagacacccctccaggatggtagccgcaccccacactacggctcacagacgcccctgcatgatggcagccgcactcctgcccagagtggggcctgggaccccaacaaccccaacacgccgtcacgggctgaggaagaatatgagtatgctttcgatgatgagcccaccccgtccccgcaggcctatgggggaacccccaatccccaaacacctggctacccagacccctcgtccccacaggtcaacccacaatacaacccgcagacgccagggacgccggccatgtacaacacagaccagttctctccctatgctgccccctccccacaaggttcctaccagcccagccccagcccccagagctaccaccaggtggcgccaagcccagcaggctaccagaatacccactccccagccagctaccaccctacaccgtcgcccatggcctatcaggctagccccagcccgagccccgttggctacagtcctatgacacctggagctccctcccctggtggctacaacccacacacgccaggctcaggcatcgagcagaactccagcgactgggtaaccactgacattcaggtgaaggtgcgggacacctacctggatacacaggtggtgggacagacaggtgtcatccgcagtgtcacggggggcatgtgctctgtgtacctgaaggacagtgagaaggttgtcagcatttccagtgagcacctggagcctatcacccccaccaagaacaacaaggtgaaagtgatcctgggcgaggatcgggaagccacgggcgtcctactgagcattgatggtgaggatggcattgtccgtatggaccttgatgagcagctcaagatcctcaacctccgcttcctggggaagctcctggaagcctgaagcaggcagggccggtggacttcgtcggatgaagagtgatcctccttccttccctggcccttggctgtgacacaagatcctcctgcagggctaggcggattgttctggatttccttttgtttttccttttagttttccatcttttccctccctggtgctcattggaatctgagtagagtctgggggagggtccccaccttcctgtacctcctccccacagcttgcttttgttgtaccgtctttcaataaaaagaagctgtttggtctaaaaaaaaaaaaaaaaaaaaaaaa

SEQ ID NO: 989 - DNA, 5896 bp, Homo sapiens
cgactccattttcctcggtgggggcttagcgcactggaggagcggcgggcttcagacagttatcttcaggcagagtgagaagctgcagcaatgtctgattttgtggaaagcgaggctgaggagtcagaggaagaatacaatgatgaaggcgaggtggtaccccgagtcaccaagaaatttgtggaagaggaggatgatgatgaggaggaggaggaggagaacctagatgatcaggatgagcaaggcaacttgaaaggctttatcaatgacgatgatgatgaagatgaaggggaggaggatgagggcagtgactctggtgattcagaagatgatgttggccacaagaagagaaaacgcacctcttttgatgaccgcctggaggatgatgattttgacctcattgaggagaatttgggtgtcaaagtcaaaagaggacaaaagtaccggcgtgtcaaaaaaatgtcagatgacgaggacgatgacgaggaggaatatggcaaggaggaacatgaaaaagaagctattgcggaagaaatcttccaggatggggaaggggaagaagggcaggaggccatggaggcccccatggctcctccagaggaggaggaagaagatgatgaggagtcagatattgacgacttcattgtggatgatgatggacagcctctgaaaaaacctaagtggcggaaaaagcttcctggatacacagacgcggccctgcaagaagcccaggaaatcttcggtgtggactttgactatgatgaatttgagaaatacaatgagtatgatgaagaactggaggaagagtatgagtatgaggatgatgaggctgagggtgaaatccgagtgcgccccaagaagaccaccaagaagcgtgtgagccgtaggagcatctttgaaatgtatgagcccagtgagctagaaagcagccacctcacagatcaggacaatgaaatccgagccactgacctgcctgagaggttccagctccgctccatcccagtcaagggggctgaagatgatgaactagaagaagaagctgactggatctacaggaatgcttttgccacaccaaccatttctctccaggaaagctgtgattacctagaccgagggcagccagccagcagcttcagtcggaaagggcccagcacaattcagaagatcaaagaggccctgggcttcatgcgaaatcagcattttgaggtgccttttattgccttctatcgaaaggagtatgtggagcctgagttgcacatcaatgacctatggagagtctggcagtgggatgaaaagtggacccagctgcggatccgtaaagagaacctaacacggctgtttgagaagatgcaggcttatcagtatgaacagatctctgctgaccctgacaaacctcttgctgatggcatccgggctctggacaccactgacatggagaggctcaaggatgtccaatcaatggatgagctgaaagatgtctacaaccattttcttctttattatggccgagacatccctaagatgcagaacgccgccaaagctagccgcaagaagctgaagcgtgtcagggaagagggagatgaagaaggtgaaggtgacgaggcagaagatgaggagcagagggggcctgagctcaagcaagcctctcgccgagacatgtacaccatctgccagagtgctgggctagatggcctggccaaaaagtttgggcttactcccgagcagtttggggagaacctgcgggatagctaccagcggcacgagacagagcagtttcccgcggagcccttggagctggccaaggattacgtttgcagccagttccctactccagaagctgtgctagaaggcgcccgctacatggtagccctgcagattgcccgtgagccccttgtccggcaggtgctgaggcaaaccttccaagagagagccaagttaaatataacccccaccaagaaaggtagaaaggatgtggatgaggcccactatgcctattccttcaagtatttaaagaacaagcctgttaaggaactgagagatgaccagtttctcaagatatgcctggctgaagacgaagggctcctcaccactgacatcagcatagatttgaagggagtggaaggctatggcaacgaccagacatattttgaggagataaaacagttttactaccgagatgagttcagccaccaggtgcaggagtggaaccggcagcgcaccatggccatcgaacgggctttacagcagttcctctatgtgcagatggccaaagaactcaagaacaagctgctggctgaagccaaggaatatgtcataaaggcctgtagtcgaaagctctacaattggttgagagtggcaccctaccgaccagatcagcaggtggaagaagatgacgactttatggacgagaaccaagggaagggcattcgagtcctcggcattgctttctcctctgccagagatcaccctgtgttctgcgccctggtcaatggtgaaggagaagtgacagacttccttcgactgccccattttaccaaacggcgaactgcatggagagaggaagagcgggaaaagaaggctcaagacattgaaacgctaaagaaatttctcctgaataagaagcctcatgtagtgacagttgcaggagagaacagggacgcccagatgttgattgaagatgtgaagcgcattgtacatgagctggaccagggccagcagctgtcatctattggggtagagctggttgacaacgagttggccattctctatatgaacagcaagaagtcagaggcagagttccgggattatcctccagtgctgagacaggccgtctccctggcccggcgcatccaggaccctctgattgaatttgcccaggtgtgcagttccgatgaagacatcctgtgtctcaagtttcaccccttgcaggagcatgtggtgaaagaggagctgctcaacgccttgtactgtgaatttatcaaccgagtcaatgaggtcggggtcgatgtcaaccgtgccattgcccacccttacagccaggccttgatccagtatgtttgtggcctgggacctcggaaagggacccacctcctgaagatcctgaagcagaacaacacccggctcgagagccggacccagctggtcaccatgtgccacatgggtcccaaagtcttcatgaattgtgctggcttcctcaagatcgacacggcctccctgggggacagcactgactcatatattgaagtccttgatggttcccgtgtccaccctgagacttatgagtgggctaggaagatggcagtggatgccctggaatacgatgaatcagccgaggatgccaatcctgcaggagcccttgaagaaatcttggaaaacccagagcgactgaaagacctggaccttgatgcctttgcagaagagctggagaggcagggctatggtgacaaacacatcacactctatgacatccgggcagagctgagctgtcgatataaggacctccggacagcctaccgctctcccaacacagaggagatcttcaatatgttaaccaaagaaacaccagagaccttctacattggaaagctcatcatctgcaatgtcactggcattgcccacaggcgtccccagggtgagagctatgaccaggcgatccgcaatgatgagacagggctgtggcagtgccccttctgtcagcaggacaatttccctgaactaagcgaggtgtggaaccactttgacagcggttcgtgcccaggccaggccatcggtgtcaaaacacggctagacaatggtgtcaccggcttcatccccaccaaattcctcagtgacaaagtggtaaagcggccagaagaacgagtgaaggtgggaatgactgttcactgccgcatcatgaagattgacattgagaagttcagtgcagacctgacctgccgcacctcagacctcatggacaggaacaatgagtggaagctgcccaaagacacctactatgactttgatgctgaagctgcagaccacaagcaggaggaggacatgaagcggaagcagcagcggaccacatacatcaagagagtgatcgcacacccatccttccataatatcaatttcaagcaagcagaaaagatgatggagaccatggaccagggtgatgtgattatccgaccaagcagcaagggcgagaaccacctgacagtgacctggaaagtcagtgatggcatctaccagcatgtggatgtgcgggaggagggcaaggaaaatgccttcagcctgggagccactctgtggatcaacagtgaggaattcgaagatttggatgagattgttgctcgctatgtccagcccatggcatcctttgcccgggaccttctgaatcacaagtattatcaggactgcagcggtggggaccgcaagaaattagaggagctgctcatcaaaactaagaaggagaagcccaccttcatcccttatttcatctgtgcctgcaaggaactgcccggcaagttcctactgggataccagccccggggtaaacccaggatagaatatgtaacggtgactccagagggattccggtaccggggccagatcttcccaaccgtgaatggactgtttagatggtttaaggatcactaccaggatcctgtaccaggcatcacccctagcagcagcagcaggacccggacacctgcctctatcaatgctaccccagccaacatcaaccttgcagatctgacacgggctgtgaatgccctgcctcagaacatgacttcacagatgttcagtgccattgctgcggtgacaggccaaggacagaaccctaatgccaccccagcccagtgggcctccagccagtacggctatggcggcagtggaggcggcagcagtgcttaccacgtattcccaacgccagcccagcagccagtggccacaccactaatgacccctagctactcctacacgaccccaagccagcccatcaccacccctcagtaccaccagctccaggccagcaccaccccacagtcggcccaggcccagccccagccctcttccagctcccggcaacggcagcagcagccaaagtccaacagccatgcagccatcgactggggaaaaatggcggagcagtggctgcaggaaaaggaggcagaacggcggaaacagaagcagcggctgacacctcggccctcccccagccccatgatcgaaagcacccccatgtccattgctggcgatgccaccccactcctggacgagatggatcggtagggggcctgctcctcggactctggttacctctgaggctgggaaaggcctggctgcccactgcctccctccctgcccctccttttatgtccataaagtggcgtgaagtgagacgttctctttggtggtcaacccggatgggtgacaggctggatggccttgtgaacttgagctcagtgtatgctaggcaacaattctcccgctccagaccctcaccgaccacctgtcctgggaccaggctgggaggggagtgtggcagggaggaggaagaggaaggtgagaatgagtagaacagttttgtattctactccctacaagccattttgaacttctgccctcaccggactctgggctgtgactggggcaccaaactcagcacatgagtctcccctagctctcgtggggagagggatgctatttattcagtttggggcaggagggagaggagggaaagtatttctgaccctgatgccaacagccgggtggctgtccaagcaggattgcaggggacacagggaagcactgcccagcccctgcctggctgccctttcccccctgctgctgccaccgcttcctgcctgtcatttgaataaacagtgtttctattgaaaaaaaaaaaaaaaaaaaa

SEQ ID NO: 990 - DNA, 1782 bp, Homo sapiens
gttttggcgtccgtttgctgcggtaggaacatggcggatcggctcacgcagcttcaggacgctgtgaattcgcttgcagatcagttttgtaatgccattggagtattgcagcaatgtggtcctcctgcctctttcaataatattcagacagcaattaacaaagaccagccagctaaccctacagaagagtatgcccagctttttgcagcactgattgcacgaacagcaaaagacattgatgttttgatagattccttacccagtgaagaatctacagctgctttacaggctgctagcttgtataagctagaagaagaaaaccatgaagctgctacatgtctggaggatgttgtttatcgaggagacatgcttctggagaagatacaaagcgcacttgctgatattgcacagtcacagctgaagacaagaagtggtacccatagccagtctcttccagactcatagcatcagtggataccatgtggctgagaaaagaactgtttgagtgccattaagaattctgcatcagacttagatacaagccttaccaacaattacagaaacattaaacactatgacacattacctttttagctatttttaatagtcttctattttcactcttgataagcttataaaatcatgattgaatcagctttaaagcatcataccatcattttttaactgagtgaaattattaaggcatgtaatacattaatgaacataatataaggaaacatatgtaaaattctgttatgacataatttatgtctccattttgttgtattggccagtacttttacaaatcaaaacatctctcaagccaaaggagaagacagtaagaacagacataagggacattttagtttaggctagtgtcctgcctcttagaggtggcattgtgtaaatctgagctttgagcaagaaagttttggaaattgtgttgcttttaagaaatagagttagtgtggctggataagaaagtcacatttatgcaaatgtttcttctgctagaacctcatacctgttctagttcatctccacgtttattttaccaagagatcctctgtcaagagaatttcctggctgttgtgaaagaatttttctacatcctgaactatttttcctatttcttttcaccttgctttttttcatccttaatttgcttgtcatcacaatgaagtatgttttttgaatcatcaattctttctcattctccatttatctgaaggttcttttgcccttattaacctctcaacttttattgctgtattctagtcagaccagaacatacttccactacatcagttacttggcatcatttcacctcagtttattattgccaaataataatttgtgtcagcattttcaactatggttattcatccaacccttggatctctttgagtctactgataatctccactggaaaggtggaattgaaatgtggtccacattttaactagctatttcctggggctgtatttttcagaatatgctgagctacatttgctgcaatctgttgctattcagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcaggaaaaaaaaaaaaaaaaaaaaaaaaaaaa

SEQ ID NO: 991 - DNA, 2745 bp, Homo sapiens
ctcgcgaggccggctaggcccgaatgtcgttagccgtggggaaagatggcggaaaatttaaaaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagttgtgaccccaacctgcaggtgtacaacgtcttcatagacaaccttgacgagcggctgccccgcatcgctttctttgccacaagaaccatccgggcaggcgaggagctcacctttgattacaacatgcaagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaacaaaaaaaaaaaaaaaaaa

SEQ ID NO: 992 - DNA, 3399 bp, Homo sapiens
gcattctaatccgtttcacacacggtgctgctacctcgtttgcttcgtgcgtgcgtgcgcgcgcagatgtgggccccgcgggagcagctactgggctggactgcggaagctctgcctgccaaggattctgcctggccctgggaagagaagcctagatatctgggaccagtgactttcgaggatgtggctgtgcttttcactgaggcagagtggaagagactgagccttgagcagaggaacctatacaaagaagtgatgctggaaaatctcaggaatctggtctcattggcagaatcaaagccagaagtccatacctgcccttcttgccctctggcctttggcagtcagcagttcctcagccaagatgagctacacaatcatcctattccaggtttccatgcaggaaatcaactccacccaggaaatccctgcccagaggatcagccacagtcacaacatccttctgataaaaatcacaggggggctgaagcagaagatcaacgagtggaaggaggcgtcagacccttgttttggagtacaaatgaaaggggggctttagtgggtttctctagcctgttccagagaccaccaataagctcttggggaggcaacagaatattagagatacagctcagtccagcccagaatgcaagctctgaggaagtagacagaatttccaagagggcagaaaccccagggtttggagcagtcacgtttggggagtgtgcactagcttttaaccagaagtcaaacctgttcagacagaaggcagtcacagcagaaaaatcttcagacaaaaggcagtcacaggtgtgcagggagtgtgggcgaggctttagcaggaagtcacagctcatcatacaccagaggacacacacaggagaaaagccttatgtctgcggagagtgtgggcgaggctttatagttgagtcagtcctccgcaaccacctgagtacacactccggggagaaaccttatgtgtgcagccattgtgggcgaggctttagctgcaagccatacctcatcagacatcagaggacacacacaagggagaaatcgtttatgtgcacagtgtgtgggcgaggctttcgtgaaaagtcagagctcattaagcaccagagaattcacacgggggataagccttatgtgtgcagagattgaggccgaggctttgtaaggagatcatgtctcaacacacaccagaggatacattcagatgagaagccttttgtttgcagagagtgtgggcgaggctttcgtgctaaatcaactctcctcctacaccagtggacacattcagaggtgaaacctcacgtgtgtgaggagtgtgggcatggatttagccagaagtcgtcgctcaaatcacatcggagaacacactcaggggagaagccttatgtgtgtggggaatgtgggcggggatttagccggaggatagtcctcaatggacactggaggacacacacgggagagaagccttacacgtgctttgagtgtgggcgaaactttagcctcaagtccgctcttagtgtacatcagaggatacactctggggagaagccttatgcatgcacggagtgtgggcaaggctttatcacgaaatcacagctcatcagacaccagaggacacacacaggagaaaagccttatgtctgcggagagtgtgggcgaggctttatagctcagtcaaccctccactaccaccggagtacacactccaaggaaaaaccttatgtgtgcagccagtgtgggcgaggcttttgtgataaatcaactctcctcgcacacgagcagacacattcaggggagaagccttatgtgtgtggggaatgtgggcggggatttggccggaagatactcctcaacagacactggaggacacacacaggagagaaaccttacgcatgcatcgagtgtgggcgaaactttagccacaagtccactctcagcttacatcagaggatacactcgggggagaagccttatgcatgcgtggagtgtgggcaaagctttaggagaaagtcacagctcatcatacaccagaagatacactcggggaaaagctttagaggtgcaaggagtgaggatgtgattttagcaacaagtcagccatcagccacaccagcggaaatgcttagggagaagccttgtttgtaaggtaatgtggacagagctgtacgtggacatcattacttgtcacgtgtcagaggacacactcgggagaaaccttcatggagtgagagtaaggtgttggctggaagtggccccttaagagatacttggagtcaaatctatccactgtacgcccaccccactcttgttctaagagctttggggacagtcttttgaccccttacattcctttagatgtgaagatgacagagatctaacttctgagagcagaggtgtcaagtgacggtccccttggaggaatggtctttgcatctgactacttccttctgcaactgtgttcttccattagcttccatgacactctcctgctttatttttttctacatctctagcctttgctgtttcctctcctaccccacctttagattttactcagagttcagtctccagccctacaatctgagggacacctttaccaggtccccttcctaaccctccagtcccaaatccaagattctttaaccacactctaaaagttcttcagactcaggacttaaacatagccacgccaccttggccttcaatgacagggatctagcaatgctgcatcatcagccttccaataccaggtttaagggtattttaaacacagctcctcttaaatcctccaatctcagtacccagtgttttagccatgctcgggtggctaaattacatccaggaatggtgccagggcctttagccatttgtctctcctcacactccagggcccatatggcccaggttctgacagtttgccttactcccttgggctggggctagccctacctgataccctgtgtcaatgagtgtaccttggagagctatccactcaggccccagtgcctctatttgctaagggactctgccacagaaaagaaggggagagatgttcatgtaacctcaaaatacttaggcttggttttgatgctagagaggaaaaaggacttggagagagagaaggaatggctggtccagaggcttttgtccactccctctcactggaagtggttgatctccagggaatccccaaggttagcctgcttaggggaagggctaggggtacctggaatgtaggatctcccccatgcctggcctaccaccctaatgtgtctggaattggtgggttcttggtcttgctgacttcaagaatgaagccgtggaccctcacggtgagtgttacaattcttaaaaaaaaaaaaaaaaaaaaaaaaaaaaaaaaaaaaa

SEQ ID NO: 993 - DNA, 6210 bp, Homo sapiens
ggtgctagaagtcggaccggaagtggaagtggtccccgaaggctatttcgccgctggcgtcaggactattttcacgttttaatgccgagaggtctctgtgacgattttggttcttgggtgtctctggggagtccctgggccagaccttcctccagactccagcccacctcttcggagcagctctgctgagttcacagatgaccactaaacttcaggcaccctagacaaaaagggttgagatccagtgtggccatgccagctagttggacctcaccccagaaatcctcagccctggctccagaggatcatggcagctcctatgagggatcagtgtccttcagggatgtggctatcgatttcagcagagaggaatggcggcacctggacctttctcagagaaacctgtaccgggatgtgatgctggagacctacagccacctgctctcagtagggtatcaagttcctaaaccagaggtggtcatgttggagcaaggaaaggaaccatgggcactgcagggtgagaggccacgtcacagctgcccaggagagaaattatgggaccataatcaacatagaaaaatcatcggttataaaccagcttcctctcaagatcaaaaaatttattctggggaaaaatcctatgagtgtgctgaatttggaaagagcttcacctggaagtcacagttcaaggtacatctgaaagttcctacaggagaaaaactctatgtatgtattgaatgtgggagggcttttgtacagaagccagaattcatcacacatcagaaaacccatatgagagagaagccctataagtgcaatgaatgtggaaaatccttttttcaagtatcgtctcttttcaggcatcacagaattcataccggagaaaaactatatgaatgtagtgaatgtgggaaaggtttcccttataactcagatctcagtatacatgagaaaattcatactggagagagacaccatgaatgcactgactgtggcaaagcgttcacacaaaagtccacactcaagattcatcagaaaatccatacaggcgagagatcctacatctgtattgaatgcgggcaggccttcatccagaaaacacaattgattgcacaccgaagaattcatagtggagaaaaaccatatgaatgcaataactgtggcaaatccttcatttccaagtcacaacttcaggtacatcaacgtgttcacacaagagtgaagccctatatatgtaccgaatatgggaaggtcttcagcaataattccaacctcattacacatgagaagattcaaagtagagagaaatcttccatatgtactgagtgtgggaaggcctttacctacaggtcagagttgattattcatcagagaattcacactggagagaaaccttatgaatgcagtgactgtgggagagccttcactcagaagtcagcactcacagtgcatcagagaattcatacaggagaaaaatcgtatatatgcatgaaatgtggactggccttcatccggaaggcacacttgattacacatcaaataattcatactggagagaaaccttataaatgtggtcactgtgggaaattgtttacttccaagtcacaactccatgttcataaacgaattcacacaggagaaaagccctatgtatgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagcctttactcagaagtcaaatcttaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgtgggaaagcctttagtggcaggtcaaatctcagtaagcaccagaaaactcataccggagaaaagccctacatttgttctgaatgtgggaagacctttcgacagaagtcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttagcaacaggtccaatttgaataaacatcagacaacacacactggagacaaaccctacaagtgtggcatctgtgggaaaggcttcgttcagaaatcagtgttcagtgttcatcagagcagccacgcttgagagaaacagtgtgagaaaacccccctgagggttgggtctgattgtacactgttgcacgcatgcagcagaaaaatatgtatattattgtaaatagaaatgaccacatcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcataagaaagatcatattatgggaatgataatcctgtttactgtggattaggtatagtgccaacagtttgaatggtaagacaacataatatatatgatagtgatgaatccttctgtgagttgtttgttccagaacacactgtctagtagaattgtgggtattttcttcttttgaatcgaacacagttgtgcatatccaattccccattgagtatttctatcaagcaagagatactgcaataagacaaactccctgtgtattcagacacagacctcagagcgtatgttgagtccccattgtcatagaaaaagacttacagtccccttcattatctgccaggactctctctgagccccacaggttctcagcacattgtgtttgacacccagcacagtgttttttctttttctttctttctttctctttctttctttctttctttctttctttctttctttctttctttctttctttctttctttccttctttctttctttttctttctttctctttctttctttctttctttctttctttctttctttctttctttctttctttctttctttttttgagacagagtcttgctctgtcgggcaagctagagtgcagtggcgctatcttggctcactgcaacctccgtctcccgggctcaagcaattctcctgcctcagcctcctgagtagctgggattgcgtgtgccaccacgcccagctaatttttgtatgtttagtagaaacgggggtttcaccatgctggccaggctggtctcgaactcctgacctcatgatccgcccgcctcggcctcccaaagtcctgggattacggacgtgagccactgcgcccggcccagcacagtgttttgtacactcccaccaccctcaagaaagcctttgaggttaggattttcaggtcatctgggagaacttaaattcttccttctgctattacaattcttctcactcagttgcctgcctcttttttttttttaatttacttgtgactgagttgaagcccagcattttactttccttaatgatctgactttcataagttgataagtcatgaaatcattatcttacattatatgagatatgagataaatcataaatcatatgaaattgataactcatatgaaaaccaaccccaccatatgttcactgtctacttgtgtccatcttcgtcccacgcaccccacaaggaccttccccgccatgtgcctcaaacatcagttcctgactcagggcctttgtatttgcagtgcccgttgcaaagagcacaattctttattttatctgtggcttgtccgtcatgtctttttttccatgacacctccacacaggccttccctgcctgcctggtttaaaattccagccccttacccttcctcctttattcttctccctagcaatttccaccatgctgcctggtgtattttcctcatttctctgtggcttctacactagaaaatatttcccttttgttcaccactatgagtctagacccatgactgccatacagcaggcattccataaatgcacctgtggagagttgacccatgcttgttgcgtgacttctgtctgatttttttctgtgttgcagcataagaagcgctaatagggagaaccaacttggctaaaacacaccaggctttttcacctctagtctgtacctgggctgtatcccttctcaaccctaaagctaaaaagtcattgtgaaccttttggtctgatgctaaagaagggaaaacaggtacaggaaatcccatgtggatgcttgcttccaggatttcctgccatgattccagaatcccacagctccaacatgattgcaaaagactccctgctcatttttcctcagcatgcacagcgctgtcctgtctcagttgcaactcgacagagccgcatttactccagaacccaatccacacacctgctcatcctgccccgagaggagtgcctgaagccaatagcagggaactagagcagacttgggtggatcttcattggatattaggtatcttgccctagataggcagcagtggccttacagatgctgacagatgatctgattagatgcacagttgctgggtggcgtctggggccagtctattggcagttctgggagtgggaactatttgggctctgcaaagatggtttcacctttaagaagggcagtatggggaggtgaagatggggcccaaaggatagaacatagtcaaagaagcagggccacaatgcccctttaattcccaagccctagttgggcagtgcttggtgacacatcccattacctcaccttagatcaatgtctactgagccatcattagctctgcttcctcacttcttcacagtatctgatggcccatcacatgctgctcaacatcttagaccaatgtctgctcacccattacctcccttcacctcatccagcactgtatctgaagcttcactattcttccttcagttttggatattttgtgatacaacattatccccaacttaggacaatgtcagctgactctcaggagggtgcctggagatcacctcttccttcctaacataccctagaacaaggtctggtccccttcattattcccattttaccttactcctaagtgtatcactcctcatgaattccaggaaatatggaggaaaacacatttcactgtacatgactttcaataatttctcctttatatttattgtaacgtgatattttagtgctgacatatatatgtatatgtatgcccatttatataaaagactagtttttagagaaattttaggttcacagcaaaatggggcagaaggtacagagatttcccatatatcccctaccctcacatatacacagcctcccccatcatcaacatcccccttcagagtggtacatttgttacaattgatgaaactacattgacactatcggccaaagtccatggtttaattagggttcagtcttgatgtgcattctgtgggttgagacaaatgaataatgacatgtatgcattattacagaaggataaagagccgtttcactgtcccaataatcctctgtgtttcgcctactcctctaaactcctggctattttcttttgtctccataattttgcctctgaaccataaagtatgcagccttttcagattgatttgtttcacttagtaatgtggatttaagtttcttccatgtcttttcgtagcttgctagctcttttttttttttttttctcattgaataatatgctattgtctggaagtaccatgacttatttatccattcacctactgaaggacaccttaattgcttccaagttttgttgattatgaataaagatgctataaaca

SEQ ID NO: 994 - DNA, 2518 bp, Homo sapiens
tttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactgcggcgagacgagcgcggcgcatcccaaagcccggccaaatgcgctcgtccctgggaggggagggaggcgcgcctggagcggggacagtcttggtccgcgccctcctcccgggtctgtgccgggacccgggacccgggagccgtcgcaggtctcggtccaaggggccccttttctcggaagggcggcggccaagagcagggaaggtggatctcaggtagcgagtctgggcttcggggacggcggggaggggagccggacgggaggatgagctcccctggcaccgagagcgcgggaaagagcctgcagtaccgagtggaccacctgctgagcgccgtggagaatgagctgcaggcgggcagcgagaagggcgaccccacagagcgcgaactgcgcgtgggcctggaggagagcgagctgtggctgcgcttcaaggagctcaccaatgagatgatcgtgaccaagaacggcaggaggatgtttccggtgctgaaggtgaacgtgtctggcctggaccccaacgccatgtactccttcctgctggacttcgtggcggcggacaaccaccgctggaagtacgtgaacggggaatgggtgccggggggcaagccggagccgcaggcgcccagctgcgtctacatccaccccgactcgcccaacttcggggcccactggatgaaggctcccgtctccttcagcaaagtcaagctcaccaacaagctcaacggagggggccagatcatgctgaactccttgcataagtatgagcctcgaatccacatagtgagagttgggggtccacagcgcatgatcaccagccactgcttccctgagacccagttcatagcggtgactgcttatcagaacgaggagatcacagctcttaaaattaagtacaatccatttgcaaaagctttccttgatgcaaaggaaagaagtgatcacaaagagatgatggaggaacccggagacagccagcaacctgggtactcccaatgggggtggcttcttcctggaaccagcaccctgtgtccacctgcaaatcctcatcctcagtttggaggtgccctctccctcccctccacgcacagctgtgacaggtacccaaccctgaggagccaccggtcctcaccctaccccagcccctatgctcatcggaacaattctccaacctattctgacaactcacctgcatgtttatccatgctgcaatcccatgacaattggtccagccttggaatgcctgcccatcccagcatgctccccgtgagccacaatgccagcccacctaccagctccagtcagtaccccagcctgtggtctgtgagcaacggcgccgtcaccccgggctcccaggcagcagccgtgtccaacgggctgggggcccagttcttccggggctcccccgcgcactacacacccctcacccatccggtctcggcgccctcttcctcgggatccccactgtacgaaggggcggccgcggccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagcggtgctgtcccaggtggcttacagatgaacccaactgtggagatgatgcagttggcccaacctcactgacggtgaaaaaatgtttgccagggtccagaaactttttttggtttatttctcatacagtgtattggcaactttggcacaccagaatttgtaaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcaaaataaacgcaatatgcaaaatgtgattcgtccagttattagtgaagcccctccttttgtgagtatttactgtttattg

SEQ ID NO: 995 - DNA, 1886 bp, Homo sapiens
tttcccgctcagccctggagcgcgtagctctaccaagaatggccactgtgccagatgcccctgaccagcgttgcccatttgaatttcctagcaggccccccaaagtaggtatttcagtaccctgttagagctgaggcgcaggtaaaatgactggcccaggccggtcccaccccgtaaggatttgaacgttggctccacaactcgggagcctgcgcctttcctcctcccaacgtggactcctgcccggcgaagtgcctcacttccttctcccgggagtcatcaagctttggtgtatgtgttggccggttctgaagtcttgaagaagctctgctgaggaagaccaaagcagcactcgttgccaattagggaatggaccgtttgggtccctttagcaatgatccctctgataagccaccttgccgaggctgctcctcctacctcatggagccttatatcaagtgtgctgaatgtgggccacctccttttttcctctgcttgcagtgtttcactcgaggctttgagtacaagaaacatcaaagcgatcatacttatgaaataatgacttcagattttcctgtccttgatcccagctggactgctcaagaagaaatggcccttttagaagctgtgatggactgtggctttggaaattggcaggatgtagccaatcaaatgtgcaccaagaccaaggaggagtgtgagaagcactatatgaagcatttcatcaataaccctctgtttgcatctaccctgctgaacctgaaacaagcagaggaagcaaaaactgctgacacagccattccatttcactctacagatgaccctccccgacctacctttgactccttgctttctcgggacatggccgggtacatgccagctcgagcagatttcattgaggaatttgacaattatgcagaatgggacttgagagacattgattttgttgaagatgactcggacattttacatgctctgaagatggctgtggtagatatctatcattccaggttaaaggagagacaaagacgaaaaaaaattataagagaccatggattaatcaaccttagaaagtttcaattaatggaacggcggtatcccaaggaggtccaggacctgtatgaaacaatgaggcgatttgcaagaattgtggggccagtggaacatgacaaattcattgaaagccatgcattggaatttgaactccgaagggaaatcaagaggctccaagaatacaggacagcaggcattaccaatttttgtagtgccagaacctacgatcacctcaagaagacacgggaggaagagcgccttaaacgcactatgctctcagaagttctccagtatatccaggacagtagtgcttgccagcagtggctccgccggcaagctgacattgattccggcctgagtccttccattccaatggcttcgaattcaggtagacggagtgcaccacccttgaacctcactggcctccctggcacagagaagctgaatgaaaaagaaaaggagctctgtcagatggtgaggttggtccctggagcctatttagaatacaaatctgctctattgaacgaatgtaacaagcaaggaggcttaagactggcgcaggcaagagcactcatcaagatagatgtgaacaaaacccggaaaatctatgatttcctcatcagagaaggatacatcactaaaggctaaggctccaagagcttgggatcagaagtcagaagtttggaatgtggtgggtcaaaggacaatatgggtgggcattctggagagttgtttttcagctgaattctcatggtgaaaacaggggaaaggacaaaggaaaccttaaaaaaaaaaaaaaaaaaaaaaaaaaaaaaaaaaaaaaaaaaaaaaaa

SEQ ID NO: 996 - DNA, 2245 bp, Homo sapiens
gtacccccatcctttctctcgcccctcctacccgcagctcctggcgctcggcggggctaactgcagcgcggagatctcggccgccaagctccgcctcccgccccgggctgtgccccggggctcgcctgaggccgaccacccgcaccccacctctagcggctttgctcgaggcccaccttcttcccacccccggcaaactccagtaggctcgccctcgctgactccccgcccccgcgtcaactgcaaggggcccgcccatagccagttccggggcggttgctcacatcgaccggaactccccgccccctcccgcggcccctggggccgtaggaggccgcagcgaggaggtagagggggcgggggtcgcactagggtgtccctagagaacgaggactctgaaggcgggacatttgggcgacccccgggcggggccagccattaaacagtcccacttctgtgccagacactgaactgggctcttgacgggcatcatctcttaatcctcagaacatcccagggagctccacaggatccccatatcctgggccatgagtgagttgaaagactgccccttgcagttccacgacttcaagtctgtggatcacctgaaggtctgtccccgctacacggcagtgctggcacgctctgaggatgatggcatcggcatcgaggagctggacaccctgcagctggagctggagaccctgctgtcttctgccagccggcgcctgcgtgtgcttgaggccgaaacccagatcctcaccgactggcaggataagaaaggtgacagacgattcctgaagctgggtcgagaccatgaacttggagctccccccaaacatgggaagcccaagaagcagaaactggaagggaaggcaggacatgggccgggccctggcccaggacggcccaaatccaaaaaccttcagcccaagatccaggaatatgaattcactgatgaccctatcgacgtgccacggatccccaaaaatgatgcccccaacaggttctgggcttcagtggagccctactgtgctgacatcaccagcgaggaggtccgcacacttgaggagttactgaagcccccagaagatgaggctgagcattacaagatcccacccctggggaagcactactcccagcgctgggcccaggaggacctgctggaggagcagaaggatggggcccgggcagcggctgtggctgacaagaagaaaggcctcatggggccactgaccgaactggacactaaagatgtggatgccctgctgaagaagtctgaggcccagcatgaacagccggaagatggatgcccctttggtgccctgacgcagcgcctcctgcaggccctggtggaggaaaatattatttcccctatggaggattctcctattcctgacatgtctgggaaagaatcaggggctgacggggcaagcacctcccctcgcaatcagaacaagcccttcagtgtgccgcatactaagtccctggagagccgcatcaaggaggagctaattgcccagggccttttggagtctgaggaccgccccgcagaggactccgaggatgaggtccttgctgagcttcgcaaacggcaggctgagctgaaggcacttagtgcccacaaccgcaccaagaagcacgacctgctgaggctggcaaaggaggaggtgagccggcaggagctgaggcagcgggtgcgcatggctgacaacgaggtcatggacgcctttcgcaagatcatggctgcccggcagaagaagcggactcccaccaagaaagaaaaggaccaggcctggaagactctgaaggagcgtgagagcatcctgaagctgctggatgggtagccctcacccctgcctcaggctgattatctggcctaggggaggggaagggaggcccacttccttctttgggcacaggaaacattggcctgtggctgtccctcaaatggcggcagtctctagagggccgtggcccttcccctgaggtcttttggcctagctctgtacaaccaggacacaggaagccctgctgggctagcctgaggcctagtctctgcttggtccccgagatggggttggaggggacttcgtttctgggtcttcctcttcccctctttaccatcccccactccctaatcccctacccctgtctccccttcaaggacttctcccttgtggttttgtaaagtgcaaacttaagaataaagtgactgctgtggtttttcaaaaaaaaaaaaaaa

SEQ ID NO: 997 - DNA, 7709 bp, Homo sapiens
aagggagctcagtaagtcacttctgggcgactgttgttttatttccggtctatgggacccggctgcgatttgctgctgcggacagcagctaccatcactgctgccgccatcatgtcagacacggacagcgacgaagattccgctggaggcggcccattttctttagcgggtttccttttcggcaacatcaatggagccgggcagctggagggggaaagcgtcttggatgatgaatgtaagaagcacttggcaggcttgggggctttggggctgggcagcctgatcactgaactcacggcaaatgaagaattgaccgggactgacggtgccttggtaaatgatgaagggtgggttaggagtacagaagatgctgtggactattcagacatcaatgaggtggcagaagatgaaagccgaagataccagcagacgatggggagcttgcagcccctttgccactcagattatgatgaagatgactatgatgctgattgtgaagacattgattgcaagttgatgcctcctccacctccacccccgggaccaatgaagaaggataaggaccaggattctattactggtgtgtctgaaaatggagaaggcatcatcttgccctccatcattgccccttcctctttggcctcagagaaagtggacttcagtagttcctctgactcagaatctgagatgggacctcaggaagcaacacaggcagaatctgaagatggaaagctgacccttccattggctgggattatgcagcatgatgccaccaagctgttgccaagtgtcacagaactttttccagaatttcgacctggaaaggtgttacgttttctacgtctttttggaccagggaagaatgtcccatctgtttggcggagtgctcggagaaagaggaagaagaagcaccgtgagctgatacaggaagagcagatccaggaggtggagtgctcagtagaatcagaagtcagccagaagtctttgtggaactacgactacgctccaccaccacctccagagcagtgtctctctgatgatgaaatcacgatgatggctcctgtggagtccaaattttcccaatcaactggagatatagataaagtgacagataccaaaccaagagtggctgagtggcgttatgggcctgcccgactgtggtatgatatgctgggtgtccctgaagatggcagtgggtttgactatggcttcaaactgagaaagacagaacatgaacctgtgataaaatctagaatgatagaggaatttaggaaacttgaggaaaacaatggcactgatcttctggctgatgaaaacttcctgatggtgacacagctgcattgggaggatgatatcatctgggatggggaggatgtcaaacacaaagggacaaaacctcagcgtgcaagcctggcaggctggcttccttctagcatgactaggaatgcgatggcttacaatgttcagcaaggttttgcagccactcttgatgatgacaaaccttggtactccatttttcccattgacaatgaggatctggtatatggacgctgggaggacaatatcatttgggatgctcaggccatgccccggctgttggaacctcctgttttgacacttgatcccaatgatgagaacctcattttggaaattcctgatgagaaggaagaggccacctctaactccccctccaaggagagtaagaaggaatcatctctgaagaagagtcgaattctcttagggaaaacaggagtcatcaaggaggaaccacagcagaacatgtctcagccagaagtgaaagatccatggaatctctccaatgatgagtattattatcccaagcaacagggtcttcgaggcacctttggagggaatattatccagcattcaattcctgctgtggaattacggcagcccttctttcccacccacatggggcccatcaaactccggcagttccatcgcccacctctgaaaaagtactcatttggtgcactttctcagccaggtccccactcagtccaacctttgctaaagcacatcaaaaaaaaggccaagatgagagaacaagagaggcaagcttcaggtggtggagagatgttttttatgcgcacacctcaggacctcacaggcaaagatggtgatcttattcttgcagaatatagtgaggaaaatggacccttaatgatgcaggttggcatggcaaccaagataaagaactattataaacggaaacctggaaaagatcctggagcaccagattgtaaatatggggaaactgtttactgccatacatctcctttcctgggttctctccatcctggccaattgctgcaagcatttgagaacaacctttttcgtgctccaatttatcttcataagatgccagaaactgatttcttgatcattcggacaagacagggttactatattcgggaattagtggatatttttgtggttggccagcagtgtcccttgtttgaagttcctgggcctaactccaaaagggccaatacgcatattcgagactttctacaggtttttatttaccgccttttctggaaaagtaaagatcggccacggaggatacgaatggaagatataaaaaaagcctttccttcccattcagaaagcagcatccggaagaggctaaagctctgcgctgacttcaaacgcacagggatggactcaaactggtgggtgcttaagtctgattttcgtttaccaacggaagaagagatcagagctatggtgtcaccagagcagtgctgtgcttattatagcatgatagctgcagagcaacgactgaaggatgctggctatggtgagaaatccttttttgctccagaagaagaaaatgaggaagatttccagatgaagattgatgatgaagttcgcactgccccttggaacaccacaagggccttcattgctgccatgaagggcaagtgtctgctagaggtgactggggtggcagatcccacggggtgtggtgaaggattctcctatgtgaagattccaaacaaaccaacacagcagaaggatgataaagaaccgcagccagtgaagaagacagtgacaggaacagatgcagaccttcgtcgcctttccctgaaaaatgccaagcaacttctacgtaaatttggtgtgcctgaggaagagattaaaaagttgtcccgctgggaagtgattgatgtggtgcgcacaatgtcaacagaacaggctcgttctggagaggggcccatgagtaaatttgcccgtggatcaaggttttctgtggctgagcatcaagagcgttacaaagaggaatgtcagcgcatctttgacctacagaacaaggttctgtcatcaactgaagtcttatcaactgacacagacagcagctcagctgaagatagtgactttgaagaaatgggaaagaacattgagaacatgttgcagaacaagaaaaccagctctcagctttcacgtgaacgggaggaacaggagcggaaggaactacagcgaatgctactggcagcaggctcagcagcatccggaaacaatcacagagatgatgacacagcttccgtgactagccttaactcttctgccactggacgctgtctcaagatttatcgcacgtttcgagatgaagaggggaaagagtatgttcgctgtgagacagtccgaaaaccagctgtcattgatgcctatgtgcgcatacggactacaaaagatgaggaattcattcgaaaatttgccctttttgatgaacaacatcgggaagagatgcgaaaagaacggcggaggattcaagagcaactgaggcggcttaagaggaaccaggaaaaggagaagcttaagggtcctcctgagaagaagcccaagaaaatgaaggagcgtcctgacctaaaactgaaatgtggggcatgtggtgccattggacacatgaggactaacaaattctgccccctctattatcaaacaaatgcgccaccttccaaccctgttgccatgacagaagaacaggaggaggagttggaaaagacagtcattcataatgataatgaagaacttatcaaggttgaagggaccaaaattgtcttggggaaacagctaattgagagtgcggatgaggttcgcagaaaatctctggttctcaagtttcctaaacagcagcttcctccaaagaagaaacggcgagttggaaccactgttcactgtgactatttgaatagacctcataagtccatccaccggcgccgcacagaccctatggtgacgctgtcgtccatcttggagtctatcatcaatgacatgagagatcttccaaatacataccctttccacactccagtcaatgcaaaggttgtaaaggactactacaaaatcatcactcggccaatggacctacaaacactccgcgaaaacgtgcgtaaacgcctctacccatctcgggaagagttcagagagcatctggagctaattgtgaaaaatagtgcaacctacaatgggccaaaacactcattgactcagatctctcaatccatgctggatctctgtgatgaaaaactcaaagagaaagaagacaaattagctcgcttagagaaagctatcaaccccttgctggatgatgatgaccaagtggcgttttctttcattctggacaacattgtcacccagaaaatgatggcagttccagattcttggccatttcatcacccagttaataagaaatttgttccagattattacaaagtgattgtcaatccaatggatttagagaccatacgtaagaacatctccaagcacaagtatcagagtcgggagagctttctggatgatgtaaaccttattctggccaacagtgttaagtataatggacctgagagtcagtatactaagactgcccaggagattgtgaacgtctgttaccagacattgactgagtatgatgaacatttgactcaacttgagaaggatatttgtactgctaaagaagcagctttggaggaagcagaattagaaagcctggacccaatgaccccagggccctacacgcctcagcctcctgatttgtatgataccaacacatccctcagtatgtctcgagatgcctctgtatttcaagatgagagcaatatgtctgtcttggatattcccagtgccactccagaaaagcaggtaacacaggaaggtgaagatggagatggtgatcttgcagatgaagaggaaggaactgtacaacagcctcaagccagtgtcctgtatgaggatttgcttatgtctgaaggagaagatgatgaggaagatgctgggagtgatgaagaaggagacaatcctttctctgctatccagctgagtgaaagtggaagtgactctgatgtgggatctggtggaataagacccaaacaaccccgcatgcttcaggagaacacaaggatggacatggaaaatgaagaaagcatgatgtcctatgagggagacggtggggaggcttcccatggtttggaggatagcaacatcagttatgggagctatgaggagcctgatcccaagtcgaacacccaagacacaagcttcagcagcatcggtgggtatgaggtatcagaggaggaagaagatgaggaggaggaagagcagcgctctgggccgagcgtactaagccaggtccacctgtcagaggacgaggaggacagtgaggatttccactccattgctggggacagtgacttggactctgatgaatgaggcttcctttgggcctccttggtcagccttccctgttctccagcctaggtggttcacctttccccaatttgttcatatttgtacagtatctgatcctgaaatcatgaaattaactaacaccttagcctttttaaaagtagtaagtaaatgataataaatcacctctcctaatcttcctggggcaatgtcaccctttgatttaaaacaaagcaaccccctttcccctaccactacggaaaagagcaagctcatttttccgtgtcctcctttatttaactccatttattgcttttggtataatttttccctggggaaggaggggaaattatgaaagaactagtaactttatgtcctcttgatgtattaggaaatttccggccaggcgtggtggctcacacctgtaatctcagcactctgggaggccgaggcgggcagatcacctgaggtcagaagttcgagaccagcttggccaacatggcgaaaccgcatctctactaaaaatacaaaaattagccaggtgtggtggcgtatgcctgttaatcctagctactcgggaggctgaggcaggagaattacttgaacccgggaggcagaggttgcagtgagtggaggtcacgccactgcactccagcctgggcgaaagagtgagattcagtctcaaaaaaaaaaaaatttccaagcatggtatcatctcacttttctaatttacaggctggagcagatgagagccctcctgctgggacagagaattgggttctagtggactctgtgctacacttaaacctgtgagacaaaccgcccattattttattatttaattatgcaatgcctagttcctaaatggattggaggcaaattaccgtaaattttgaaacagcctatatgtcagaaatgataatgttgccacctaaatgttttctgtcccccccaccctccccaggggaaatggtaggaaaatggtaagtttcttagggcaaagactgtgtcttctgtttcttttcatgcttaggatatggttctgtgcatagtaggtactcagtaaatgttcctagaatcataaaatcctcaacagatatgttactgagcatctgcttttcatgataagcactctatcagatccttgggatgcaaaggtaaataagacaaatcccttttacccaaagagctcaccatcaagttgggggagggaaagtggaattcaaaacatgttaataaatcatcatagtactgtgagataagtgcaattaagaagctagttataaagtataggggaaatagaggagtaatcatgtctgaaaagtcaggaaagtcttcctagaggtaatttttaagctgattgttttagaattagtagaagcttgccagatggaaaagtccaggcaaagtgtaacatgaatgggaaaggccacagtctagaaatggcagagtgtgttcctagtttgtttgtttgtttgtttgtacctgccttgttccaggaaggatttaatgtggtttatattccagtcctttaatgctggaagggctgagatgagactgaaagatgggcaggaagtatatcatcacaagctttgtgtttgatgttaatgtgtatgatttttatattatgggaaataagctcttagaggagtgatataatcaggtttgtgttttagaaatctgtgtaatgaatgaatgaagaaagaaattgaagaatcatgtaacatatgtgatcgcatttttgtaaaagaaccatgtgtgtttatatgtgtttatatatatacttgtgtatgcaaaggtaaaagtctgaaaggatatatgctaactgttcacaatgataaccccccaggaatgggattggaggggagggggcttctgtgtttgttatgtatgctgggtgggatattgtgcttttatttctatattgtttgaatttttttacagtatgtattatttttgtaataaaaattttaaaaaattccaaaaaaaaaaaaaaaaaa

SEQ ID NO: 998 - DNA, 762 bp, Homo sapiens
gttcgccgcctctcccaccggcccgatgagctgcagcggctccggcgcggaccccgaggcggcgccggcctccgccgcctcggccccgggccccgcgcccccggtctcggctcccgccgcgctgccctccagcaccgccgcggagaacaaggccagccccgcggggacagcggggggacctggggctggagcagctgctgggggcacgggacccttggcggcgcgggccggggagccagctgagcggcgtggggcggctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacgatcccagatgcagtgactggttactacctgaaccgtgctggctttgaggcctcagacccacgcataattcggctcatctccttagctgcccagaaattcatctcagatattgccaatgatgccctacagcactgcaaaatgaagggcacggcctccggcagctcccggagcaagagcaaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggc

SEQ ID NO: 999 - DNA, 1599 bp, Homo sapiens
aagatcctggcctgtgcagctcgggtttccgagcttctgcctcaggcatctccgcgatctcctctcccctccaatcctatccgtgatggacgatgcccacgagtcgccctccgacaaaggtggagagacaggggagtcggatgagacggccgctgtgcccggggacccgggggctaccgacaccgatggaatcccagaggaaactgacggagacgcagatgtggacttgaaagaagctgcagcggaggaaggcgagctcgagagtcaggatgtctcagatttaacaacagttgaaagggaagactcatcattacttaatcctgcagccaaaaaactgaaaatagataccaaagaaaagaaagagaaaaagcagaaagtagatgaagatgagattcagaagatgcaaatcctggtttcttctttttctgaggagcagctgaaccgttatgaaatgtatcgccgctcagctttccctaaggcagccatcaaaaggctgatccagtccatcactggcacctctgtgtctcagaatgttgttattgctatgtctggtatttccaaggttttcgtcggggaggtggtagaagaagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgccgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaataattggtgcttgtaaacatttaagattctcctgtggattttggtgagtgatcattaaactgttttccaacttgcaaaaaaaaaaaaaaaaaaaaaaaaaaaaaaaaaaaaaaaaaaaaaaaaaaaaaaaaaaaaaaaaaa

SEQ ID NO: 1000 - DNA, 1129 bp, Homo sapiens
cggaagtagtcggggagggccgcgcagtcggaccggctgctgagacgaacgcttcactggggcagtctctgcatatcatggggagatagacgctgctgcctttaattggccttggtcctcacagctccaaaaagaaacaggatctcgataagctctatgagctgaagtccaaagctcggcagattatgaaccagtttggcccctcagccctaatcaacctctccaatttctcatccataaaaccggaaccagccagcacccctccacaaggctccatggccaatagtactgcagtggtaaagataccaggcactcctggggcaggaggtcgtcttagccctgaaaacaatcaggtattgaccaagaagaaattacaggacttagtaagagaagtggatcctaatgagcagttggatgaagatgtggaggagatgctgctgcagattgctgatgattttatcgagagtgtggtgacagcagcctgtcagcttgcgcggcatcgcaagtctagcaccctggaggtgaaagatgtccagctgcatttagagcgccagtggaacatgtggatcccaggatttggctctgaagaaatccgaccctacaaaaaagcttgcaccacagaagctcacaaacagagaatggcattgatccggaaaacaaccaagaaataacacacggaaaggtcagggaatggacagcaatgtatttggagatacttgagctgagaactcagccatctcatccttggatttttttttttaatgctttacagagaagcatatattttttattaacagtgcagcaatatctataatgactgagaggatctgccaaaagaataaagcctcctaccccaacttccggtcccttttccctgccatctcaaagaggagcaatgtatcttccagagaagattttatttgtggtttattatataagtgactgaatatgggacaaagcattatggtctttttgggtaagacagtattagcaggatttgtaaagggttttgtttccttctcccttccccttttccctgtactttgtaatgtcagtgtttatatgaatatgactttcatttgcttttccagaataaagaagttattaatcgaaaaaaaaaaaaaaaaaa

SEQ ID NO: 1001 - DNA, 577 bp, Homo sapiens
gtgtaaccagctgggagccagccggcaggacgctgtgagttggcgtgctagtgggatggcagatgaggaagaagaccccacgtttgaggaagaaaatgaagaaattggaggaggtgcagaaggtggacagggtaaaagaaagagacttttttctaaagaattgcgatgtatgatgtatggctttggggatgaccagaatccttatactgagtcagtggatattcttgaagatcttgtcatagagtttatcactgaaatgactcacaaggcaatgtcaattggaagacaaggtcgagtacaagttgaagatatcgtcttcttgattcgaaaggacccaaggaagtttgccagggttaaagacttgcttactatgaatgaagaattgaaacgagctagaaaagcatttgatgaagcaaattatggatcttgacactttttgtagtttccgaaaattaccatctggggaaaccatatataataattgtatattttctaaagtaagattctgatatctagccatgtaaatgaaagatggagaaacacaaagttttcagcctttatttttatgcctttgatt

SEQ ID NO: 1002 - DNA, 2166 bp, Homo sapiens
agtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatggacagaactacagcggttactccagttatggacaaagttattcacagtcctatggtggttatgagaatcaaaagcagagctcatatagccagcaaccatataataaccagggacagcagcaaaacatggaatcatcaggaagccaaggtggaagagcaccttcctatgaccagccagactatggtcaacaagattcatatgaccagcagtcaggctatgatcaacatcaaggctcatatgatgagcagtcaaattatgatcagcagcatgattcctatagtcaaaaccagcagtcctatcattcacaaagggaaaactacagccaccacacacaagatgaccgtcgtgatgtgagtaggtatggagaagataatagaggatatggcgggtcacagggaggaggtagagggcgtgggggatatgacaaggatggaagaggtcctatgacaggatcaagtggtggtgaccgcggtggcttcaaaaattttggtggtcacagggattatggacccagaacagatgctgattcagaatctgataattcagataacaacacaatctttgtgcaaggacttggggagggtgtgtctacagatcaagttggggagttctttaaacaaataggaattatcaagacaaataagaagaccggaaaaccaatgataaatctttatacagacaaggacacaggaaagccaaagggggaggcaacagtgtcatttgatgaccctccttcagctaaggcagccattgactggtttgatggaaaagaattccatggcaacatcattaaagtgtcctttgccactagaagacctgaattcatgagaggaggtggaagtggaggtgggcggcgaggccgtggaggatatagaggtcgtggaggctttcaagggagaggtggagaccccaaaagtggggattgggtttgccctaatccgtcatgcggaaatatgaactttgctcgaaggaattcctgcaatcagtgcaatgagcctagaccagaggactctcgtccctcaggaggagatttccgggggagaggctacggtggagagaggggctacagaggtcgtgggggcagaggtggagaccgaggcggctatggtggagacagaagtgggggtggctatggtggagacagaagcagcggtggtggctacagcggagatagaagtgggggcggctatggtggagacagaagtgggggtggctatggtggggacagaggcggcggctatggtggggacagaggaggcggctatggaggagaccgaggaggtggctatggaggagatcgaggtggctatggaggagaccgaggtggaggctatggtggagaccgaggaggctatggaggagatcgaggaggttacggaggagatcgaggaggttatggaggagatcgaggaggctatggaggagacagaagccgggggggctatggaggagaccgtggtggtggcagtggctacggtggagaccgaagtggaggctatggaggagacaggagtggtggcggctatggaggagaccgaggtgggggctacggaggagaccgaggtggctatggaggcaaaatgggaggaagaaacgactacagaaatgatcagcgcaaccgaccatactgatgactgttttgaatgttcctttgtctctgacatgatccatagtgaaattgccagagttttgcctgctgctttcctcgtggcctcttcttgggtagtgaaattaagtgacatttggatttttatttgggtgggagggctgggacagtttttcttctagaaatgtctgttgagatttccccctttagtttccaaccttctccccaacccttggagctaaatgcgttgtaaaatattgccaaaatgaaaagtgttttgtaatactgcaataaaggctgcttgtttttgtggaaaaaaaaaaaaaaaaaaaaaa

SEQ ID NO: 1003 - DNA, 1893 bp, Homo sapiens
gccaacgatacgcctgctgcagcaggaggagttacgagccgggccgcgcgctgcctaaatacctaaaccaggtttagcgcctgctcatataaagctctcctaactcgtcttccggtgggaatttcttcacgtgggccggagtcggagactgagtttagctttactgaggagctctaaatttaggcgggtatgagtgatttcagtgaagaattaaaagggcctgtgacagatgatgaagaagtggaaacatctgtgctcagtggtgcaggaatgcattttccttggcttcaaacatacgtagaaactgtggccattggagggaaaaggaggaaggattttgctcagacaacaagtgcttgtttaagttttatccaagaagctctgctgaagcaccaatggcagcaagctgcagaatacatgtacagttattttcagaccttggaagattcagatagctacaaaaggcaggctgcacctgagattatttggaagctcggaagtgaaattctattttatcatcccaaaagcaacatggagagtttcaatacttttgctaaccggatgaaaaatattggcgtcatgaattatttaaagatctccttacaacatgcattataccttctgcatcatggaatgcttaaagatgctaagagaaatctgagtgaggcagagacatggagacatggtgaaaatacgtcttcccgggaaatattaatcaaccttattcaggcctataaagggcttttacagtattatacctggtctgaaaagaagatggaattgtcaaagcttgataaggatgattatgcttacaatgcagtagcccaggatgtgttcaaccacagctggaagacatctgcaaatatttctgcattgattaaaattcctggagtttgggacccttttgtgaagagttatgtagaaatgctggaattctatggggatcgagatggagcccaagaggtactcaccaattatgcatatgatgaaaagtttccatcaaatccaaatgcccatatctacttatacaactttctaaagagacagaaggcaccaagatcaaaattgataagtgtgcttaagattttgtatcagattgtaccatctcataaattgatgttggaattccatacattacttagaaaatcagaaaaagaagaacaccgtaaactggggttggaggtattatttggagtcttagattttgccggatgcactaagaatataactgcttggaaatacttggcaaaatatctgaaaaatatcttaatgggaaaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttagttatttcacagttgtagctacacagtaagtagcttggtagatagttattgaatgtatttatgtagtgtattaagaagcttatattactacaaaaaacttatttttatatatttttatatttttgtattatttatagctagagaaacaatattactgcctttgctctttgtaactatgtctgttttcttttttgtaatgttaaatgttacatttgttaaggaataattcttcaaatgacaaactaattacagaatatagctctacagcagttattgtttgcaaatactttgcctcttgctattgtgtaataaactgtaacttgtaaaaaaaaaaaaaaa

SEQ ID NO: 1004 - DNA, 1703 bp, Homo sapiens
attcccgcgtttccggccggaacggttctccagcctttcccggaagctgcgctcgctacccgggtaacggtcccggctgtggaagctcccgcggcgccgcgattggacctcgaggagtcggaagagtttaaagaacgctgtactcagtgtgctgctgtctcatggggtcttactgatgaaggcaaatattattgcacttcttgccacaatgttacagagagatatcaggaagttacaaacactgatcttattcctaatacccaaataaaagccctcaaccgggggcttaaaaaaaaaaacaatactgaaaaaggctgggattggtatgtgtgtgaaggtttccagtatattctttatcaacaagcagaagccttaaagaaccttggagtaggcccagagttaaagaacgatgttttacataatttttggaagcgctaccttcagaagagcaagcaggcatattgtaagaacccagtttataccactggaaggaaacctacggtattagaagataatctaagtcattcagactgggctagtgagcctgagctgctaagtgatgtcagctgtcctccttttcttgaaagtggagcggagtctcagtctgacatccacactcgaaaacctttccccgtcagcaaagcatcacaatcagaaacgtctgtctgctctggatctctggatggagttgaatactcacaacgaaaggagaagggaatcgtgaagatgaccatgccacagacacttgccttctgttatctgtccttactttggcagagagaagcaataacactttcagatcttttgaggtttgttgaagaggaccatattccttacataaatgcttttcagcattttccagaacagatgaaattatatggacgtgacagaggaatctttggtatagagtcttggcctgactacgaggacatctataaaaaaacaatagaagttggaacatttttagatttgcctcgttttccagacataactgaagactgctatcttcatcccaacatactgtgtatgaaatacttgatggaagtcaacctccctgatgaaatgcatagcttaacttgccacgtggtaaaaatgactggaatgggagaagtggattttctgacatttgatcctatagccaaaatggcaaaagctgttaagtacgatgtacaagctgtagctatcattgtggtggtattgaaactgctctttctaatggatgacagtttcgagtggtctttgtctaatcttgctgaaaagcataatgaaaagaacaaaaaagataagccatggtttgatttcagaaagtggtaccaaattatgaagaaagcttttgatgagaaaaaacaaaaatgggaagaagcaagggccaagtacctgtggaaaagtgaaaagccactctactactcatttgtcgacaaaccagtagcatataaaaaaagagaaatggtggtgaatctacagaaacaatttagcacactggtcgattcaacagcaactgctggaaaaaaaagcccttcaagttttcagttcaactggactgaagaggacactgatagaacgtgtttccatggacacagccttcagggagtcctgaaagagaaaggccaatcactgctgactaagaattcattatattggcttagtacacagaaattctgcagatggtaataatgcttttagaaaaagtcacatataattga

SEQ ID NO: 1005 - DNA, 3925 bp, Homo sapiens
gtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacgaactctggcgccccttaccagcttccagtctctcgaggtggccagtgtggtgcttggtccttgtttccaggatggacttccccagctccctccgccctgcattgtttctgaccggcccccttggtctgagcgacgtccctgacctctctttcatgtgcagctggcgagacgcactgactctgccagaggcccagccccagaactcagagaatggggcactgcatgtgaccaaggacctgctgtgggagccggcaacccctgggcctctccccatgctgcctcccctcatcgatccctgggaccctggcctgactgcccgggacctgcttttccgcggagggtgccggtatcggaagcggccccgagtcgtgctggatgtgactgagcagatcagccggttcctcttggatcatggagacgtagcctttgcgcccctggggaagctgatgctggagaatttcaagctggagggagcggggagccgcactaagaagaagacagtggtcagtgtgaagaagctgctccaggacctcggtggacaccagccctgggggtgtccctgggcttacctcagcaaccgacagcgccgcttctctatcctcgggggccccatcctgggcacgtcggtggcgagccacttggcagagctgctgcacgaggagctggtgctgcggtgggagcagctgcttctggatgaggcctgcactgggggcgcgctggcctgggttcctggaaggacaccccagttcgggcagctggtctaccctgctggaggcgcccaggacaggctgcatttccaagaggtcgttctgaccccaggtgacaatccccaattccttgggaaacctggacgcatccagctccagggacctgtccggcaagtggtgacatgcaccgtccagggagaaagtaaggcccttatatacactttcctccctcactggctgacctgctacctgacccctggccctttccatccctcctcagctctgctggccgtccgctctgactaccactgtgccgtgtggaagtttggtaaacagtggcagccaacccttctgcaggcaatgcaggtggagaaaggggccacggggatcagcctcagccctcacctgcccggggagctggccatctgcagccgctcgggagccgtctgcctgtggagccctgaggatgggctgcggcaaatctacagggaccctgagaccctcgtgttccgggactcctcttcgtggcgttgggcagacttcactgcgcaccctcgggtgctgaccgtgggtgaccgcaccggagtgaagatgctggacactcagggcccgccgggctgtggtctgttgctttttcgtttgggggcagaggcttcgtgccagaaaggggaacgtgtcctgcttacccagtacctggggcactccagccccaaatgcctcccccctactcttcatctcgtctgtacccagttctctctctacctagtggacgagcgccttcccctggtgccgatgctgaagtggaaccatggcctcccctccccgctcctgctggcccgactgctgcctccgccccggcccagctgcgtgcagcccctgctcctcggaggccagggtgggcagctgcagctgctgcacctggcaggagaaggggcgtcggtgccccgcctggcaggccccccccagtctcttccttccaggatcgactccctccctgcatttcctctgctggagcctaagatccagtggcggctgcaggagcgcctgaaagcaccgaccataggtctggctgccgtcgtcccgcccttgccctcagcgcccacaccaggcctggtgctcttccagctctcggcggcgggagatgtcttctaccagcagctccgcccccaggtggactccagcctccgcagagatgctgggcctcctggcgacacccaacctgactgccatgcccccacagcttcctggacctcccaggacactgccggctgcagccagtggctgaaggccctgctaaaagtgcccctggctcctcctgtgtggacagcacccaccttcacccaccgccagatgctgggcagcacagagctgcggagggaggaagaggaagggcagcggctgggtgtgctccgcaaggccatggcccgagggcagctcctgctgcagagagacctgggctccctccctgcggcagagccaccccctgcacccgagtcaggcctagaggacaagctcagtgagcgcctgggggaagcctgggcaggccgaggggctgcctggtgggagaggcagcagggcaggacctcggagcccgggagacagaccaggcggcccaagcgccggacccagctgtccagcagcttttcgctcagtggccatgtggatccctcagaggacaccagctcccctcatagccctgagtggccacctgctgatgctctgcccctgccccccacgaccccgccctcccaggagttgactccggatgcatgcgcccagggcgtcccatcagagcagcggcagatgctccgtgactacatggccaagctaccaccccagagggacaccccaggctgtgccaccacacctccccactcccaggcctccagcgtccgggccactcgctcccagcagcacacacccgtcctctctagctctcagcccctccggaagaagcctcgaatgggcttctgaggacacaaggtgggctgccctcaagccccagagagcccctcatccttcctctgggaccagatgtgccttccacagttgaaacttgagaagcagagctcgccaccttctggaggccactgtgatgatgagccaagcaatttggagccaagttgaagggacagggcaacaaaatacagtagtagtttcttttgtattttgtatattcgcctgaagatcatcccgcaaggcaggctggaggtgccggtgggcctgtgttgctgggattttagtctgtgctgggaggcagggctccgctgcgcctcagctgtgggggcctcaggcaggtccctcagttctcacgccttcctgtccagtggaatgggggccaggagtgctggctcctcgtgtttggtgagggtggagtgaggcccctgcagagctgctgatgaggtgggcacagcggccgttggcagctgctgttgtgggttgctttgtcaatctctgccccggtctgatgtttcctacagggagatgccttggatccaggttcagggactaaatacacttggcagctgaagatgaattggaatggtcacgttttttaggctggacagcgtcccgccacagctactacctgacactgagctcatgcagagagatgatggctgatgttccttctcccttgggacatgggtctggcacctgtgggctgtcgatagtgccctctgagcagagggtcacggtcatgtcagtttgggggaattctctgttgtgcctcacagactcccccctttctttcctccctccccttctcattttgatgtctaaagcatcaagtccctcttcctcggagtttctctagctgcagtggaagattctgttttcctgtggggaaaatgctcacttgagattttgcagggacccgggtctgtctggtttctgatgacatagtaagagaaaggtcttttttcaggttggctggtgaaaggaattgcatgtgactcacacaaacaggagctagcccaatcatacactgactcgcgtgggtgttaaaatgtttatcatgcctaagggagacatttatgattaaaccatttatgctacataa

SEQ ID NO: 1006 - DNA, 5049 bp, Homo sapiens
acagacaagatgtcggcggatggtagcttcgagcccttgcggagaggagcatctctgtgacagaagcttgtcgacggcggcttctaggagctagtcgaaggagcgaggttgaggcgggcagcgacccgtcaggtcgctcacctgggcaccggccagctgcgagacgtgacttggggaccgcaggggagtggagagtgtgaggtgccaaagactagtaatgccccgtatccccctaggaagccgggaagccaagctccgcgggaccgcttcatgccgctgactggtgtagagcccgccagaatgaacaggaagaaaggagacaagggctttgaaagcccaaggccatataaattaacccatcaggtcgtctgcatcaacaacataaatttccagagaaaatctgttgtgggatttgtggaactgactatatttcccacagttgcaaacttgaatagaatcaagttgaacagcaaacagtgtagaatataccgagtaaggatcaatgatttagaggctgcttttatttataatgacccaaccttggaagtttgtcacagtgaatcaaaacagagaaacctcaattatttttccaatgcttatgcagctgcagttagtgctgtggaccctgatgcaggaaatggagaactttgcattaaggttccatcagagctatggaaacacgttgatgagttaaaggtcctgaagatacacatcaatttttctttggatcagcccaaaggaggtcttcattttgtggtacccagtgtagagggaagtatggcagagagaggtgctcatgttttctcttgtgggtatcaaaattctacaagattttggttcccttgtgttgattcatactctgaattgtgtacatggaaattagaatttacagtagatgctgcaatggttgctgtttctaatggcgatttggtggagacagtgtatactcatgatatgaggaagaaaactttccattatatgcttaccattcctacagcagcgtcaaatatctccttggccattggaccatttgaaatactggtagatccatacatgcatgaggttactcatttttgtttgccccaacttcttccattgctgaaacataccacatcataccttcatgaagtctttgaattttatgaagaaattcttacatgtcgttacccatactcctgttttaagactgtcttcattgatgaggcttatgttgaagtggctgcttatgcttccatgagcatttttagcacaaatcttttacacagtgccatgattatagatgagacacctttgactagaaggtgtttagcccaatccttggcccagcagttttttggttgtttcatatctagaatgtcttggtctgatgaatgggtgctgaagggaatttcaggctatatctatggactttggatgaaaaaaacttttggtgttaatgagtaccgccattggattaaagaggagctagacaaaatagtggcatatgaactaaaaactggtggggttttactacatcccatatttggtggaggaaaagagaaggataatccggcttcccatctacacttttcaataaagcatccacatacactgtcctgggaatactacactatgtttcagtgtaaagcccaccttgtgatgagattgattgaaaataggatcagtatggaatttatgctacaagttttcaataaactgctaagtctggctagtactgcttcatctcagaagttccagtcacatatgtggagtcagatgttggtttccacatctgggtttttgaaatccatttcaaatgtctctggcaaagatattcagccgttaataaagcagtgggtagatcagagtggagtggtaaaattttatggaagttttgcatttaatagaaaacgaaatgtcttggaactggaaataaaacaggactatacatctcctggaactcagaaatacgtgggaccacttaaagtgacagtgcaggagttagatggatccttcaatcatacactgcaaattgaagaaaacagccttaaacatgatataccctgccattccaaaagtagaaggaataaaaagaaaaaaatcccactgatgaatggagaagaagttgatatggatctttctgcaatggatgctgattcccctttgctgtggataaggatagacccagatatgtcagtattgaggaaggtagaatttgagcaagctgattttatgtggcagtatcagctccgctatgagagagatgttgttgcacagcaggaatccattttggctttggaaaaattccctactccagcatctcggcttgcactcactgatatattagaacaagagcagtgtttctacagagtaagaatgtcagcttgcttctgtcttgcaaagattgcaaattcaatggtgagcacatggacaggaccaccagccatgaagtcactcttcactaggatgttttgttgtaaaagttgtccaaacattgtgaaaacaaacaactttatgagctttcaaagctattttctacagaagactatgccagttgcaatggctttattaagagatgttcataatctttgtcctaaagaagtcttaacatttattttagacttaatcaagtacaatgacaacaggaaaaataagttttcagataactattatcgtgcagaaatgattgatgccctggccaactctgttacacctgcagtcagtgtgaataatgaagttagaactttggataacttaaatcctgatgtgcgactcattcttgaagaaatcaccagatttttgaatatggaaaaacttcttccgagttacaggcataccatcactgtcagttgtttgagagccatacgggtacttcagaagaacggacatgtgccaagtgatccagctctttttaaatcttatgctgaatatggccactttgtggacattaggatagcagctttggaagcagttgttgattatactaaagtggacagaagttatgaagaactgcaatggctacttaatatgattcagaatgaccctgtaccctatgtaaggcataagattctcaacatgttgactaagaacccaccatttactaagaacatggagtctcccttatgcaatgaagccctggtagatcaactttggaaacttatgaattctggtacttcacatgactggaggttacggtgtggtgctgtggacttgtacttcacactttttggcctcagtagaccttcctgtttacccttgccagagcttgggttggttcttaatctaaaggagaaaaaagctgtcttgaatcctaccataattccagagtcagtagcaggcaaccaagaagctgcaaataatccaagcagtcacccacagctagttggatttcagaaccctttttccagttctcaagatgaggaggagattgatatggatactgttcatgatagccaggccttcatttcccatcatttaaacatgcttgaaaggccgtcaactccagggctctcgaaatatcggccagctagctcccgatctgctttaataccccagcactcagcaggctgtgacagcacacccaccacaaaaccccagtggagtttggaacttgcacggaagggaacaggtaaagaacaagcacctttggagatgagtatgcatccagcggcaagcgctccactctcagtctttactaaggaatctacagcctccaaacacagtgaccaccatcaccaccatcaccatgagcacaagaaaaagaagaagaagcataaacataagcacaaacacaagcataagcatgacagtaaagaaaaggacaaggagcctttcactttctccagccctgccagtggcaggtctattcgttctccttccctttcagactgagaaggggacaaaaagacctttcctttcatgtccagaagaatgtatgtaactaaagctttgtcctctgtgaagaattataaaagggaggggggaaaggattcgcctctcctacagaaattctgaattcatttaagttctaagcatttgatttatgttatttatacagttgggatctaattaggaaaatgtgttttgtagttctggataaactatttcatccgctgtttcctccccaaaacacacacacagagcaaactccctttcataaaagccctcatatccactggcagtccccgttcgcatcatggtctccatgtgtaccgccaaagtcaattatgtttgaaagcctttggtggatgttatggggcaaagttatgatttacacagaagcaactgccaaatctgtggtgcaaccactatctccagtgaaatattgtataacaccatttggaactactgaaaagacagtggcttttctacagtactcttccttattgcaccatttttgtattaacgtagaaactaagcatcagaatttatgaacaaagaatatgttatttttccttttgctctaaaatactgagatttggggaagcaattcttttttaaaaaaattttgaataactatcttttgataacacattcggcggttacgatgttggaatttagcagaactatcaaatccaaaattattttcaaatcaagatgtttaaattataagtttttttgttttgttttccagtaagtataaatgaaaatattcatatgtaaaatatgttttgcttaatgtggacaatttacacacccaacacatactgtttccaaaattatttctatatgacacaaagtatgatacctttaaaaaggtgagcttatatattgtttattaacctggaaatagacaatttggctctcataccataagcatttaaaaacatatgaaatattttgatttctttatatggtggtgtgtttttatttctgaattttccatgtgctttaatatttgtttaagaatattttttatatctgttcaatttttatcattccccttatcattagaaagtttgacaaaaatacttgaatcttggacctctaaatatacttttagttgtgtttaacttgtttaataaataactttttaagttgaaaaaaaaaaaaaaaaaaaaaaaaaaaaaa

SEQ ID NO: 1007 - DNA, 2182 bp, Homo sapiens
atgtgcgagagttactccaggtcgttgttgagggtctcggtggcgcagatctgccaggcgctgggctgggactcggtgcagctcagcgcctgccacctcctcacggacgtgctgcagcgctatctgcagcagctgggccggggctgccatcggtactctgagctctatggccgaacagacccaattttggatgatgttggtgaagctttccagctgatgggggttagtctacatgaactagaagactatattcacaacattgagcctgtcaccttcccacaccaaattccgtcatttcctgttagcaagaacaatgtacttcagtttcctcaacctggaagtaaagatgcagaggaaagaaaagaatacattcctgattacctgccacccattgtgtcttctcaagaagaagaagaagaagagcaggtgcccactgatggaggcacatcagcagaagccatgcaggttcccttggaagaagatgatgaattggaggaggaagaaattattaatgatgagaatttcctgggcaagagaccactggatagtcctgaagctgaagaactgccagccatgaagcggcctcggctattaagcactaaaggggacacgctagatgttgtgttattggaagctcgagagccactcagctcaataaatactcaaaagatcccaccaatgctttctccagtccatgtacaggacagtacagacttggcacctccctcacccgagccgccaatgttggctccagttgcaaaatcacaaatgccaactgcaaaaccattagaaacaaagtcatttacacctaaaacaaagactaaaactagctctccaggacagaagactaaatcacctaaaaccgcccagtcaccagcaatggtcggaagtcctattcgatcaccaaaaactgtatccaaagaaaagaaatcacctggacgttccaagagccccaagagtcccaagagccccaaggtcacgactcacattccccaaacacctgtgagacctgaaacgcccaacaggactccttcagctacactcagtgaaaaaatcagtaaagagactatccaggtaaaacaaatacagacaccccctgatgctgggaaactgaacagtgagaatcagccgaaaaaggctgtggtagcagataaaacgattgaggcctctatcgatgctgtgattgcacgagcctgtgctgagcgagagccagatcctttcgaattttcttctggatcggaatctgaaggagacatttttactagccctaagagaatttcaggcccggagtgtactactcccaaagcttccacttccgcgaacaatttcacaaagtcaggatccactcctctgcctctttccggtggaacctcaagttccgataactcatggacaatggatgcctccattgatgaggttgtacgtaaagcaaaactgggaacaccttcaaatatgccccccaactttccttatatctcttctccgtcagtgtctcctcccactcccgaacctctccacaaggtgtatgaggagaaaaccaagctgccttcctccgtggaggtaaagaagaagttgaaaaaggaactaaagactaaaatgaaaaagaaagaaaagcagagagatagggagagggaaaaagacaagaacaaggacaaaagtaaggagaaggataaagtgaaagagaaagagaaagacaaggaaactggcagggaaacaaagtatccctggaaggaatttcttaaagaggaagaggcagatccctacaagtttaaaatcaaagaatttgaagatgttgatcccaaagtgaaattgaaagatggacttgtgaggaaggagaaagagaagcataaagataagaagaaagatagagagaaaggcaagaaagataaagataagagagagaaagaaaaagtgaaagataaaggcagagaagataagatgaaagccccagcacccccactggtgttgcccccaaaagagttggccctgcccttgttcagccctgccacagcctccagggtcccagccatgctgccatctttgttgccagtgcttccggaaaaactgtttgaggagaaagagaaggtgaaggagaaagaaaagaaaaaggacaaaaaggagaagaagaaaaagaaggaaaaagagaaggagaagaaggagaaggaaagagagaaagagaagg

SEQ ID NO: 1008 - DNA, 4647 bp, Homo sapiens
atggcggcgggctcggatctgctggacgaggtcttcttcaacagcgaggtggacgagaaagtggtgagcgacctggtgggctcgctggagtcgcagctggcggccagcgcggcccaccaccaccacctcgcgccgcgcacgcccgaggtgcgggccgcggccgccggcgcgctcgggaaccatgttgtgagcggcagcccggccggagccgcgggcgcagggccggccgcccccgccgagggcgcgcccggagcggcgccggagccgccccccgcaggtagagcgcggccggggggcggggggccgcagcgcccgggccccccctcaccgcgccgcccccttgtccccgcagggcccgcgccgcccgccgcgaagctgaggccgccgcccgagggcagcgcggggtcctgcgccccggtgcccgccgccgccgccgtcgccgcggggcccgagcccgcccccgccggccccgccaagcccgccggccccgccgcgctggccgcccgcgccggccccggccccgggcccggccccggccccggccccggccctggccctggcaagcccgccggccccggcgccgcgcaaactttgaatgggagcgccgcgctgctgaactcgcaccacgccgccgcacctgctgtcagcctggtcaacaacgggcccgccgcgctgctgccgctgcccaagcccgccgcccccggcactgtcatccagacgccccccttcgtgggcgccgccgcgccccccgcgcccgccgcgccctcgccccccgccgcccccgcgcccgccgcccccgccgccgccccgcccccgccaccccccgcgcccgccactctggcccggccgcccggccaccccgccggacccccgaccgccgcgcccgccgtgccgccccccgccgccgcccagaacgggggcagcgccggggcagcccccgcccccgccccggccgccgggggccccgcgggggtcagcggccaacccgggcccggcgcggcggctgcggcgccggcgccgggggtcaaggccgagtcgcccaagagggtggtgcaggcggcgcccccggcggcgcagaccctggcggccagcggcccggccagcacggcggccagcatggtcatcgggccaactatgcaaggggcgctgcccagcccggccgccgtcccgccgcccgcccccgggacccccaccgggctgcccaaaggcgcggccggcgcagtgacccagagcctgtcccggacgcccacggccaccaccagcgggattcgggccaccctgacgcccaccgtgctggccccccgcttgccgcagccgcctcagaacccgaccaacatccagaacttccagctgcccccaggaatggtcctcgtccgaagtgagaatgggcagttgttaatgattcctcagcaggccttggcccagatgcaggcgcaggcccatgcccagcctcagaccaccatggcgcctcgccctgccacccccacaagtgcccctcccgtccagatctccaccgtacaggcacctggaacacctatcattgcacggcaggtgaccccaactaccataattaagcaagtgtctcaggcccagacaacggtgcagcccagtgcaaccctgcagcgctcgcccggcgtccagcctcagctcgttctgggtggcgctgcccagacggcttcacttgggacggcgacggctgttcagacggggactcctcagcgcacggtaccaggggcgaccaccacttcctcagctgccacggaaactatggaaaacgtgaagaaatgtaaaaatttcctatctacgttaataaaactggcttcatctggcaagcagtctacagagacagcagctaatgtgaaagagctcgtgcagaatttactggatggaaaaatagaagcagaagatttcacaagcaggttataccgagaacttaattcttcacctcaaccttaccttgtgcctttcctgaagaggagcttacccgccttgagacagctgacccccgactccgcggccttcatccagcagagccagcagcagccgccaccgcccacctcgcaggccaccactgcgctcacggccgtggtgctgagtagctcggtccagcgcacggccgggaagacggcggccaccgtgaccagtgccctccagccccctgtgctcagcctcacgcagcccacgcaggtcggcgtcggcaagcaggggcaacccacaccgctggtcatccagcagcctccgaagccaggagccctgatccggcccccgcaggtgacgttgacgcagacacccatggtcgccctgcggcagcctcacaaccggatcatgctcaccacgcctcagcagatccagctgaacccactgcagccagtccctgtggtgaaacccgccgtgttacctggaaccaaagccctttctgctgtctcggcacaagcagctgctgcacagaaaaataaactcaaggagcctgggggaggttcgtttcgggacgatgatgacattaatgatgttgcatcgatggctggagtaaacttgtcagaagaaagtgcaagaatattagccacgaactctgaattggtgggcacgctaacgcggtcctgtaaagatgaaaccttcctcctccaagcgcctttgcagagaagaatattagaaataggtaaaaaacatggtataacggaattacatccagatgtagtaagttatgtatcacatgccacgcaacaaaggctacagaatcttgtagagaaaatatcagaaacagctcagcagaagaacttttcttacaaggatgacgacagatatgagcaggcgagtgacgtccgggcacagctcaagttttttgaacagcttgatcaaatcgaaaagcagaggaaggatgagcaggagcgggagatcctgatgagggcagcaaagtctcggtcaagacaagaagatccagaacagttaaggctgaaacagaaggcaaaggagatgcagcaacaggaactggcacaaatgagacagcgggacgccaacctcacagcactagcagcgatcgggcccaggaaaaagaggaaagtggactgtccggggccgggctcaggagcagaggggtcgggccccggctcagtggtcccaggcagctcgggtgtcggaacccccagacagttcacgcgacaaagaatcacgcgggtcaacctcagggacctcatattttgtttagaaaatgaacgtgagacaagccattcactgctgctctacaaagcattccttaagtgacacaggaggacgcctggggactttttatatatttgcagattacgcctttttgtaacgagcaaatgggatattgtttaaaaaacagccacctctttacaatggaacagttttatattcctgtttctaaatcagctcttcagtgtgaaagaaaacacgtttctgtaacagagagaacacaaaggcctgtggatactcttaaaggacaattaaatcttaactcatcttgattgagtggccttcctgccaaacaagccatatataaagactgatggaatcgttagcaaataattagctgccctctgtcaactcatagcagtttctgcattatttgtgcattttggtttagttctacctaacttactatgtaggtgtatgtctacagccgatgacctcatttcgtttattttatttttgtaatagtcagttggcaaagcaaactgattttttagactatttatcttccttcccttcccctcccaccccgctctcctctctgccccctgccctcccctcccctcccttcccctccactccgctgagaatcctggaggaatacacaattcatcgttgcacccccacctcagagtgtaatcgcatttctgcttggtagaggccgagcccagcaaaggtggctccttctgaatgtgtggtcagcatctgtacaaatgcattttatttgctatagtttgtaaagctgtaaagttaaaagagatgaaaaccttttcagcataaatatattttacttgcactgtgttttttagctaaaagtgaaaacctagattaaataaaatcaaagttgagaagaatcatcaaaagactgtttctcggtgtgaatcaagtgttgaaaaatggttggtgtattttgtcagtaattgtacataacttttggcacatgacatagaaatggctatgtaaactataattattttgctaagagactgtatgcaagccttgggccgactttacagacgtccagagcaaagccccttctttgtacctatttttttattacaaatatactaattggttctttctattttcagaggttattgtatgaaattgtctattgatagtacttttatgactgtaaatactctggctttctccgtgtgaattctcacattagactttaattcgagcgcgtgtgaactgaacgctgatcagtattttttatcaacacctgagaactgttacaccttttattttgtcttttaggaaatccctgtctttccattttttcatgtaaattttgcacagttacttgttcatatgtaaatattttactttcagaaatgaagtttttaattgctattgttttatataggattgaaagaaaattaactcctttattaaaaacaaatttatctgtaaaaaaaaaaaaaaaaaaaa

SEQ ID NO: 1009 - DNA, 2556 bp, Homo sapiens
gggaccctggtgaccaaagtggctccggtcagcgcccctcctaaagtcagcagcggccctaggctgcctgctcctcagatagtcgccgtgaaagcccccaacaccacgacaatccagtttcctgctaatttgcagcttcctccaggaaccgttttgattaaaagtaacagtggtccgttgatgttggtatctcctcagcaaactgtaacaagagccgagaccacaagtaacataacctcaaggccagcagtaccagcgaatcctcaaacagtcaaaatctgtacagtgccgaactctagctcacaattaatcaagaaagtggcagtgacacctgttaaaaaattggcacaaataggaactactgtggtaaccactgttccgaagccttcctcagtacaatctgtggctgtgccaaccagtgtcgtcacagttactcctggaaagccattgaatactgtaactaccctgaagccttcaagtttgggagcatcatccactccttcaaatgagcccaatcttaaagcagagaactcagcagctgttcagattaatctttctccgacaatgctagaaaatgtgaagaaatgcaagaacttccttgcaatgttaataaaactagcatgtagtggatcacagtcccctgaaatggggcaaaatgtgaagaagctggtggaacaacttttggatgcaaaaatcgaagcagaagaatttactaggaaactgtatgttgaactcaagtcttcacctcagcctcacctggttccttttcttaagaaaagcgtggttgccttacgacaacttctgcctaactcccagagcttcatccagcaatgtgttcagcagacttctagtgacatggtcattgctacctgtactacaacagtaacaacttctcctgtggtgacaactacagtgtcctcaagccagtctgaaaagtcaattattgtttctggagcaacagcacccagaactgtgtcagtgcaaactttgaacccacttgctggtccagtgggagcaaaagctggagttgtgacacttcattctgtgggcccaactgctgcaacaggaggaacaacagctggaactggtttgcttcagacttcaaaaccacttgtgacatctgtggcaaacacagtgaccacggtctcactgcaacctgaaaagccagttgtctctggaacagcagtaacactgtcccttccagcagtaacttttggagaaacttcaggtgcagctatttgtcttccatctgtgaaacctgttgtttccttctgctgggaccacatctgcaagcctgttattgggactccagttcaaatcaaacttgcccagccgggccctgtcctttcacaaccagctgggattccaacaggcagttcaagcaagcaactattctcattgtttcacgtagttcagcagccttcaggaggcaatgaaaaacaagtgaccacaatttcacattcctcaacattgaccattcagaaatgtggacagaagacgatgccagtgaacaccataatacctactagtcagtttcctccagcttccattctaaagcaaattactctgcctggaaataaaattctgtcacttcaagcatctcctactcagaaaaatagaataaaagagaatgtaacatcatgcttccgagatgaggatgacatcaatgatgtgacttctatggcaggggtcaaccttaatgaagaaaatgcctgcatcttagcaacaaactctgaattggttggcacactcattcagtcatgtaaagatgaaccatttctttttattggagctctacaaaagagaatcttagacattggtaaaaagcatgacattacagaacttaactctgatgctgtgaacttgatctcccaagcaacacaggaacgactacgaggccttctagaaaaactgactgcaattgctcagcatcgaatgactacttacaaggcaagtgaaaattacatcctgtgtagtgataccaggtcacagctcaaatttcttgaaaagctggatcaattggagaagcagagaaaggatttggaagaaagagaaatgttacttaaggcagccaagagtcgttctaataaagaagatccagaacagctgagattaaagcagaaagccaaagagttacagcaattggaacttgcacagatacagcatagagacgctaatctcacagctcttgcagctattggaccaaggaagaagagaccactagaatctggaattgagggcttaaaagacaaccttcttgcttctgggacatccagcctgacagccaccaaacagttgcatcgtccaagaatcacgagaatctgcctcagggacttgatattttgtatggaacaggaacgggagatgaagtattctcgagctctatacctggcccttctgaagtgaccactccactcttccatccacatccttgctatttactgccaaagaagacacaaagcattgttgcactgtcctgaaatttcaatttctggaaaataacaccaacatgaaagagcattgtttacgattagaactttattaactcttacctat

SEQ ID NO: 1010 - DNA, 2016 bp, Homo sapiens
atgagtgtgagctcgtgagtgggcgccgccgccaccgcccccgccgccgtcgtctcggtagcagccttcgccacgccggggtcttcagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcagaatagctctcagttcatgaagcacaccaaacgccggaagctgacggttgaggacttcaacagggccctcagatggagcagcgtggaggctgtgtgtggttacggatcacaggaggcactgcccatgcgccccgccagggagggtgaactctactttcctgaggatcgagaggtgaacctggtggagctggccctggctaccaacatccccaaaggctgtgctgagacagctgtcagagttcatgtctcctacctggatggcaaagggaacctggcacctcaaggatcggtgcccagtgctgtgtcttcactgacagatgaccttctcaagtactatcaccaggtgactcgtgctgtgctaggggatgatccgcaactgatgaaggttgcactccaggacttgcagacgaactccaagattggggcactcctgccttactttgtttatgtggtcagtggggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggactcatggggaccttgtaagtggcctctatcagcatatcctgctatccctgcagaagatcctggcagatcctgtgcggccgctctgctgccactatggagccgtggtggggctgcatgctcttggctggaaggcagtagaacgagtcctgtacccacacctgtccacctactggacaaacttgcaggctgtgctggatgattattcagtatctaatgcccaggtcaaagcagatggacacaaagtctatggagccattctggtggcggtagagcgactgctgaagatgaaggcccaggcagcagagcccaacaggggtggcccaggtggcagggggtgccggcgcctggacgacctgccatgggacagccttctctttcaagagtcgtcctccgggggcggtgcagaacccagctttgggtccggcctcccgctgccgccagggggcgcggggccggaggacccttctctttcggtgaccctggccgacatctaccgggagctctacgccttcttcggtgacagcttggccacacgctttggcaccggccagcctgcacccacggctccgcggccgcccggggacaagaaggagccggcggcagccccggactcggtgcggaagatgccgcagctgacggcaagcgccatagtcagcccgcacggcgacgagagcccccggggcagcggcggaggcggccccgcgtcggcctctgggcccgccgcctctgagagcaggcccttgccgcgcgtgcatcgggcgcgcggggcaccccggcagcagggccccgggaccggcacccgcgacgttttccagaagagccgtttcgccccgcgcggcgccccgcactttcgtttcatcatagccgggcggcaggctgggaggcgctgccgcgggcgccttttccagactgccttccccgcgccgtacgggcctagcccggcctcgcgctacgtgcagaaactgcccatgatcggccgtaccagccgccccgcccgccggtgggcgctctcggactactcgctgtacttgccgctctgagtcagtggccccttcgttccttgtaaataaatcccgcccccggaaa

SEQ ID NO: 1011 - DNA, 2310 bp, Homo sapiens
acttccgtttttgctgggtaggcgacccggacggagggccggcgaggtgcggggtctggtgatgcgagctgcgcctctcggcaagatttcgcgctgcccatcccgggccctttcatcagtaatcggtagtggatcactctgccaagcggcaggaagaattaaggaaacgacaaggagacgctcggctctctcccgcttggctccttgcggcctcctcttcccttcgctccggcccggtgaaactgaacttataatcgtcactggattgtaagtacccgaggcgaagagagctcgctgagccctgattttttgagtgtctttgttccgggagagtttgtgagttgaaagtatctctgctgggctttctgggccgaaaaccgttccgggggagccgccatttgctttcctgttccctagctagctagctagctctctccgcgttgtccggcagcggcacctagaggttgggacttggcattgcatctgatttaatgaacttaagtctgtgaataagcctttgtgttaacgactggtattcggtcacagcatatttagagaaaagacttggagcttaaataaaaactaaggcaaaatagacgcttagctgctgatctacagagaacttcttgtaattaaaagatttcaattcatagcaaactggtgttttaaactattgcagtagctggaactttttagtgtaaccagcatttattggagaagtgaatcacaaggaaataaagatgagtaaaagcaaagatgatgctcctcacgaactggagagccagtttatcttacgtctgcctccagaatatgcctctactgtgagaagggcagtacagtctggtcatgtcaacctcaaggacagactgacaattgagttacatcctgatgggcgtcatggaatcgtcagagtggaccgtgttccattggcctcaaaattagtagacctgccctgtgttatggaaagcttgaaaaccattgataaaaaaactttttacaagacagctgatatctgtcagatgcttgtatccacagttgatggtgatctctatcctcctgtggaggagccagttgctagcactgatcctaaagcaagcaagaaaaaggataaggacaaagagaaaaagtttatctggaaccacggaattactctgcctctaaagaatgtcaggaagagaaggttccggaagacagcaaagaagaaatatattgaatctccagatgttgaaaaagaagtgaaacgattgctgagtacagatgctgaagctgttagtactcggtgggaaataattgccgaagatgaaacaaaggaggcagaaaatcaaggcctggatatctcttctccaggaatgtctggtcacaggcagggccatgactcattagaacatgatgagcttcgggagatattcaatgacctcagcagcagcagtgaggatgaagatgagacccagcatcaagatgaagaagatataaacatcattgacacggaggaagatctggagagacagctacaggacaagctaaatgaatcagatgaacagcaccaggaaaatgaaggaaccaatcagctggttatgggaattcagaagcagattgacaacatgaaaggcaagctccaagagacccaggacagggcaaaacgacaagaggatctcatcatgaaagtggaaaatctggctctcaagaacagatttcaggctgtactggatgagctcaaacaaaaggaagaccgagaaaaggagcaactcagctctttgcaagaggagctagaatcactcctagagaagtaaaaagaactgatatttaatttcagtcttcagactggtcagcattagaaaattcttggctttattgtactgggtattaagaccttgctcttcctagtccttttaatgctgtgtgttctgttaagttctttcatttgtttgtaattttgtttttcagcaaatttatattgttttgctaggtgttcatcctataagaagcaggattgtataggcagaaaaatgattgtaggaaagttgcaggattagcggaatgtatggttcaaccttaattatagcttcattgcaggactttactgtttctccattttctagaagctgctgttgctgctttgtgatgacgtgagatcaataagaagaacctagtctagagacaatgatgctagtttgcatatgttttcctatgcaataattgttttcccagttattcaaagcagctttctatatgtagagatgcaaattattaagttgtttccaatacaataaataaaagcatctgtttttcactttaaaaaaaaaaaaaaaa

SEQ ID NO: 1012 - DNA, 1245 bp, Homo sapiens
gtgggcttttgctgccgcccgccccttccggctcctccctgtagagcaaagggcacgtgagcgaggcgcccgaagccgtcgcggcggggaccatgttgcttccgaacatcctgctcaccggtacaccaggggttggaaaaaccacactaggcaaagaacttgcgtcaaaatcaggactgaaatacattaatgtgggtgatttagctcgagaagtctgatcatcggatatcatggagtctggcaagacggcttctcccaagagcatgccgaaagatgcacagatgatggcacaaatcctgaaggatatggggattacagaatatgagccaagagttataaatcagatgttggagtttgccttccgatatgtgaccacaattctagatgatgcaaaaatttattcaagccatgctaagaaagctactgttgatgcagatgatgtgcgattggcaatccagtgccgcgctgatcagtcttttacctctcctcccccaagagattttttattagatattgcaaggcaaagaaatcaaacccctttgccattgatcaagccatattcaggtcctaggttgccacctgatagatactgcttaacagctccaaactataggctgaaatctttacagaaaaaggcatcaacttctgcgggaagaataacagtcccgcggttaagtgttggttcagttactagcagaccaagtactcccacactaggcacaccaaccccacagaccatgtctgtttcaactaaagtagggactcccatgtccctcacaggtcaaaggtttacagtacagatgcctacttctcagtctccagctgtaaaagcttcaattcctgcaacctcagcagttcagaatgttctgattaatccatcattaatcgggtccaaaaacattcttattaccactaatatgatgtcatcacaaaatactgccaatgaatcatcaaatgcattgaaaagaaaacgtgaagatgatgatgatgacgatgatgatgatgatgactatgataatctgtaatctagccttgctgaatgtaacatgtatacttggtcttgaattcattgtactgatattaaacatgcatgctggatgttttcaagttgtgttttagaaaactaataataatgagtaaacacagttaccatacttttcaattgaaatgaaggtttttcatcagccttaaaagtgtaagaaaaataaagttgtcattcattcgaaaaaaaaaaaaaaaaaaaaa

SEQ ID NO: 1013 - DNA, 5018 bp, Homo sapiens
gcccgggactatcccttcgcggtgtagcggcagccggagacctggctgaggaggcaaccgcgtagacacctccctgcttagaaaacaaacactgaaccagaccgatcccagttggagggttcgaaaatgttccagacagcctgtcgggaggggttgttgttgctgttggactaaatagctattcctgattggtcatgtatagggttttttaaggcgggtggggggaggagggggtagaggaaaggctccaaacacctgcaggttgggggcggaaagctgtttgcgattccctggactggttggtcggggacaggaggtaattcccagccattgacccccatttctctctctccctccctcttgccctgcctctttctctccacccctatctttcctggaaactcgctttgggcgcggcagatcgcccaggaccacaccgcagcgtaactgcaggcctctcagcgaaaaagggggaaagcaaagacccgggtgtgcatcctcttcctcggcttccgcccctttccggcggagtggagatcctattcagaggggccggtctctctaaatatgccccaggatgaccgagcggccgccgagcgaggcggctcgcagtgacccccagctagagggacgggacgcggccgaggccagcatggcccccccgcacctggtcctgctgaacggcgtcgccaaggagacgagccgcgcggccgcagcggagcccccagtcatcgaactgggcgcgcgcggaggcccggggggcggccctgccggtgggggcggcgccgcgagagacttaaagggccgcgacgcggcgacggccgaagcgcgccatcgggtgcccaccaccgagctgtgcagacctcccgggcccgccccggcccccgcgcccgcctcggttacagcggagctgcccggcgacggccgcatggtgcagctgagtcctcccgcgctggctgcccccgccgcccccggccgcgcgctgctctacagcctcagccagccgctggcctctctcggcagcgggttctttggggagccggatgccttccctatgttcaccaccaacaatcgagtgaagaggagaccttccccctatgagatggagattactgatggtccccacaccaaagttgtgcggcgtatcttcaccaacagccgggagcgatggcggcagcagaatgtgaacggggcctttgccgagctccgcaagctgatccccacacatcccccggacaagaagctcagcaagaatgagatcctccgcctggccatgaagtatatcaacttcttggccaagctgctcaatgaccaggaggaggagggcacccagcgggccaagactggcaaggaccctgtggtgggggctggtgggggtggaggtgggggagggggcggcgcgcccccagatgacctcctgcaagacgtgctttcccccaactccagctgcggcagctccctggatggggcagccagcccggacagctacacggaggagcccgcgcccaaacacacggcccgcagcctccatcctgccatgctgcctgccgccgatggagccggccctcggtgatgggtctgggccaccaggatcagccaggagggcgttcttaggctgctgggatggtgggcttcagggcaggtggggtgagaattgggcggctctgaagcaaggcggtggacttgaactttcctggatgtctgaactttgggaagcctttactgaccctggggctggcttttctgtttcctgtaccagtaggagatcagaaaaatggagcaaagtggtaggtactttttgtgaagacggcacggtcttccctcttccctcagtcccaaatccttcccaagtaagaggctggagttgtcactgcttttggcctggagtttgggatccctgtctttcctaagacctggggttgtcagctctcatctgaggcatccagcagtctctgccttgcctttagcccctcccaagctggctggggtggcctgtgtggccacttctgtccatatttataggtacccaatagctgcccatttcgtgagccccatcttcacccaggcctatgttgatccatccagcttgccagatgctgcagagtcacaagcctcgaggtgccttcttcagggcctggttgaagaagatgatcagtggacagtctgctctagatgagctgggccggagggtcaggaaacccagtcgcccttacttcttgccctggggatcaaagttctgctttctccccaatgagacttgccttcctaagcctgtggctgtggagacaatgtctgcagccctgagaaagccctgtcgggctttgtgtgaaggcagagaaagggacaatgatagtagagtgatatggagcaagagatattttgggcatgtgggcttcaactcctcgacatcactgttcatgctggcgagtgaatgccagtgtgctgatgggcgtacgctggtgctgagtagatgcgcagccccatctgtgcattctcctggatgcttagagggatttctttgctgtaagatgtctgtttgctgatggtctggtctatgttccgaattgagcacaaaacctgtcctatgaatgctttgcatttggaatttttgcttgacttcagttattggtggaatctttagcgctcaataggaccaggatccagcctcacttctagggtatgggaaatccaatcagagaccaggccctggctaagacccaaacatatgcacattcacttagcagaaccttaaacacccctcagttgtgcagcttttggtcatcaagggtgcgtctgggaggttggtttaatgcaatagaagtgctcccctctgaaagttgtacatgaaatttttgtaaatcacatccttatccttcatcttttaaagaaataaccactgcaagtccttttgtaaagtgaagaatccttttgtagaatgaaccactgccccttcattgatttcctgtgtcaatccagatggtgggatgtggttttcttaaggtgaggcctgtctgtgacctgcatctaagcccatgggacaaattgcacagaagtcctgtatgtctgtcattgtacccttaagtcaccctagccctctccctctaggctctgccttcgaggtcagaggagagatagcctgtggccctgtcctgccatgcaagaactcatcactgtggctgtctggaaagcccccccttatagtttgggcttcagcctagtggcttgtcctcaccatgatggggccctaattcagccatgtacagacagagaatatgtctgctcctttccccttccttttaagtaaggtccaattctcgagcttggggcaacattgttcacctttgtagcactcaggctctccattcaatttcaggctccccagatcatgttttggtgaaaattagggttggttcctttccaacgtttggaagatcctgtgaggagccccatctgtctaaagatagagtcattgctgtaggatctaaggctgtttgcttcaccgtggattcgcttgagttaggaatgagaagtagccacagtatggatgggtggatgggttttatgagatggatcacatattttattaagaactcaaacttctggctccctcttctttcagacttgccatgtgactctggcttggcctatctcctagggctatggtgtggactgaatgggatcatgaaagtagacagttttgagaacgtaaagaactttttcttttccctcaatctcaatcctgcagtggggtttcgcagcctgagtccacgacctaggcagtaggccggtgtgcctgactgcccagcatttgggtaatttagattgtaaaccgctttggcctgagttattgagattgtcctcatttctccagattatctatttgtgtgtgtgtgtgtgtgtgtgtgagagacggtgtcttgttctgtcactcaggctggagtacagtggtgccatcattgctgtctgcagccttgaactctgggctcaagcaatcctctcacctcagcctcccgagtagggaggaccacaggtgtgagccaccacacctggctaatttttacttttttttttttttggtagagatggagtcttgctatattgcccaggctggtcttgaagtcctggcttcaggcaattctcctgcctttgcctccagaagcactgggatcacaggtgtcagccattgcacccagcccagattgtcttaatttctatcttgttccaaggccagggacagtaataagaatggaaaagagatatgggaacactggcagactgtgtaaaatgtaatgcaactacccaaaacaagcctggtaggaaagggcaagtctttaggtctttgtaagaactaaagaagatctgtaatttttattttcaccctctgtaccccatgaccttatccttcctctccttccttgttacccatgaaaaactggcaacattccaagaatagcatctgtacaaaggggaaagaacataaaggtaaaacaaaacaaaacaacattttgagaacaaagatgaccataaccactgaagggaatcacatcttttaagacaaattcatattcttttatttgttatggcagatgacaagatggtacaacctttattcttttccaaaataaaacaaagggcacagcatctgtagtcagccgacaactatttcggccttttgggggtgggtctggccgtacttgtgatttcgatggtacgtgaccctctgctgaagacttgccccctgcccgtgtacatagtgcattgtttctgtgggcgggcccagcactttccgtcaacgttgtactgtatgtgatgaattgcgttggtctctgcatttttctgcagaagaggagtaaccgctccaggtaccttgacctttgtacagcccagaggccaacactgtgggtgtgtgactctttagcaaaaaaaacccatgtggtgatgatgtgtatatatatgtgaggatgtatcgggaagatttctaaataaaagttttacaaaggggaaaaaaaaaaaaaaaa

SEQ ID NO: 1014 - DNA, 656 bp, Homo sapiens
ccctgagggccctttctctttccatctcaggaactcaaacatgaccaggaagatcttcacaaataccagggagcggtggaggcagcagaatgtcaacagcgcctttgccaagctgaggaagctcatccccactcaccctccagacaaaaagctgagcaaaaatgaaacgcttcgcctggcaatgaggtatatcaacttcttggtcaaggtcttgggggagcaaagcctgcaacaaacgggagtggctgctcaggggaacattctggggctcttccctcaaggaccccacctgccaggcctggaggacagaactctgcttgagaactaccaggttccttcacctggtccaagccaccacattccttagtgtggctctggctgtcatctcccagggcagcacttgcccagaaatcactgcctgtggacagacttttgcatgttccagagttgacctgatgataactcgtgaagcatgaattctagcttcctgggaggtggctcagagacagctgcagggagctgaaagaagccatgaggaatgtcacttgtgggccgccaccccccagggatgtcaggtagagcggcctacctctgcctattttaaatccaggttctgcataagacttttggagaaaaaattctaaataaaaaaaaaa

SEQ ID NO: 1015 - DNA, 1921 bp, Homo sapiens
ggcggaagtgacattatcaacgcgcgccaggggttcagtgaggtcgggcaggttcgctgtggcgggcgcctgggccgccggctgtttaacttcgcttccgctggcccatagtgatctttgcagtgacccagcatcactgtttcttggcgtgtgaagataacccaaggaattgaggaagttgctgagaagagtgtgctggagatgctctaggaaaaaattgaatagtgagacgagttccagcgcaagggtttctggtttgccaagaagaaagtgaacatcatggatcagaacaacagcctgccaccttacgctcagggcttggcctcccctcagggtgccatgactcccggaatccctatctttagtccaatgatgccttatggcactggactgaccccacagcctattcagaacaccaatagtctgtctattttggaagagcaacaaaggcagcagcagcaacaacaacagcagcagcagcagcagcagcagcaacagcaacagcagcagcagcagcagcagcagcagcagcagcagcagcagcagcagcagcagcagcaacaggcagtggcagctgcagccgttcagcagtcaacgtcccagcaggcaacacagggaacctcaggccaggcaccacagctcttccactcacagactctcacaactgcacccttgccgggcaccactccactgtatccctcccccatgactcccatgacccccatcactcctgccacgccagcttcggagagttctgggattgtaccgcagctgcaaaatattgtatccacagtgaatcttggttgtaaacttgacctaaagaccattgcacttcgtgcccgaaacgccgaatataatcccaagcggtttgctgcggtaatcatgaggataagagagccacgaaccacggcactgattttcagttctgggaaaatggtgtgcacaggagccaagagtgaagaacagtccagactggcagcaagaaaatatgctagagttgtacagaagttgggttttccagctaagttcttggacttcaagattcagaatatggtggggagctgtgatgtgaagtttcctataaggttagaaggccttgtgctcacccaccaacaatttagtagttatgagccagagttatttcctggtttaatctacagaatgatcaaacccagaattgttctccttatttttgtttctggaaaagttgtattaacaggtgctaaagtcagagcagaaatttatgaagcatttgaaaacatctaccctattctaaagggattcaggaagacgacgtaatggctctcatgtacccttgcctcccccacccccttctttttttttttttaaacaaatcagtttgttttggtacctttaaatggtggtgttgtgagaagatggatgttgagttgcagggtgtggcaccaggtgatgcccttctgtaagtgcccaccgcgggatgccgggaaggggcattatttgtgcactgagaacaccgcgcagcgtgactgtgagttgctcataccgtgctgctatctgggcagcgctgcccatttatttatatgtagattttaaacactgctgttgacaagttggtttgagggagaaaactttaagtgttaaagccacctctataattgattggactttttaattttaatgtttttccccatgaaccacagtttttatatttctaccagaaaagtaaaaatcttttttaaaagtgttgtttttctaatttataactcctaggggttatttctgtgccagacacattccacctctccagtattgcaggacagaatatatgtgttaatgaaaatgaatggctgtacatatttttttctttcttcagagtactctgtacaataaatgcagtttataaaagtgttagattgttgttaaaaaaaaaaaaaaaaaa

SEQ ID NO: 1016 - DNA, 1340 bp, Homo sapiens
gcactgtctctatgctccccagcgtctagtctatttattgtcgcggggaagctgcggccgcctcgcacccggaacaacaaagcaaggaagacggagtccgagcctcgggggctcctagcaacgggccggggcgggagttccatggagactggggagcgcgcccgtctcatcctcatccttgtcctccagcttctccttcgcatccgacgcaaccggcagcagcgctgccgccgcgtcctcagccaccgctccctcttcccacggatgtgatcttcgtggtggaaagctaaattttaaaaccaccccaatggatgcagacagtgatgttgcattggacattctaattacaaatgtagtctgtgtttttagaacaagatgtcatttaaacttaaggaagattgctttggaaggagcaaatgtaatttataaacgtgatgttggaaaagtattaatgaagcttagaaaacctagaattacagctacaatttggtcctcaggaaaaattatttgcactggagcaacaagtgaagaagaagctaaatttggtgccagacgcttagcccgtagtctgcagaaactaggttttcaggtaatatttacagattttaaggttgtaaacgttctggcagtgtgtaacatgccatttgaaatccgtttgccagaattcacaaagaacaatagacctcatgccagttacgaacctgaacttcatcctgctgtgtgctatcggataaaatctctaagagctacattacagattttttcaacaggaagtatcacagtaacagggcccaatgtaaaggctgttgctactgctgtggaacagatttacccatttgtgtttgaaagcaggaaagaaattttataattcaccacttaattggttagaatctctaactgagcaccttttaaacctgctgcacattggactcaaaaggaaaactggaccaacaataattgaggaaatagactcttttattcattcacggctacagtgtaagctccagtccctttggattttattccaaaccttgctgtaatataaaaggaagtttacaagacatgatattgctgcttttacaaaaggacattctatttattttcgcagtaattctcatgtccccataagcagagctgtcacagtgtgcactaccttagattgttttattgtcgtcattgttatttttttccattttgagctaatgtgttttatttgtgaatagtcttttacatttttgtatgctgaatatgggcaccaaagaacctgtaaaagttatctttttcaattgaatgtgcacaaataaaagtttggaaaagataaaaaaaaaaaaaaaaaaaaa

SEQ ID NO: 1017 - DNA, 3186 bp, Homo sapiens
caggtgattatcctaattaatgtctatctaattaaattactgtcagcagctaaccaatggcaggagccgtttcatcggctgcacaagcagcaagatcaaaagtgagccttttctgattgctgcatagtgtcaattggccaatctcttctcccagggaaaaaaaaaagtaaatcaaacctttgagaagcatttgctggttgaagtgctttctgtctagtgagggggtctgtggatttctagtttatgataaataggactttaaaaaccagggacgggagggcgagtgttcaggttctagagctatgcagctggagcactgcctttctccttctatcatgctctccaagaaatttctcaatgtgagcagcagctacccacattcaggcggatccgagcttgtcttgcacgatcatcccattatctcgaccactgacaacctggagagaagttcacctttgaaaaaaattaccagggggatgacgaatcagtcagatacagacaattttcctgactccaaggactcaccaggggacgtccagagaagtaaactctctcctgtcttggacggggtctctgagcttcgtcacagtttcgatggctctgctgcagatcgctacctcctctctcagtccagccagccacagtctgcggccactgctcccagtgccatgttcccgtaccccggccagcacggaccggcgcaccccgccttctccatcggcagccctagccgctacatggcccaccacccggtcatcaccaacggagcctacaacagcctcctgtccaactcctcgccgcagggataccccacggccggctacccctacccacagcagtacggccactcctaccaaggagctccgttctaccagttctcctccacccagccggggctggtgcccggcaaagcacaggtgtacctgtgcaacaggcccctttggctgaaatttcaccggcaccaaacggagatgatcatcaccaaacagggaaggcgcatgtttccttttttaagttttaacatttctggtctcgatcccacggctcattacaatatttttgtggatgtgattttggcggatcccaatcactggaggtttcaaggaggcaaatgggttccttgcggcaaagcggacaccaatgtgcaaggaaatcgggtctatatgcatccggattcccccaacactggggctcactggatgcgccaagaaatctcttttggaaaattaaaacttacgaacaacaaaggagcttcaaataacaatgggcagatggtggttttacagtccttgcacaagtaccagccccgcctgcatgtggtggaagtgaacgaggacggcacggaggacactagccagcccggccgcgtgcagacgttcactttccctgagactcagttcatcgccgtcaccgcctaccagaacacggatattacacaactgaaaatagatcacaacccttttgcaaaaggatttcgggataattatgacacgatctacaccggctgtgacatggaccgcctgaccccctcgcccaacgactcgccgcgctcgcagatcgtgcccggggcccgctacgccatggccggctctttcctgcaggaccagttcgtgagcaactacgccaaggcccgcttccacccgggcgcgggcgcgggccccgggccgggtacggaccgcagcgtgccgcacaccaacgggctgctgtcgccgcagcaggccgaggacccgggcgcgccctcgccgcaacgctggtttgtgacgccggccaacaaccggctggacttcgcggcctcggcctatgacacggccacggacttcgcgggcaacgcggccacgctgctctcttacgcggcggcgggcgtgaaggcgctgccgctgcaggctgcaggctgcactggccgcccgctcggctactacgccgacccgtcgggctggggcgcccgcagtcccccgcagtactgcggcaccaagtcgggctcggtgctgccctgctggcccaacagcgccgcggccgccgcgcgcatggccggcgccaatccctacctgggcgaggaggccgagggcctggccgccgagcgctcgccgctgccgcccggcgccgccgaggacgccaagcccaaggacctgtccgattccagctggatcgagacgccctcctcgatcaagtccatcgactccagcgactcggggatttacgagcaggccaagcggaggcggatctcgccggccgacacgcccgtgtccgagagttcgtccccgctcaagagcgaggtgctggcccagcgggactgcgagaagaactgcgccaaggacattagcggctactatggcttctactcgcacagctaggccgcccctgcccgcccggccccgccgcggcccggacccccagccagcccctcacagctcttccccagctccgcctccccacactcctccttgcgcacccactcattttatttgaccctcgatggccgtctgcagcgaataagtgcaggtctccgagcgtgattttaaccttttttgcacagcagtctctgcaattagctcaccgaccttcaactttgctgtaaaccttttggttttcctacttactcttcttctgtggagttatcctcctacaattcccctccccctcgtctttctcttacctcctacttctctttcttgtaatgaaactcttcacctttaggagacctgggcagtcctgtcaggcagcagcgattccgacccgccaagtctcggcctccacattaaccataggatgttgactctagaacctggacccacccagcgcgtcctttcttatccccgagtggatggatggatggatggatggtagggatgttaataattttagtggaacaaagcctgtgaaatgattgtacatagtgttaatttattgtaacgaatggctagtttttattctcgtcaaggcacaaaaccagttcatgcttaacctttttttcctttcctttctttgcttttctttctctcctctcatactttctcttctctctcttttaattttcttgtgagataatattctaagaggctctagaaacatgaaatactcagtagtgatgggtttcccacttctcctcaatccgttgcatgaaataattactatgtgccctaatgcacacaaatagctaaggagaatccacccaaacacctttaaagg

SEQ ID NO: 1018 - DNA, 1538 bp, Homo sapiens
ccggcagggggagcgaggaggaagggaaccgcggccgggccagcggaggcggcggagcgcaccgcccaccagggctcagggtcctccgaccgggtgaagcttcgctggctgccaggatccccggcagggatgcacttcagcaccgtcaccagggacatggaagccttcacggccagcagcctgagcagcctgggggccgcggggggcttcccgggcgccgcgtcgcccggcgccgacccgtacggcccgcgcgagcccccgccgccgccgccgcgctacgacccgtgcgccgccgccgcccccggcgccccgggcccgccgccgccgccgcacgcctacccgtttgcgccggccgccggggccgccaccagcgccgccgccgagcccgagggccccggggccagctgcgcggccgcagccaaggcgccggtgaagaagaacgcgaaggtggccggtgtgagcgtgcagctagagatgaaggcgctgtgggacgagttcaaccagctgggcaccgagatgatcgtcaccaaggccggcaggcggatgtttcccaccttccaagtgaagctcttcggcatggatcccatggccgactatatgctgctcatggacttcgtgccggtggacgataagcgctaccggtacgccttccacagctcctcctggctggtggcggggaaggccgaccctgccacgccaggccgcgtgcactaccacccggactcgcctgccaagggcgcgcagtggatgaagcaaatcgtgtccttcgacaagctcaagctgaccaacaacctactggacgacaacggccacattattctgaattccatgcacagataccagccccgcttccacgtggtctatgtggacccacgcaaagatagcgagaaatatgccgaggagaacttcaaaacctttgtgttcgaggagacacgattcaccgcggtcactgcctaccagaaccatcggatcacgcagctcaagattgccagcaatcccttcgcgaaaggcttccgggactgtgaccctgaggactggccccggaaccaccggcccggcgcactgccgctcatgagcgccttcgcgcgctcgcggaaccccgtggcttccccgacgcagcccagcggcacggagaaagggctggtcacagaaggctctgggctccaacctggcttgctggacgtgctcttgaagcccccaagtaagaagtctgagtccctgagaccaccacactgcaaggacacttgaaggtactcaggtttcagagcccaagtcaggaggtcaagtgtgcatgcaagaggtggcaggggacagatgtgctgctgttcccaggccacctgcacagctggatggtggaagcagttcacttaaaggccatgagttactcgggaggctgaggcaggaggatcacttgagcctattagttggaggctgcagtaagctatgatcatgccactgcactccagcctgggtgacagagtgagacccccactgtccctggtctcttaaaagaaaaaacaaacaaacaaaccaaaaaa

SEQ ID NO: 1019 - DNA, 83 bp, Homo sapiens
aggaggcctcgcctctcccagctgggctggggctcctgtcccccactgtggtgtgcctggggcctggccaggactcccagtga

SEQ ID NO: 1020 - DNA, 3513 bp, Homo sapiens
tctttccggcttctttgcaaaaggatagaaccgtctcgaccagggcactaggactggaagatcgggctgtgtctaggccgctgtccgcgaaatccgagacgttttttcagcttggctaggaccgacttcgctgccggtttgagctttctctgcactcgggggtctcctgccgtcctcgaccggtggcgtaacttgggaagagattctgagcagagcactggttcagattctgaggtcctcactgagcggacttcctgctccttcagtactcacactgacctggcctctggtgctgcaggccctgtgcctgctgccatgtcttccatggaggagattcaggtggagctgcaatgtgctgacctctggaagcggttccatgatattggaactgaaatgatcatcaccaaagcaggcaggaggatgtttcctgccatgagagtgaaaatcactggcctagatccacatcagcagtactacatagcaatggacattgtgcctgtggacaataaaagatacagatatgtgtatcatagctccaagtggatggtggctggcaatgctgattcccctgtgcccccaagagtttatatacaccctgattctctagcttctggagacacctggatgagacaggtggtcagttttgacaaactcaagcttaccaacaatgagttggatgatcaaggacatatcattctgcactctatgcacaaataccagcctcgagttcatgtgattcgcaaagacttcagcagtgacctttcacccactaagcctgttcctgttggggatggggtgaaaacgttcaactttcctgagactgtgttcaccacagttacggcctatcagaatcagcagattaccagattaaaaattgaccgaaacccttttgctaaaggattcagagattctgggagaaacagaactggacttgaagccatcatggagacatatgcattctggagacctcctgtgcgcacactcaccttcgaagacttcaccaccatgcagaagcagcaaggaggcagcacaggcacttccccaaccacctccagcactgggacaccatccccttcggcttcttctcatcttttatctccatcctgttctcctccaacttttcatctggcccccaacactttcaatgtgggctgccgagaaagccagctgtgtaatctaaacctctctgattatccaccatgtgcccgaagcaacatggctgccttgcagagctacccagggctgagtgacagtggctacaacaggcttcagagtggcaccacttcagccactcagccctctgaaaccttcatgcctcagaggactccatccctgatctcaggaataccaactcctccctcgttgcctggcaacagcaagatggaagcctacggtggccagctggggtcctttcccacttcccagtttcagtatgtcatgcaggcaggcaatgctgcctccagctcctcatcaccacacatgttcgggggcagccacatgcagcagagctcctacaatgccttctcccttcacaacccttacaacctgtatggatacaatttccccacttcccctaggctagctgcaagcccggaaaaactgagcgcctctcaaagcactttactctgttcttctccttccaacggggcctttggagagaggcagtacctgccgtcagggatggagcacagcatgcacatgattagcccttcacccaataaccaacaggcaaccaacacttgtgatggccggcagtatggggcagttccaggctcctcctcccagatgtccgtgcacatggtttaaaggccagtccaaacaccacggagcatttggcaatcaaggccccagagtctccgtggtcagatcctcctctttgggagtccagtgtctttgaaaaacaggaaccgtgttttttttttttttttttttctggccgaagacatatacccaagaacaagagatacctttaagccagtgaaggatacttgcgatagaatcatccgcaactcagtggccattcttctgccttcccagaccttagttttataaagcattgtctgttccagagtggcctttgaagagactgaataatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaatagtacattgcattttgaagttttgggttttgtccttcatctttccctttcccttcaaatcttttaatggtaagaaagcaagtgaagcttggtgcaagctaaaatttttaaatggtgtggaaatgcaaataataccaagtaaaataatacagatattattaaagtttctggttttgaggtgttgtagataaatgtatttatgtgcctagtggggaatccaatattatgaatatgaaaaagggggcaataaaagggtatgtaaaatatgtatgaagaaaaggtgtacaaaaatttgcccttatgcacggaactctgtttctaagtgccaagcacagaaagccgctaaataaaatctttgcaattgttttcaaaaaaaaaaaaaaaaaa

SEQ ID NO: 1021 - DNA, 545 bp, Homo sapiens
ctctggaagcgctttcatgagataggcactgagatgatcatcaccaaggccggcaggcgcatgtttccagcaatgagagtgaagatctctggattagatcctcaccagcaatattacattgccatggatattgtaccagtggacaacaaaagatacaggtatgtttaccacagttcgaaatggatggtggcaggtaatgctgactcgcctgtgccaccccgtgtgtacattcatccagactcgcctgcctcgggggagacttggatgagacaagttatcagcttcgacaagctgaagctcaccaacaatgaactggatgaccaaggccatattattcttcattctatgcacaaataccaaccgcgagtgcacgtcatccgtaaagactgtggagacgatctttctcccatcaagcctgttccatccggggaaggagtaaaggcattctcctttccagaaactgtcttcacaaccgtcactgcctatcagaatcagcagattactcgcctgaagatagataggaatccatttgctaaaggcttccg

SEQ ID NO: 1022 - DNA, 2882 bp, Homo sapiens
tagaagcaggcaagttgggtaacggctctcggcaaagttcgagaagtgcctatggccatgagtgagctgggcactcggaagcccagcgatggcactgtttctcatctgctcaatgtggtggagagtgagcttcaggcagggagggaaaaaggcgaccctacggagaagcaacttcagatcatcctggaggatgcacctctctggcagagattcaaggaagtcactaatgagatgattgtgaccaagaatggcagacggatgtttccagtcctaaagattagtgtcacagggttggaccccaatgccatgtactccctcctgctggactttgtccctacggacagtcaccgctggaagtacgtcaacggggaatgggtgcccgctggcaagccagaggtctccagccacagctgcgtctacattcacccggactcccccaactttggggcccactggatgaaagctcccatctccttcagcaaagtgaagctgaccaacaagctcaatggaggcgggcagataatgttgaattctctgcataaatatgaaccccaggttcacatagtgcgtgttggaagtgcccatcgaatggtaacaaactgctccttccctgaaacccagttcatagccgtgactgcctatcagaatgaggagataacggctctcaaaatcaagtacaatccttttgccaaagccttcttggatgccaaggaaagaaatcacctaagagacgtaccggaggctatctctgagagccagcatgtgacctattctcacttgggaggctggatcttttccaatccagatggagtgtgcacagcaggaaactccaattaccagtatgccgctcctctgcctctgcctgctccccacacccaccatggctgtgagcactattcgggtctccgaggacaccggcaggctccctacccttctgcgtacatgcacagaaaccattctccctcagtgaatttgatagaaagctcaagcaataatctgcaagttttctcgggacctgacagctggacttccttatcctccacaccccatgccagcatcctgtctgtaccccacaccaacggaccaatcaatccagggcccagcccctacccgtgcctgtggaccatcagcaatggtgccggaggccccagtgggccaggcccggaggtgcacgccagcaccccaggagcatttctcctcggaaacccagctgtgacttcacccccttctgtgctctccacccaagcacccacttcggctggtgtggaggttctgggggagccctcgctaaccagcattgctgtgtccacctggacagcagtggcctcgcatcccttcgcgggctggggtggcccaggagcgggtgggcaccattctccttcctcactggatggttaagcaggatcctaggagcctctttgcacagcgatccttccatgtgtagagtgcttagaaaccccatcaactgatctagtgagtcagactgtggaatctcccttcccactagctggaggtggaggtgggttattacagaagtcatactgggagagggttcagtttggatgatgctagttagatcatttgcatctctccaccattttcttctgcactcccattttctctgcagcttattcttgccatgcttaggtgacagaagtttgttaagtaccatccttgtgccctgcctcttattctcaaatcgttctggaaagcctcacttccttttctgtggagaaggtgcaaagctgttaaatgagctcagagtttacctagctaaggccactgcttcctgctttgtgaagcctggaaagtatgtgtggccacagggctcaggttcacacttctgctttgagaccaggatggggtgtaagccatagagtaaggttaacaaaaagaataaagctaatcatgtattacaaacagcagtgtgcccagacttgtggaaatgaagtcatgtcactcctctgctcagaaaccttcaatggttcaccattaccagtggaatgaagtcaattctcctcactataactgggtgtggtagtttaagcctataatctcagcccttttggaggccaaggtaagaggatcgcttgaggtcaggagttcgagaccagcttgtgcaacaaagtgagagcctgtctctacaaaaaatagtcatgcacacaaaattagctgggcatggtggcctgtgcctatagtcccaactacttagaggaggatcgcttgatctcaggaggttgaggctgcagtgaattatgattgtggcattgcactccagcctgggtggtagatcaaggctttgtttcatttgaaaaaaaagaaagaaagaaagaaagaaagaaatcctactacgagcgatcacaccatctggcctgaaaccacttccccagcttaggtccctctgttatcctgttggcctcctatgtattggtcaaggcaggcatctctgttctctgaacattcattgcactttcccacctctataccttgcctgtgccttagtgtcctcttttttccagttcacctgtgcgaatccgacccacctcccagagcctggctgaaacgtcactccctgcatccaacatctgatctgctgagatatgtctgatctatctctgctcgctgttctcccgttgtttttgcctctgccatagagctcacctcattttgccttgtatttttgttacctgtgagtgtgtctctccctattagactgtaagcctctcgagggtgaggcctagccttcttgtctttgtaacccacagcagctggtactgtgccttgcctattgtaggtgcccaataaacatttgctgaactgaaaaaaaaaaaaaaaaaaaaaaaaaaaaaaaaaaaaaaaaaaaaaaaaaaaaaaaaaaaaaa

SEQ ID NO: 1023 - DNA, 3396 bp, Homo sapiens
cagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggcggatgttcccccccttcaaggtgcgagtcagcggcctggacaagaaggccaagtatatcctgctgatggacattgtagccgctgacgattgccgctataagttccacaactcgcgctggatggtggcgggcaaggccgaccctgagatgcccaaacgcatgtacatccacccagacagcccagccacgggggagcagtggatggctaagcctgtggccttccacaagctgaagctgaccaacaacatctctgacaagcacggcttcaccatcctaaactccatgcacaagtaccagccgcgcttccacatagtgcgagccaacgacatcctgaagctgccttacagcaccttccgcacctacgtgttcccggagaccgacttcatcgccgtcactgcctaccagaatgacaagatcacacagctgaagatcgacaacaacccgtttgccaagggcttccgggacaccgggaacggccggcgggagaaaaggaagcagctgacgctgccgtctctacgcttgtacgaggagcactgcaaacccgagcgcgatggcgcggagtcagacgcctcgtcgtgcgaccctccccccgcgcgggaaccacccacctccccgggcgcagcgcccagtccgctgcgcctgcaccgggcccgagctgaggagaagtcgtgcgccgcggacagcgacccggagcctgagcggttgagcgaggagcgtgcgggggcgccgctaggccgcagcccggctccagacagcgccagccccactcgcttgaccgaacccgagcgcgcccgggagcggcgtagtcccgagaggggcaaggagccggccgagagcggcggggacggcccgttcggcctgaggagcctggagaaggagcgcgccgaagctcggaggaaggacgaggggcgcaaggaggcggccgagggcaaggagcagggcctggcgccgctggtggtgcagacagacagtgcgtcccccctgggcgccggacacctgcccggcctggccttttccagccacttgcacgggcagcagttctttgggccgctgggagccggccagccgctcttcctgcaccctggacagttcaccatgggccctggcgccttctccgccatgggcatgggtcacctactggcctcggtggcaggcggcggcaacggcggaggtggcgggcctgggaccgccgcggggctggacgcaggcgggctgggtcccgcggccagcgcagcaagcaccgccgcgcccttcccgttccacctctcccagcacatgctggcatctcagggaattccaatgcccactttcggaggcctcttcccctacccctacacctacatggcagcagcagccgcagccgcctcggctttgcccgccactagtgctgcagctgccgccgccgcagccgccggctccctctcccggagccccttcctgggcagtgcccggccccgactgcgtttcagcccctatcagatcccggtcaccatcccgcctagcactagcctcctcaccaccgggctggcctctgagggctccaaggccgctggtggaaacagccgggagcctagccccctgcccgagctggctctccgcaaagtaggggccccatcccgcggtgccctgtcgcccagtggctcggccaaggaggcggccaatgaactgcagagcatccagagactggtgagtgggctggagagccagcgagccctctccccaggccgggagtcgcccaagtgaggggctgcccagctgctcccctgccacgcaggccacccgggctgcctgcccctgctgcttgggacgtgtacagcacagaatgagtatttatttaaataaaggagaaaagtgggctgcagcagccggaatagagcctcgtctggcaagtcggggcctgggacacttccctgggcctcaacaaggatcaggctgctggaaacacagtcacttgggagctgctgggctaggtccagatccgctccagcgtcaaggtggcatccgaaggtgtctctggtcttccagcgaggtgggagaggcctcatccagggcccagcggtccctgcagaagccagaaggtgcaggggccaggggtgggagcatcggagggagtcccagagccctggaccttgggcctagaccgcgtgataaaactgggttgagggatgctggaaccagttacgactgaagtcagtgtagacctgagctgggagggaacctgttagtctccccacctcttccctgaagagacaggcacccctcccagccgtggtcaacggagggagtggcacttctgccttgagtccccaggggaaaaaaaaaaaagatatttatgaaataaatggtaatttgtgtaaataagctttaaggttcccagaatatgcaaattggtattaatttattcaaaggtgtacattgctgtgtacatatatttagagattaactcatacatttaaagtttttttcattttacgtgagcatctatattgtacagggctgggggggcccttggctgcgggagaaggcccagagccctggaggagccaccaccccgccggcccctcgacccctcggcccctcggcccctccgcccgggtttggctcgcccggcccgcgggctccacctcaggttttcacttttcgctccggagcgagaacgaaacgacaaaaacgcaagaaaacaataaaacgctagaaagcgaaaaaaaaaaaaaaaaaa

SEQ ID NO: 1024 - DNA, 602 bp, Homo sapiens
atggccaaaattgcctgcagcctggagaccaaggagctttgggacaaattccatgagctgggcaccgagatgatcatcaccaagtcgggcaggaggatgtttccaaccatccgggtgtccttttcgggggtggatcctgaggccaagtacatagtcctgatggacatcgtccctgtggacaacaagaggtaccgctacgcctaccaccggtcctcctggctggtggctggcaaggccgacccgccgttgccagccaggctctatgtgcatccagattctccttttaccggtgagcaactactcaaacagatggtgtcttttgaaaaggtgaaactcaccaacaatgaactggatcaacatggccatataattttgaactcaatgcataagtaccagccaagggtgcacatcattaagaagaaagaccacacagcctcattgctcaacctgaagtctgaagaatttagaactttcatctttccagaaacagtttttacggcagtcactgcctaccagaatcaactgataacgaagctgaaaatagatagcaatccttttgccaaaggattccgggattcctccaggctcactgacattgagag

SEQ ID NO: 1025 - DNA, 2589 bp, Homo sapiens
cggcccgctggagaggaagcccgagagctgccgcgcgcctgccggacgagggcgtagaagccaggcgtcagagcccgggctccggtggggtcccccacccggccctcgggtcccccgccccctgctccctgcccatcccagcccacgcgaccctctcgcgcgcggaggggcgggtcctcgacggctacgggaaggtgccagcccgccccggatgggcatcgtggagccgggttgcggagacatgctgacgggcaccgagccgatgccggggagcgacgagggccgggcgcctggcgccgacccgcagcaccgctacttctacccggagccgggcgcgcaggacgcggacgagcgtcgcgggggcggcagcctggggtctccctacccggggggcgccttggtgcccgccccgccgagccgcttccttggagcctacgcctacccgccgcgaccccaggcggccggcttccccggcgcgggcgagtccttcccgccgcccgcggacgccgagggctaccagccgggcgagggctacgccgccccggacccgcgcgccgggctctacccggggccgcgtgaggactacgcgctacccgcgggactggaggtgtcggggaaactgagggtcgcgctcaacaaccacctgttgtggtccaagtttaatcagcaccagacagagatgatcatcaccaagcagggacggcggatgttcccattcctgtcatttactgtggccgggctggagcccaccagccactacaggatgtttgtggacgtggtcttggtggaccagcaccactggcggtaccagagcggcaagtgggtgcagtgtggaaaggccgagggcagcatgccaggaaaccgcctgtacgtccacccggactcccccaacacaggagcgcactggatgcgccaggaagtttcatttgggaaactaaagctcacaaacaacaagggggcgtccaacaatgtgacccagatgattgtgctccagtccctccataagtaccagccccggctgcatatcgttgaggtgaacgacggagagccagaggcagcctgcaacgcttccaacacgcatatctttactttccaagaaacccagttcattgccgtgactgcctaccagaatgccgagattactcagctgaaaattgataataacccctttgccaaaggattccgggagaactttgagtccatgtacacatctgttgacaccagcatcccctccccgcctggacccaactgtcaattccttgggggagatcactactctcctctcctacccaaccagtatcctgttcccagccgcttctaccccgaccttcctggccaggcgaaggatgtggttccccaggcttactggctgggggccccccgggaccacagctatgaggctgagtttcgagcagtcagcatgaagcctgcattcttgccctctgcccctgggcccaccatgtcctactaccgaggccaggaggtcctggcacctggagctggctggcctgtggcaccccagtaccctcccaagatgggcccggccagctggttccgccctatgcggactctgcccatggaacccggccctggaggctcagagggacggggaccagaggaccagggtccccccttggtgtggactgagattgcccccatccggccggaatccagtgattcaggactgggcgaaggagactctaagaggaggcgcgtgtccccctatccttccagtggtgacagctcctcccctgctggggccccttctccttttgataaggaagctgaaggacagttttataactattttcccaactgagcagatgacatgatgaaaggaacagaaacagtgttattaggttggaggacaccgactaatttgggaaacggatgaaggactgagaaggcccccgctccctctggcccttctctgtttagtagttggttggggaagtggggctcaagaaggattttggggttcaccagatgcttcctggcccacgatgaaacctgagaggggtgtccccttgccccatcctctgccctaactacagtcgtttacctggtgctgcgtcttgcttttggtttccagctggagaaaagaagacaagaaagtcttgggcatgaaggagctttttgcatctagtgggtgggaggggtcaggtgtgggacatgggagcaggagactccactttcttcctttgtacagtaactttcaaccttttcgttggcatgtgtgttaatccctgatccaaaaagaacaaatacacgtatgttataaccatcagcccgccagggtcagggaaaggactcacctgactttggacagctggcctgggctccccctgctcaaacacagtggggatcagagaaaaggggctggaaaggggggaatggcccacatctcaagaagcaagatattgtttgtggtggttgtgtgtgggtgtgtgttttttctttttctttctttttattttttttgaatgggggaggctatttattgtactgagagtggtgtctggatatattccttttgtcttcatcactttctgaaaataaacataaaactgttaaaaaaaaaaaaaaaaa

SEQ ID NO: 1026 - DNA, 2248 bp, Homo sapiens
caaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttgaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggcggatgttcccctctgttcgggtcaaggtgaaagggttggatccagggaagcagtaccatgtggccatcgatgtggtgccggtggattccaaacgctataggtacgtctatcacagctcacagtggatggtagctgggaatacagaccatttgtgcatcattcctagattctatgttcacccggactcaccctgctcgggagagacctggatgcggcagatcatcagctttgatcgcatgaaactcaccaacaatgagatggatgacaaaggccacatcattctgcaatccatgcataagtacaaaccccgagtgcacgtgatagagcaaggcagcagtgttgacctgtcccagattcagtccttgcccactgaaggtgttaaaacattctcctttaaagaaactgagttcaccacagtaacggcttaccaaaaccaacagattacgaaactaaaaatagaaagaaatccttttgctaaaggatttagagatactggaagaaacaggggtgtattggatgggcttttagagacctacccatggaggccttctttcactctcgattttaaaacctttggcgcagacacacaaagtggaagcagtggctcatctccagtgacctctagtggaggggccccctctcctttgaactccttactttctccactttgcttttcacctatgtttcatttacctacaagctcccttggaatgccctgtccagaggcatacctgcccaatgtcaacctgcctctatgctacaagatttgtccaactaatttttggcaacagcaacctcttgttttaccggctcctgaaagactagcaagcagcaacagttctcagtctttagccccactcatgatggaagtgcctatgttatcttccctgggggtcaccaattcaaaaagcggttcatctgaagactccagtgatcagtatctacaagcacctaattctaccaatcaaatgttatatggattacagtcacctggaaatatttttctgccaaactccatcaccccagaagcacttagttgctcctttcatccttcctatgacttttatagatacaatttctctatgccatctagactgataagtggttccaaccatcttaaagtgaatgacgacagtcaagtttcttttggagaaggcaaatgtaatcatgttcattggtatccagcaattaaccattacctttagtaagacaatagcatttctagaacaattacatgtaaacaaatattttctttatttgtagccaaagaaatttcaacagttattgggcttaaaaagcatcattacaatacagtatttctttgttatacatttaaagatttaaagtgccttatcaaataatattcatgaagagttgtttataatgtcaaatgaaacctacaggaatctctgattacagtggccttgagcttcaaaatgagatatgcaataaatattatttgatgatactccaccagtgaaaattgatgctaagtgatgggattttcaattatactgaagctagttcaccacgttaactgcattttacacattgacaatgacaaaaagaagatggatgtaattctcatgaaagcagtgaagcaatttcagttttaaaaatgaagatcggctttcatgtaattatctagtagttgtagaagaaaatttaattatttgtttgcctcatgcctttatactttgctgttgaagaaactactaatctcaatttaagatacaaataaggacacaaactttcaagtattatattttatttatctttgtagcctaaagaccatttaatcttgaaggaacacaaagatcaaatgaaaagtaaaacactctaaataaatttgcttttattttc

SEQ ID NO: 1027 - DNA, 4754 bp, Homo sapiens
gaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtctaaaaaaaaaaaaaaaaaaaaaaaaaaaaaaa

SEQ ID NO: 1028 - DNA, 2470 bp, Homo sapiens
tgtggacctgggcgagtgactcgttgtgtgctgtgcccgcaggagatgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcagaccatcgagaacatcaaggtggggctgcatgagaaggagctctggaagaagttccacgaggcgggcaccgagatgatcatcactaaggctggcaggaggatgttccccagctacaaggtaaaagtcacaggcatgaaccccaagaccaagtatatcctgctgattgacattgtccctgccgatgaccatcgctacaagttctgtgacaacaaatggatggtggcagggaaggctgagccagccatgccaggaaggctgtatgtccacccggattctcctgccacaggagcccactggatgcggcagctggtctccttccagaagctgaagctgacaaacaaccacctggacccctttggccatatcatcctcaactctatgcacaagtaccagccgcggctccacatcgttaaggctgatgagaacaatgctttcggctccaaaaacactgctttctgcacccacgtgttcccagagacctccttcatctctgtgacctcctaccagaatcacaagatcacccagctgaaaattgagaacaacccttttgccaagggattccggggcagtgatgacagtgacctgcgtgtggcccgactgcagagcaaagaataccccgtgatttccaaaagcatcatgaggcagaggctcatctccccccagctctcagccacaccggacgtgggccccctgctcggcacccaccaggcactccagcactaccagcacgagaacggggcacactcacagctcgcggagccgcaggacctgcccctcagcacctttcccacccagagggactcaagcctcttctatcactgcctgaaaagacgagacggtacccgccacctggacttaccttgcaagcgatcctatctggaagccccctcttcggtgggggaggatcactatttccgttccccccctccctacgaccagcaaatgctgagcccctcctactgcagtgaggtgacccccagagaagcatgtatgtactcaggttcagggcccgagattgccggggtgtctggggtggacgacctgcccccacctccgctgagctgtaacatgtggacttcagtgtcgccgtacaccagctatagcgtgcagacgatggagactgtgccgtaccagcccttccccacgcacttcaccgccaccaccatgatgccgcggctgcccaccctctccgctcagagctcccagccaccaggaaatgcccactttagtgtctacaatcagctctcccagtctcaggtccgagagcgggggcccagcgcctcattcccaagagagcgcggcctcccccaagggtgtgagaggaagccaccctcgccacatctaaatgctgccaatgagtttctctactctcaaaccttctccttgtcccgagaatcttccttacagtaccattcaggaatggggactgtggagaactggactgacggatgactctcacgtctcctccatagccccgggaccgtgttgctccagtattaacctctgtgggtggcctgcactctaccaagaaacacaggaaggtattccagtgtgtgtgtgtgtgtgtgtgtgtgtgtgtgtgtgtgtgtatacacgagcatgtatgtatttggagagcatccatcttctgacatacaactgaggtcatgacaaggaaaaaaaacaccacatttatctaagaagtgattttggctgcaggacctgggtctattgttatctgacatctcttgacatgcccgtgggtgggatgggagtggagggttcatatgagttattgagagggttttataatggttgatttactcaggggccaggtggggagttctctcccatggggaaagattctcactgctggggtgggaagattctcgctgctggggtgtgaggactctgtgcacaccttagagttcctggccttctctttgcaaggggagctgagaatctggttttggtagcaggaggcccactcctttgacttctggagagtctgtgagactgcctgagaggtgggctcagctaagccacaatgtgtactttgatagtacagctggctgctcagtgagtggcctagacattgatgactggagctctgaggtctgagggatgacgttcggaaagggtcatgggctaaatgtcacctgaggggtatttttaaagggtttttttttcccttcaagaggagggaaaatgcaaccagtagcatctctgtcatcattcagattttgtaataaagtacaga

SEQ ID NO: 1029 - DNA, 3921 bp, Homo sapiens
catgccttatgcaagagacctcagtcccccggaacaactcgatttccttccaatagaggtctgaggtggactcccacctcccttcgtgaagagttccctcctctcccccttcctaagaaagtcgatcttggctctatttgtgtcttatgttcatcaccctcattcctccggagaaagccgggttggtttatgtctttatttattcccggggccaagacgtccggaacctgtggctgcgcagacccggcactgataggcgaagacggagagaaatttacctcccgccgctgccccccagccaaacgtgacagcgcgcgggccggttgcgtgactcgtgacgtctccaagtcctataggtgcagcggctggtgagatagtcgctatcgcctggttgcctctttattttactggggtatgcctggtaataaacagtaatatttaatttgtcggagaccacaaaccaaccttgagctgggaggtacgtgctcttcttgacagacgttggaagaagacctggcctaaagaggtctcttttggtggtccttttcaaagtcttcacctgagccctgctctccagcgaggcgcactcctggcttttgcgctccaaagaagaggtgggatagttggagagcagaaccttgcgcgggcacagggccctgggcgcaccatggccgacgcagacgagggctttggcctggcgcacacgcctctggagcctgacgcaaaagacctgccctgcgattcgaaacccgagagcgcgctcggggcccccagcaagtccccgtcgtccccgcaggccgccttcacccagcagggcatggagggaatcaaagtgtttctccatgaaagagaactgtggctaaaattccacgaagtgggcacggaaatgatcataaccaaggctggaaggcggatgtttcccagttacaaagtgaaggtgacgggccttaatcccaaaacgaagtacattcttctcatggacattgtacctgccgacgatcacagatacaaattcgcagataataaatggtctgtgacgggcaaagctgagcccgccatgcctggccgcctgtacgtgcacccagactcccccgccaccggggcgcattggatgaggcagctcgtctccttccagaaactcaagctcaccaacaaccacctggacccatttgggcatattattctaaattccatgcacaaataccagcctagattacacatcgtgaaagcggatgaaaataatggatttggctcaaaaaatacagcgttctgcactcacgtctttcctgagactgcgtttatagcagtgacttcctaccagaaccacaagatcacgcaattaaagattgagaataatccctttgccaaaggatttcggggcagtgatgacatggagctgcacagaatgtcaagaatgcaaagtaaagaatatcccgtggtccccaggagcaccgtgaggcaaaaagtggcctccaaccacagtcctttcagcagcgagtctcgagctctctccacctcatccaatttggggtcccaataccagtgtgagaatggtgtttccggcccctcccaggacctcctgcctccacccaacccatacccactgccccaggagcatagccaaatttaccattgtaccaagaggaaagaggaagaatgttccaccacagaccatccctataagaagccctacatggagacatcacccagtgaagaagattccttctaccgctctagctatccacagcagcagggcctgggtgcctcctacaggacagagtcggcacagcggcaagcttgcatgtatgccagctctgcgccccccagcgagcctgtgcccagcctagaggacatcagctgcaacacgtggccaagcatgccttcctacagcagctgcaccgtcaccaccgtgcagcccatggacaggctaccctaccagcacttctccgctcacttcacctcggggcccctggtccctcggctggctggcatggccaaccatggctccccacagctgggagagggaatgttccagcaccagacctccgtggcccaccagcctgtggtcaggcagtgtgggcctcagactggcctgcagtcccctggcacccttcagccccctgagttcctctactctcatggcgtgccaaggactctatcccctcatcagtaccactctgtgcacggagttggcatggtgccagagtggagcgacaatagctaaagtgaggcctgcttcacaacagacatttcctagagaaagagagagagagaggagaaagagagagaaggagagagacagtagccaagagaaccccacggacaagatttttcatttcacccaatgttcacatctgcactcaaggtcgctggatgctgatctaatcagtagcttgaaaccacaattttaaaaatgtgactttcttgttttgtctcaaaacttaaaaaaacaaacacaaaaagatgagtcccaccccccactaccaccacacccatcaaccagccacattcacgctactccccagatctcttcccccattccttcttttgggctctagaaagtcttgcctcattgagtgtttttccctagtgcgtagttggagtctgtccctgtcttggtgttaatgttgacattgttatataataaatgataatatatttttttctttcaattttcttaatgggacccagtcccttatttggggggaggtctgaggcaagtatatttcaaaatatgtacttgcgggattcccttcaagtaaaccatccctgaaacctaaattcacgtttccccttgactaagaaaagcacctacctctgccatgtgatgtttctgaaaagcctctgtatgtccccatttgctttggttttgtcctgccttctccaatatcacgtgctcagttttgcctctacttacccatggagtcaggataacactgacgctccctggcatcctatcttattcagccctaccatcttgccagctctgtctttccagctgtctgtcgctaaaacgtggcctatagcttcccttccggaaagcttgctttgaaaaacttaaaaagcccccgtttacatgtaggcaggactgtgataacagtgcaagctctgtgttgacaagagttgtggacaaaaagccaaaataaatattcttcctgattaaaaaaattttttttgaaaaaaacaaggccagccccaaccttccaaacctccatcaccaacaacccaaactggatgtcaagcaaaatgcacaattcctacagaagaggcaagacacagtcaccaatgatatctcgccaaagaaaccacgcccacaccaatgccaacacaaaactgtgtttactgaaagccgaaaacagtattaaaaaaagtgtgtaagtaaagtgttatggtagggttcttcagatgtaatattttactggtactatttatttataaataggaattctaattaagtaataacatgaaatgaaacccagcataggagctggccaagagcttttaattttattgatactcaaaaccaagtttgtgtttttttgtttttttttgtttttttcctctttcgaatgtgctttgctttttttgattaaaaagaattttttttttccttttttataaacagaccctaataaagagaacagggtaagatgtgaggctgagtgtgtttaagtacgtgagagagtgtgagtgtgtttgtaagtgagtgtccctatgcgattatgtctctttacgttgctaaggggggagggtgaggattaagtactcgtgccttatatttgtgtgccaattaatgcctaataaataccatgtgcttaaacaagtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1030 - DNA, 1830 bp, Homo sapiens
agctgtcggactcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagagggagcgagacgcccgtgtgaagaggaaactgcggggcccagagccagcagccacagaggcctatgggagcggagacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggagccccagcttcccggaggctccagactccgggcgctcagccccctactcggctgcatttctggagctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcaggaaaaaaaaaaaaaaaaaaaaaaaaaaaaaa

SEQ ID NO: 1031 - DNA, 1220 bp, Homo sapiens
tcttttttttgcctgtccaccatctccctattaccctttggtcgagagggaaagcagaagaagtctgctggtcacagcggggcacctcgaggagaggacgactaggagcacacggcccggaaaggtccaggtcagggaagggaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaactttaaaaaaaaaaaaaaaa

SEQ ID NO: 1032 - DNA, 4233 bp, Homo sapiens
agacgtcgggtcggcgggtggatgaacgcggccctctgtaatggcggagcgtggcggggacgggggcgagagtgaacgattcaacccgggggagctcaggatggcccaacagcaggccttgaggttccgaggtccggctcccccaccaaatgcagtgatgcgaggcccaccacctctgatgcgacctcctccaccttttggtatgatgcgaggccctcctccaccaccacggccgccctttggacgtcctccttttgatcctaatatgccgccaatgcctcctccaggagggatacctccacctatgggccctccacacctccagagaccacctttcatgcctcctcccatgagttccatgcctcctcctccgggtatgatgtttccaccaggaatgcctcctgtgactgctcctggtactccagcactacctcctacggaggagatatgggttgaaaataaaactccagatgggaaggtttattattataatgctcggacacgtgaatctgcatggaccaagccagatggagttaaggttattcagcaatcagaactgacacctatgcttgcagcccaggcacaggttcaggctcaggcccaggcgcaggctcaggcccaggcgcaggctcaggcccaggcacaagctcaggcccaggctcaggctcaggcccaggcccaggcccaggcccaggcccaggcccaagcccaagcccaggcccaggctcaggctcaggcacaagctcaggcccaggcccaggctcaggtccaggcccaggtccaggcacaagtgcaagcacaagcagttggagcttccacccctacgaccagtagcccagcacctgcagtatccacttcaacatcatcatccaccccttcctctaccacttctaccacaacaactgctacttcagttgcgcagacagtatcaacacccacaacacaagatcagaccccaagttctgctgtttcagttgccacgcctacagttagtgtttcaactcctgctcctacagccacacctgtgcaaaccgttccccagccgcaccctcagacgttacctcctgctgttcctcattcagtacctcagccaacaacagcaatacctgcttttccaccagtaatggtacctccgtttcgtgttccccttcctggcatgccaattccacttccaggtgtagcaatgatgcaaatagtcagctgcccgtatgtaaagacagtcgctaccaccaagaccggtgtattgccaggaatggcccctcctatcgtacccatgatacatccccaggttgctattgcagcttcacctgctaccttagctggagcaacagcagtttctgaatggactgaatataaaacagcagatgggaagacatattattataataatagaacattagaatcaacctgggaaaaaccccaagaactaaaggaaaaagaaaagttagaagagaagattaaagagccaattaaagaaccctctgaagagcctctgccaatggagacggaggaggaggatcctaaagaagagcctataaaggagataaaggaggagcccaaagaagaggagatgactgaagaagaaaaggctgcccagaaggcaaagccagttgctactgctcctattcctggtactccatggtgtgtcgtttggactggtgatgagcgggtcttcttttataatcccaccactcgtctttctatgtgggaccgacctgatgatctgattggcagggcagatgttgacaaaattattcaggagccccctcataaaaaaggaatggaggaattgaagaaactaaggcacccaactccgacaatgctgtcgatccaaaagtggcaattctctatgagtgcaattaaagaggaacaagaattaatggaagaaattaatgaagatgagcctgttaaagcaaaaaaacggaagagagacgataataaagacattgactcagagaaagaagctgccatggaagctgaaattaaagctgcccgagaaagggccattgtccctctggaggctcgaatgaagcagttcaaggacatgctgctagagagaggggtgtctgctttttcaacgtgggagaaggagttgcacaagatagtttttgatccccggtacttacttctcaatcctaaagagagaaaacaggtgtttgatcagtatgtaaagaccagggcagaggaagaacgcagggaaaagaaaaataaaataatgcaagccaaggaagatttcaaaaaaatgatggaagaagcaaaatttaatccaagagcaacttttagtgaatttgcagccaagcatgctaaagattcaagattcaaagcaattgaaaagatgaaagaccgagaagccttgtttaatgagtttgtggccgctgctaggaagaaagagaaagaagattcgaagaccagaggtgagaagattaaatcggatttctttgaactattatctaatcatcacttggacagtcagtctcgatggagcaaagtaaaagacaaagtagaaagtgatccacgttacaaagcagtagatagttcatcaatgagagaagaccttttcaaacagtacattgaaaaaatagccaagaatttagactcagaaaaagaaaaggagcttgaaaggcaagcccgcattgaggcaagccttcgagaacgagaaagggaggttcaaaaggcccgttcagaacaaacaaaagaaatagatcgagagagagagcagcacaaacgagaagaagctatccagaatttcaaagctcttctgtctgacatggtacgttcttcagatgtgtcatggtctgatactcgtaggaccctccgaaaagatcaccgctgggaatctggatccttattggaaagagaggagaaagagaagctttttaatgaacacattgaagcacttaccaaaaaaaagagagagcactttaggcaacttctggatgaaacttctgcaattaccttaacatccacgtggaaagaagtaaaaaaaatcattaaggaagatcctcgatgtattaagttctcctccagtgacaggaaaaaacaaagagaatttgaagaatatatcagagacaaatatatcacagccaaagctgacttcaggacgcttttgaaagagaccaaatttataacatatagatccaaaaaattaatccaagaatcagatcagcacctgaaagatgtagaaaaaattttacagaatgacaaacggtatctagtactggactgtgtgccagaggagaggcgtaaactgattgtggcatatgttgatgacctggatcgccggggtccacccccacctcccacagcatcggagcccacgagacgatcaacaaaataattctaaatactcttccataggggcatctattcaaaatgcttgcatgagccaattttcaggtttttacatatatgtgcattagtcaacctattgcgaaaccatctgacaaacagaaggagaagcatttgtgaacagtttctgaacagaacactttggaaatatttatgcttttctttgtgtggcatgactgacatacatactcaaatataggctgtctctagtaaatcttaaaatcttgaagctaaaattcatccttttatgaggtgtggaagtcagtgacttggtgacgttcttcctagcagtgttaatacatgcaagaagtaagagcatttgtggcttgaacttgccagatgcaaataccacagactccaagaaaacccgagttggggtttgttttgttttgattttttttttttaaagcgggtaaaagagaaaacactgaaaattgaattcttatcttccagaggctacaattattataatggacaatacttttacctttgtctctaaagatcagattagttttatttgttcacttacgtgctttgattatcccctctgaattatagaccgagtcttgttgtttagcctaagagaagatttatgtagtaatttcttctcaggtatggaaccacggtcataactaacatgttggccagaatagaaccactggttaaacatattttattcaccattaagtgatctttatcaatattctggattagacaacaaattacctttctgggtgtttcttgtaaactatactcctgtttgaatgttaaactttgttgctaaagtttaattttaagatgtttgaatgttcagtttatgtatttgaactacaataaaccaaccctttttataaaaaaaaaaaaaaaaaaaaaaaaaaaaaaaaa

SEQ ID NO: 1033 - DNA, 3241 bp, Homo sapiens
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatggggaagacttcacgccacccatcctcaaagagctggagaacctcagccctgaggaggcggcccaccagaaagccgtggtggagacccttctgcaggaggacccgtggcgtgtggcgaagatggtcaagtcctacctgcagcagcacaacatcccacagcgggaggtggtcgataccactggcctcaaccagtcccacctgtcccaacacctcaacaagggcactcccatgaagacgcagaagcgggccgccctgtacacctggtacgtccgcaagcagcgagaggtggcgcagcagttcacccatgcagggcagggagggctgattgaagagcccacaggtgatgagctaccaaccaagaaggggcggaggaaccgtttcaagtggggcccagcatcccagcagatcctgttccaggcctatgagaggcagaagaaccctagcaaggaggagcgagagacgctagtggaggagtgcaatagggcggaatgcatccagagaggggtgtccccatcacaggcacaggggctgggctccaacctcgtcacggaggtgcgtgtctacaactggtttgccaaccggcgcaaagaagaagccttccggcacaagctggccatggacacgtacagcgggccccccccagggccaggcccgggacctgcgctgcccgctcacagctcccctggcctgcctccacctgccctctcccccagtaaggtccacggtgtgcgctatggacagcctgcgaccagtgagactgcagaagtaccctcaagcagcggcggtcccttagtgacagtgtctacacccctccaccaagtgtcccccacgggcctggagcccagccacagcctgctgagtacagaagccaagctggtctcagcagctgggggccccctcccccctgtcagcaccctgacagcactgcacagcttggagcagacatccccaggcctcaaccagcagccccagaacctcatcatggcctcacttcctggggtcatgaccatcgggcctggtgagcctgcctccctgggtcctacgttcaccaacacaggtgcctccaccctggtcatcggcctggcctccacgcaggcacagagtgtgccggtcatcaacagcatgggcagcagcctgaccaccctgcagcccgtccagttctcccagccgctgcacccctcctaccagcagccgctcatgccacctgtgcagagccatgtgacccagagccccttcatggccaccatggctcagctgcagagcccccacgccctctacagccacaagcccgaggtggcccagtacacccacacgggcctgctcccgcagactatgctcatcaccgacaccaccaacctgagcgccctggccagcctcacgcccaccaagcaggtcttcacctcagacactgaggcctccagtgagtccgggcttcacacgccggcatctcaggccaccaccctccacgtccccagccaggaccctgccggcatccagcacctgcagccggcccaccggctcagcgccagccccacagtgtcctccagcagcctggtgctgtaccagagctcagactccagcaatggccagagccacctgctgccatccaaccacagcgtcatcgagaccttcatctccacccagatggcctcttcctcccagtaaccacggcacctgggccctggggcctgtactgcctgcttggggggtgatgagggcagcagccagccctgcctggaggacctgagcctgccgagcaaccgtggcccttcctggacagctgtgcctcgctccccactctgctctgatgcatcagaaagggagggctctgaggcgccccaacccgtggaggctgctcggggtgcacaggagggggtcgtggagagctaggagcaaagcctgttcatggcagatgtaggagggactgtcgctgcttcgtgggatacagtcttcttacttggaactgaagggggcggcctatgacttgggcacccccagcctgggcctatggagagccctgggaccgctacaccactctggcagccacacttctcaggacacaggcctgtgtagctgtgacctgctgagctctgagaggccctggatcagcgtggccttgttctgtcaccaatgtacccaccgggccactccttcctgccccaactccttccagctagtgacccacatgccatttgtactgaccccatcacctactcacacaggcatttcctgggtggctactctgtgccagagcctggggctctaacgcctgagcccagggaggccgaagctaacagggaaggcaggcagggctctcctggcttcccatccccagcgattccctctcccaggccccatgacctccagctttcctgtatttgttcccaagagcatcatgcctctgaggccagcctggcctcctgcctctactgggaaggctacttcggggctgggaagtcgtccttactcctgtgggagcctcgcaacccgtgccaagtccaggtcctggtggggcagctcctctgtctcgagcgccctgcagaccctgcccttgtttggggcaggagtagctgagctcacaaggcagcaaggcccgagcagctgagcagggccggggaactggccaagctgaggtgcccaggagaagaaagaggtgaccccagggcacaggagctacctgtgtggacaggactaacactcagaagcctgggggcctggctggctgagggcagttcgcagccaccctgaggagtctgaggtcctgagcactgccaggagggacaaaggagcctgtgaacccaggacaagcatggtcccacatccctgggcctgctgctgagaacctggccttcagtgtaccgcgtctaccctgggattcaggaaaaggcctggggtgacccggcaccccctgcagcttgtagccagccggggcgagtggcacgtttatttaacttttagtaaagtcaaggagaaatgcggtggaaaaa

SEQ ID NO: 1034 - DNA, 4734 bp, Homo sapiens
tccggaggcgagccgagcgcggtggtgaggccgcctcagcgaaaaaaatgtccgcctgaagagacccacaagttctattcggggggaccgacagcccgccccgggaggaaggggcggccaggcccgaaagccgcctccccctcccagacccgagagctcgtgcggggcaaagtgaaccgagccgctgggcggtgcaaggggaagcccaagcccgttctcccggccaaagtgaactttaatcggggtggttggatgcggagacggggcggcaggacctgctagaagtggccgaagatgaatccccagcaacaacgcatggccgctatagggaccgacaaggagctgagcgacctactggacttcagtgcgatgttttccccacctgttaatagtgggaaaactagaccaactacactgggaagcagtcaattcagtggatcaggtattgatgaaagaggaggtacaacatcttggggaacaagtggtcaaccaagtccttcctatgattcatctagaggttttacagacagccctcattacagtgatcacttgaatgacagtcgattaggagcccatgaaggcttgtccccaacacctttcatgaactcaaatctgatgggaaaaacatcagagagaggctcattttccctgtacagcagagatactggattaccaggctgtcaatctagtctcctgagacaagatctggggcttgggagcccagcacagctatcttcttcaggaaaacctgggacagcatactattcattctctgctacaagttccaggaggagaccactccatgactctgcagcgcttgatcccttgcaagcaaaaaaagtcagaaaggtgcctcctggtttgccttcttctgtatatgcaccatccccaaattcagatgatttcaaccgtgaatctcctagttatccatctcctaagccaccaaccagtatgttcgctagcactttctttatgcaagatgggacccacaattcttctgacctttggagttcatcaaatgggatgagccagcctggttttggtggaattctggggacctccacttcccacatgtctcaatccagtagttatggcaaccttcattcacatgaccgcttgagttatcctccacactcagtttcaccaacagacataaacacgagtcttccaccaatgtccagctttcatcgcggcagtaccagcagttcaccttacgttgctgcctcacacactcctcccatcaatggatcagacagcattctaggaaccagagggaatgctgctggaagctcacagacaggtgatgcacttggaaaggctttggcatctatttattctcctgaccataccagcagtagttttccgtcaaatccatcaacaccagttggatcaccttcacctctcacaggtaccagtcagtggccaagacctggagggcaagcaccttcatccccaagctatgaaaactcactccactccctgcagtctcgaatggaggatcgtttagacagactggatgatgcaatccatgtgctgcggaaccatgctgtgggaccttccaccagtttgcctgctggtcacagtgatatacatagtttattgggaccatcccataatgcaccaattggaagcctcaattcaaactatggaggatcaagccttgttgcaagcagtcgatcagcttcaatggttggaactcatcgggaagactctgtcagtctcaatggcaatcattcagtcctgtctagtacagtcactacttcaagcacagacctgaaccataaaacacaagaaaattatagaggtggcttgcaaagtcagtctggaactgttgttacaacagaaatcaagactgaaaacaaagaaaaggatgaaaaccttcatgaacctccttcatcagatgacatgaagtcagatgatgaatcctcccaaaaagatatcaaggtttcatctagaggcagaacaagcagtactaatgaagatgaggatttgaaccctgaacagaagatagaaagggagaaggagaggcggatggctaacaatgccagagaacgcttacgcgtgcgggatattaatgaagcattcaaagagcttggccgaatgtgtcagcttcacttgaagagtgaaaaaccccaaacaaaactccttattcttcatcaagccgtggcagtcatccttagtctagaacagcaagtcagagagaggaaccttaaccccaaagcagcctgccttaagagaagggaagaagaaaaagtttctgccgtatcggcagagccgccaaccacactgccaggaacccatcctgggcttagtgaaactaccaaccctatgggtcatatgtaaacatcagccagttccagagttatcagtaggctagatagaaggtgacctctcctcataaggacttggacaactcagattatctgaagacacaaacctgacaggagggagaagaaaaaacaaaacacttgaaccaagaaactcaaatgtaatcctacgatcaaagcaactggtcaacacttccatcagaagtgaagataggaagctcatcagatagaacatcagcccatgagatgtttgcaacaaatcttttgttgcaagcagtgtgtcgcttctgcacaatcagagactgtctcgatctctccactcaccgtggaagttgccttgtgcctaaactgaattgacaaatgcattgtaactacaaattttatttattgttatgaaactgtaaggtctacatataaagggaaaaagttaatgtggaaagctgatctacactcagctgatgccagcatacattaaagcggttcacgtgcagagaacaaagcagtgacaaccattggcccttagcattcccggcatacctattagtgtcttaaaaaggaagggaaaagtcttttgttgccctctcctatcctcttgccatatgaatagcgttttccatgaaataggaaaatattacttggtatagcatttctcttgctctcattttttgatttatttttattttctctttgtgggtgttatatttgatctctaaatctgaacagtttatggtcacagtccagcctcctccgtgcagccctgtgtgctttgcacatttaccttacagtggtaagcagagaccatctgtgaccatagcctagctagcattttaaaaggggaaattttgttctctaggttttcccccaaataaacattgctttatttctaataataaccaagacttttcaagcttctagatctcataggaaagcttgtaatagcaaaattgtaaattacaagggaagaatctactttttagaaatcgctttgttttccaagcagtaagtactacatacagtacttgtaaagtgttagctgtaagtaagcacaaaatacatttaaaatacaaagacgattttttcaggctgtgattatggtgaacataacaaaacccagtagtcaccaaggcaggtagtgtgataaatgaacacaccactctgaggctaattacctaatggaatacaagagcaatggtcacccgtatttccttatcctagcctttatttctctgtcatttggatggctggtcaatggggaagaattgagtgggtgatttaatcaactgcaaaccatctgcccctgtcccaaaatgatgagccagattagcattaaaccagtacttgtcagtccatcttaatactgttcattaaggcactctctgtctctaatccttaggagttgttttaaaagacataatcactttgaacttccatgaaacctgtcttccaccacaacaaccctgggagagaaaaacatgctaaaggaggtatcttggcttaataattccttatagccaatatcaacagtggcaatcagcacacagaggaaaggacccaaatcactatgtagcttaaagatttctgttaatttgaaagaacaaaaacaagacagaacttctggtactctaatcaggatgattcctaacaagtcagtcatttgtgaacttagtggactttttggttactttaatttgcatatattctccagttacatcggactctatctgtggccttgttcttcatttcagtgttaatcagctaaacagaagttgttgcttatgatgtgtgagtgaacatatgccactgcctggcctttttttcttcagagcttgttgtctttttcgctatattagactttgcagtatgcccagaagctttccttcataaaatagaaagaaaaaaacatttggcttatttttcactgtagctagtcttttatacaataatcttgtaagaaaatttcttgaattctaaatattactctttctagatttttgaaatcaaaaagttttcagtaaaaagtttcttactttattttattatattaggtagtaaaaaatgtagggttatttaccataacctgttcattaatatcagaaatttacaatagcattttaagaccatagtaggattctagcataccgtgtagtacctatggagtattgtaagagctaattgttggagatgaattgcttctcatcttgttctccagtttccattgttggtttattgcagatttgtatcctgtgtcaaattcaaggtattattgataaaccttttcaaccagcagcaagaagttcaaatttttttctgtcactgtaacagaaaacacaatatgtatataacatttatgtagcaataaatgtgccatcttttttttaacacagtaaaaaaaaaaaaaaaaaaaaaa

SEQ ID NO: 1035 - DNA, 1227 bp, Homo sapiens
cggcgcacggagggacgcggccggcgcccatggcgttcgcgctgctgcggcccgtcggcgcgcacgtgctgtacccggacgtgcggctgctgagcgaggacgaggagaaccgcagcgagagcgacgcgtcggaccagtcgttcggctgctgcgagggcccggaggcggcgcggcgcggcccgggccccgggggcgggcggcgggcgggcggcggcggcggcgcgggccccgtggtggtggtgcgacagcggcaggcggccaacgcgcgggagcgggaccgcactcagagcgtgaacacggccttcacggcgctgcgcacgctcatccccaccgagccggtggaccgcaagctgtccaagatcgagacgctgcgcctggcgtccagctacatcgcgcacctggccaacgtgctgctgctgggcgactcggccgacgacgggcagccgtgcttccgtgccgcgggcagtgccaagggcgccgtccccgccgccgccgacggcggccgccagccgcgctccatctgcaccttctgcctcagcaaccagcgcaaggggggtggccgtcgtgacctggggggcagctgcttgaaggtgaggggggtggccccccttcgagggccacggagatgagcctggaccctggagaaggaggccaggagccagccactggctggacagggaagaagaccccaggagccaagcccaccccttctttgtgtagggaccgggggaccatggcctgttccgggacactctgggcagggccctcgggacatctccacccgatcctggagagctgtgaggatccattcagcctgcccagctctggctggtcagagacaaggcagaacttttggaaaaacaaagactgttggtgacagggtgtgtgtgtatctgtgcgtgagtgtgagtgtgtgtgagagagaattggtgagtttaaaataaaagctatttttaaataaaagacgtcgttctgagctgaggagagtcccgtggacatcggaggtcagaggtgggccctcccctggacctagagagaggcacagatgttctgggggctgccctgagccctggaagggtgggggtggggcgggggaaggcaggcagagccccctctccgggcgccataaccaaactttcctcagtctgctgtttatcagatgttcttaacaactgttaggtgtctgatatggttggtaaagaaatcttaattttacttatttttgaa

SEQ ID NO: 1036 - DNA, 3306 bp, Homo sapiens
gttcgggcccgggaattccgaaggaggggtaggcgctgcccgcgcgcagaggccgcgcccctcctggccccggcttcttggctgtcaaacagatgcagcaacgtcggctcctgccgaggagcccaaggggtcccgggatccgccgcacaggctggcactgcttgaagaggaggctactcggagactgcgccgcgcggtggattcattgccctcggaggttcaaccagttatgagtgagggattggccagaagatcggggcgcaggcaagcaggagtgctctattaggataagcaagtttgacaggaagaagctactcttctccgaattacacagaggtgatgtgttcgtattgcacgtagacgtgtgtataacaggacctccttccccgcgccccgccaccccgacacacacaggagctgcctaaagtatccttgccttgcagattggaggctccccaaatattttgcgatctgaggatccagctcaagtgaggtgccataggacgtgttcctgagtttgcattgcacggagaccttcctggaatttttcatttgcaagtcggcttaaccaattttgcattgagtcctaggctgcttgcactctgaatttgggctattcaggtagtgtgctcaaagttgaaaccgcatacagcacaactcaagtttgcatcagactgggaagcgaacttaagccagcggtgcgtggcccaggagtgggaaaggaaatggatgcctgaagtggaagaggtggtgcagagggggcaccgcccatgctgccctgcttccaactgctgcgcatagggggcggcaggggcggtgatctctacaccttccacccccccgccggggctggctgcacctatcgcttgggccacagggccgacctgtgtgatgtggccctgcggccccagcaggagcctggcctcatctctgggatccacgccgaactgcatgccgagccccggggtgatgactggagggtcagcctggaagaccacagcagccaaggtactttggtcaataatgtccgactcccaagaggtcacaggctggaattgagtgatggagacctcctgacctttggccctgaagggcccccaggaaccagcccctcggagttctacttcatgttccaacaagtacgagtcaagcctcaggactttgctgccattaccatcccacggtctaggggagaagcccgggttggggctggtttccggcctatgctgccctcccagggggctccacagcggcctctcagcaccttctcccctgcccccaaggccacactgatcctaaactccataggcagcctcagcaagctccggccccagcccctcaccttctcccctagttggggtggaccaaagagcctgcctgttcccgccccacctggggaaatggggaccacgccttctgctccaccacaacgcaatcggaggaaatctgttcaccgagtgttggcggaactggatgatgagagtgagcctcctgagaacccgccaccggtccttatggagcccaggaagaaactccgtgtagacaaagccccactgactcccactggaaatcgacgtggccgtcctcggaagtacccagtgagcgctcccatggctccccctgcagttgggggcggggagccctgtgcagctccttgttgctgcctgccccaggaagagacagtggcctgggttcagtgtgatggctgtgacgtctggttccatgtggcctgtgttggctgcagcatccaggctgccagggaggccgacttccgatgcccagggtgccgggctggcattcagacctaaggtccactgccaaggcaccatcggacacacctgcccatgagtagacacagcagcgagcaaataggtctgataaataccccccttcccttccctccccaggagggaatgactacagggaagaaggatggattgatgtggactcattcagggcctggagcagaccctggtggccaagacagaagagatggtttcctgccaaagatattgccacctccaggaaattgccagtgagctggaagttcccactattacaagccataaggccatgttgccatggacaccagaatatctgtagtcagagcacctatcagttgcaaaagccatgcctgcaaccgatggaaaatgtaagagggagttcttaaggttcttggtggcatcacccaaggcattctgggaaaacctagggcctggccccaaaacttccctactctgtggctagtcctgctgccaacaaaatcgtagcgacctggcttttcacagctttgcttttatttccaagtcaaggacaagccgcttcattcactcctgggcatttactcttcttgtgggtctgtgatattccttgctttccagggagaatgtgcttggcaaggtctggagaactaattcagaatcttaggggaaggggagagatggaaatacaaacctgcttactggaaaggtgcaaatatatgggttgagctggaggtaggaatacaggtaattaaggtttctagtttaagggaaaacagatctattgccatttaaataaggtaactgggatttggttaagttcacaaagatagcagaagatttatttacaggcttcacctgtactgtcagggcaagagaaagcctggtaaaccagctacagcagtttaccagtgtgatggctgtgacacagctccactccacgggtggacacagcagagggcaactgggctggcctggttcagtgtgaatcaaaccgcttaacccacacatggtacatgtgattttcttttgtgagccttacaccaagccaaactattgtcaaagcatcatttctatagaaataaagccttatcttgacctgttctattaaaacctgccacacccgccctttcctacctagatttaatgagcccaagtttttaaaatggaagaaatgactctggggcaaagacccctaatgaactagtggcagagccaggaataaaacttgagtaactaatgagtcacttatgggcagagtatgcaaaaaccttaagtggaaaccaaatagaccctggtatcaagaaagcacaaagtattaatagaagtttctggttggggtgatctaggttcaacagaaataagatgatttctaagtataaagccatttaagaattccagagtagggtgggaaagcaaaaagccagctctgaacaggtaacagctacatggtgactgagtctatgggcaaaagttcttgcatcacaggcttttgggaactagcctatcacagggccctgtacaaataaacttggctgcaatccca

SEQ ID NO: 1037 - DNA, 3277 bp, Homo sapiens
cccgccagctcgcggagccgctctgccccgcgccctagcccgcgcctgcagcccgcccaggcggagtcagcccgcgctccgcccgccgcgatccgagctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctga

SEQ ID NO: 1038 - DNA, 401 bp, Homo sapiens
aacctacaaccacgtgccttcccaggaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaaggtaagacctgccctctccctccaggccagggaggcagcgtccctgcattgatggctccgtgtggtctctgaccctctctcccccagtggcacaacctgtctcgagaagaacaggccaagtactacgagctggcccggaaggagcggcagcttcactcgcagctctacccaacctggtcagcccgggacaactatgtggggtgcacactctgggcag

SEQ ID NO: 1039 - DNA, 4004 bp, Homo sapiens
aataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggcggaaagacggcctccgcctcgctccgaaagtttccgagacaaatcccgggaaagtttggaagaagcggccaagaggcaagatggagggctctttaaggggccaccgtatcccggctaccccttcatcatgatccccgacctgacgagcccctacctccccaacggatcgctctcgcccaccgcccgaacctatctccagatgaaatggccactgcttgatgtccaggcagggagcctccagagtagacaagccctcaaggatgcccggtccccatcaccggcacacattgtctctaacaaagtgccagtggtgcagcaccctcaccatgtccaccccctcacgcctcttatcacgtacagcaatgaacacttcacgccgggaaacccacctccacacttaccagccgacgtagaccccaaaacaggaatcccacggcctccgcaccctccagatatatccccgtattacccactatcgcctggcaccgtaggacaaatcccccatccgctaggatggttagtaccacagcaaggtcaaccagtgtacccaatcacgacaggaggattcagacacccctaccccacagctctgaccgtcaatgcttccatgtccaggttccctccccatatggtcccaccacatcatacgctacacacgacgggcattccgcatccggccatagtcacaccaacagtcaaacaggaatcgtcccagagtgatgtcggctcactccatagttcaaagcatcaggactccaaaaaggaagaagaaaagaagaagccccacataaagaaacctcttaatgcattcatgttgtatatgaaggaaatgagagcaaaggtcgtagctgagtgcacgttgaaagaaagcgcggccatcaaccagatccttgggcggaggtggcatgcactgtccagagaagagcaagcgaaatactacgagctggcccggaaggagcgacagcttcatatgcaactgtaccccggctggtccgcgcgggataactatggaaagaagaagaagaggaaaagggacaagcagccgggagagaccaatgaacacagcgaatgtttcctaaatccttgcctttcacttcctccgattacagacctgagcgctcctaagaaatgccgagcgcgctttggccttgatcaacagaataactggtgcggcccttgcaggagaaaaaaaaagtgcgttcgctacatacaaggtgaaggcagctgcctcagcccaccctcttcagatggaagcttactagattcgcctcccccctccccgaacctgctaggctcccctccccgagacgccaagtcacagactgagcagacccagcctctgtcgctgtccctgaagcccgaccccctggcccacctgtccatgatgcctccgccacccgccctcctgctcgctgaggccacccacaaggcctccgccctctgtcccaacggggccctggacctgcccccagccgctttgcagcctgccgccccctcctcatcaattgcacagccgtcgacttcttccttacattcccacagctccctggccgggacccagccccagccgctgtcgctcgtcaccaagtctttagaatagctttagcgtcgtgaaccccgctgctttgtttatggttttgtttcacttttcttaatttgccccccacccccaccttgaaaggttttgttttgtactctcttaattttgtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaaaagactgattaaaaaacaaaaagaaaaaaaaagcaattttgaagcagccctccagaaggagttggttctgtattatttgtattaaatacgagcttgcgaaccaatcattttacatctggtttttaaaccgtaagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataaaagcaacttagtatgtgcagataaa

SEQ ID NO: 1040 - DNA, 5998 bp, Homo sapiens
gggggggaagggggagggagggggaggaggtgactcgagcatttagacacaagcgagaggatcatggcggatggccccaggtgtaagcgcagaaagcaggcgaacccgcggcgcaataacgttacaaattataatactgtggtagaaacaaattcagattcagatgatgaagacaaactgcatattgtggaagaagaaagtgttacagatgcagctgactgtgaaggtgtaccagaggatgacctgccaacagaccagacagtgttaccagggaggagcagtgaaagagaagggaatgctaagaactgctgggaggatgacagaaaggaagggcaagaaatcctggggcctgaagctcaggcagatgaagcaggatgtacagtaaaagatgatgaatgcgagtcagatgcagaaaatgagcaaaaccatgatcctaatgttgaagagtttctacaacaacaagacactgctgtcatttttcctgaggcacctgaagaggaccagaggcagggcacaccagaagccagtggtcatgatgaaaatggaacaccagatgcattttcacaattactcacctgtccatattgtgatagaggctataaacgctttacctctctgaaagaacacattaaatatcgtcatgaaaagaatgaagataactttagttgctccctgtgcagttacacctttgcatacagaacccaacttgaacgtcacatgacatcacataaatcaggaagagatcaaagacatgtgacgcagtctgggtgtaatcgtaaattcaaatgcactgagtgtggaaaagctttcaaatacaaacatcacctaaaagagcacttaagaattcacagtggagagaagccatatgaatgcccaaactgcaagaaacgcttttcccattctggctcctatagctcacacataagcagtaagaaatgtatcagcttgatacctgtgaatgggcgaccaagaacaggactcaagacatctcagtgttcttcaccgtctctttcagcatcaccaggcagtcccacacgaccacagatacggcaaaagatagagaataaaccccttcaagaacaactttctgttaaccaaattaaaactgaacctgtggattatgaattcaaacccatagtggttgcttcaggaatcaactgttcaacccctttacaaaatggggttttcactggtggtggcccattacaggcaaccagttctcctcagggcatggtgcaagctgttgttctgccaacagttggtttggtgtctcccataagtatcaatttaagtgatattcagaatgtacttaaagtggcggtagatggtaatgtaataaggcaagtgttggagaataatcaagccaatcttgcatccaaagaacaagaaacaatcaatgcttcacccatacaacaaggtggccattctgttatttcagccatcagtcttcctttggttgatcaagatggaacaaccaaaattatcatcaactacagtcttgagcagcctagccaacttcaagttgttcctcaaaatttaaaaaaagaaaatccagtcgctacaaacagttgtaaaagtgaaaagttaccagaagatcttactgttaagtctgagaaggacaaaagctttgaagggggggtgaatgatagcacttgtcttctgtgtgatgattgtccaggagatattaatgcacttccagaattaaagcactatgacctaaagcagcctactcagcctcctccactccctgcagcagaagctgagaagcctgagtcctctgtttcatcagctactggagatggcaatttgtctcctagtcagccacctttaaagaacctcttgtctctcctaaaagcatattatgctttgaatgcacaaccaagtgcagaagagctctcaaaaattgctgattcagtaaacctaccactggatgtagtaaaaaagtggtttgaaaagatgcaagctggacagatttcagtgcagtcttctgaaccatcttctcctgaaccaggcaaagtaaatatccctgccaagaacaatgatcagcctcaatctgcaaatgcaaatgaaccccaggacagcacagtaaatctacaaagtcctttgaagatgactaactccccagttttaccagtgggatcaaccaccaatggttccagaagtagtacaccatccccatcacctctaaacctttcctcatccagaaatacacagggttacttgtacacagctgagggtgcacaagaagagccacaagtagaacctcttgatctttcactaccaaagcaacagggagaattattagaaaggtcaactatcactagtgtttaccagaacagtgtttattctgtccaggaagaacccttgaacttgtcttgcgcaaaaaaggagccacaaaaggacagttgtgttacagactcagaaccagttgtaaatgtaatcccaccaagtgccaaccccataaatatcgctatacctacagtcactgcccagttacccacaatcgtggccattgctgaccagaacagtgttccatgcttaagagcgctagctgccaataagcaaacgattctgattccccaggtggcatacacctactcaactacggtcagccctgcagtccaagaaccacccttgaaagtgatccagccaaatggaaatcaggatgaaagacaagatactagctcagaaggagtatcaaatgtagaggatcagaatgactctgattctacaccgcccaaaaagaaaatgcggaagacagaaaatggaatgtatgcttgtgatttgtgtgacaagatattccaaaagagtagttcattattgagacataaatatgaacacacaggtaaaagacctcatgagtgtggaatctgtaaaaaggcatttaaacacaaacatcatttgattgaacacatgcgattacattctggagaaaagccctatcaatgtgacaaatgtggaaagcgcttctcacactctgggtcttattctcaacacatgaatcatcgctactcctactgtaagagagaagcggaagaacgtgacagcacagagcaggaagaggcagggcctgaaatcctctcgaatgagcacgtgggtgccagggcgtctccctcacagggcgactcggacgagagagagagtttgacaagggaagaggatgaagacagtgaaaaagaggaagaggaggaggataaagagatggaagaattgcaggaagaaaaagaatgtgaaaaaccacaaggggatgaggaagaggaggaggaggaggaagaagtggaagaagaagaggtagaagaggcagagaatgagggagaagaagcaaaaactgaaggtctgatgaaggatgacagggctgaaagtcaagcaagcagcttaggacaaaaagtaggcgagagtagtgagcaagtgtctgaagaaaagacaaatgaagcctaatcgtttttctagaaggaaaataaattctaattgataatgaatttcgttcaatattatccttgcttttcatggaaacacagtaacctgtatgctgtgattcctgttcactactgtgtaaagtaaaaactaaaaaaatacaaaatacaaaacacacacacacacacacacacacacacacacacacacacaaaataaatccgggtgtgcctgaacctcagacctagtaatttttcatgcagttttcaaagttaggaacaagtttgtaacatgcagcagattagaaaaccttaatgactcagagagcaacaatacaagaggttaaaggaagctgattaattagatatgcatctggcattgttttatcttatcagtattatcactcttatgttggtttattcttaagctgtacaattgggagaaattttataattttttattggtaaacatatgctaaatccgcttcagtattttattatgttttttaaaatgtgagaacttctgcactacaaaattcccttcacagagaagtataatgtagttccaacccgtgctaactaccttttataaattcagtctagaaggtagtaatttctaatatttagatgtcttagtagagcgtattatcatttaaagtgtattgttagccttaagaaagcagctgatagaagaactgaagtttcttactcacgtggtttaaaatggagttcaaaagattgccattgagttctgattgcagggactaacaatgttaatctgataaggacagcaaaatcatcagaatcagtgtttgtgattgtgtttgaatatgtggtaacatatgaaggatatgacatgaagctttgtatctcctttggccttaagcaagacctgtgtgctgtaagtgccatttctcagtattttcaaggctctaacccgccttcatccaatgtgtggcctacaataactagcatttgttgatttgtctcttgtatcaaaattcccaaataaaacttaaaaccactgactctgtcagagaaactgaaacactgggacatttcatccttcaattcctcggtattgattttatgttgattgattttcagaatttctctacagaaacgaaagggaaattttctaatctgctttatccatgtacttgcatttcagacatggacatgctattgttatttggctcataactgtttccaaatgttagttattatggacccaatttattaacaacattagctgatttttacctatcagtattattttatttcttttagtttatagatctgtgcaacatttttgtactgtatgtcttcaaacctggcagtattaatacccttcttactgacatatgtacttttagttttagaaaacttttatatttatgtgtcttatttttatatttctttatttattacacagtgtagtgtataatactgtagtttgtattaatacaataatatattttagtatgaaaatttggaaagttgataagatttaaagtagagatgcaattggttctcctgcattgagatttgatttaacagtgttatgttaacatttatacttgccttggactgtagaacagaacttaaatgggaatgtattagttttacaactacaatcaagtcattttacctttacccagtttttaatataaaacttaaattttgaaattcactgtgtgactaatagcatgatgctctgcagttttattaagaaatcagcctaaccatacaactctcatttccttagtaagccaaattaggattaacttctataaacagtgttgggaacaatgtttaacattttgtgccaatttgttcctgtattcatgtatgtaagttacagatctgactcttcatttttaagttccttgttacatcatggtcattttctagttttttaccagactcccatctcacaataaaatgcatcaacaagcctgaactgctgtcattcttttcatcattatcagtattttctttggaaaactgtgaaatggggtacattgtcatcctgcatttgattcatcttgagctgaatttgggtaacactaaatgttttagacattctccactaaattatggattttcttgtggctaaatgtttctggagaggtcagagttgacaaaacctcttcacaggttgctccttcttcctgaaatccttaatcctccgcatttcatgcttcaggtcatttcagggaagcctgggtttagatgcctttctgactctcagctcctgcacttctgtcatcatacctctgatactattatttatattccttccccactaggaacaggaaccacatttgtcatagtcactctcacattcctcactgcctaacagggtgcctggcataagttgggacaacagatatttgttgaataaaaatataatttgcatgtttatggagctcagctatgttctcactttttttgcttctaattccagaatatatgttaaatgatctaataatttgattattttcttataagtcttattaaacactagtcataatagacacaataaattatgccttctttttctattgccttaaaaaaaaaaa

SEQ ID NO: 1041 - DNA, 1324 bp, Homo sapiens
ctggtgaggggctgcaggtggcggcgcagtctcggtaggcggtatgagtttggctgggggccgggcaccccggaagaccgctgggaaccggctttctgggcttttggaggcagaggaggaagatgagttctaccagacgacttatgggggtttcacagaggaatccggagatgatgagtatcaaggggaccagtcagacacagaggacgaagtggactctgactttgacattgatgaaggggatgaaccatccagtgatggagaagcagaagagccaagaaggaagcgccgagtagtcaccaaggcctataaggaacctctcaagagcttaaggcctcgaaaggtcaacaccccggctggtagctctcagaaggcgcgagaagagaaggcactactgccattagaactacaagatgacggctctgacagtcggaagtctatgcgtcagtctacagctgagcatacacgacaaacgttccttcgggtacaggagaggcagggccagtcaagacggcgaaaggggccccactgtgagcggccactaacccaggaggaactgctccgggaggccaagatcacagaagagcttaatttacggtcactggagacatatgagcggctcgaggctgataaaaagaagcaggttcataagaagcggaagtgccccgggcccataatcacctatcattcagtgacagtgccacttgttggggagccaggccccaaggaagagaacgttgacatagaaggacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatccctttt

SEQ ID NO: 1042 - DNA, 2418 bp, Homo sapiens
cctcgccgcagtgggcccgcccgctggcccgtttccggtccggtgggtacaagatgacggagccgggcgcctctcccgaggacccttgggtcaaggtggagtatgcctacagcgacaacagcctggaccccgggctttttgtagaaagcacccgcaaggggagtgtagtgtccagagctaatagcatcggttccaccagtgcctcttctgtccccaacacagatgatgaggacagtgattaccaccaggaggcctacaaggagtcctacaaagaccggcggcggcgcgcacacactcaggctgagcagaagaggagggacgccatcaagagaggctatgatgaccttcagaccatcgtccccacttgccagcagcaggacttctccattggctcccaaaagctcagcaaagccatcgttctacaaaagaccattgactacattcagtttttgcacaaggagaagaaaaagcaggaggaggaggtgtccacgttacgcaaggatgtcaccgccctaaagatcatgaaagtgaactatgagcagattgtgaaggcacaccaggacaacccccatgaaggggaggaccaggtctctgaccaggtcaagttcaacgtgtttcaaggcatcatggattccctgttccagtccttcaatgcctccatctcagtggccagcttccaggagctgtcagcgtgtgtcttcagctggatcgaggagcactgtaagcctcagaccctgcgggagattgtgattggcgtcctgcaccaattgaaaaaccagctttactgaccggttcttggaaacctggagaacagccaacaagaggcccttgaatctctacgtggccactgaactgctgggcccgggagactggactacaacacctcacactggtcagctggtttctacttggtgtttggtttttcccagccccattttatcttcagcggagccgcggtgtttgttttgtgaaagcttctgattaatttattatattgacgataaaactcaaacctacccagccttccccccactccatggaagtccttgggatgggcgtctgctctgggacaccccaaagagctcctgccctctcagccctttattcaagcctcagatttctgctcatgatctacatagatttggaaactggttttcctctgttttggtctcttgggcaacatttttggcccaagtttgggcaacatttggcccaagtttgggattttggcagtagctgtatgggagaaaaagagtaagaggaaatattcccacagccatgaagggtgaaagggcaccttgtcccagactagggctgcctggtcagtcccaggtgaggccaaggctttctggccatctcagggaggggccaccaggttcctcccctcaccccatattccatcaccttcctcctctgctctgggtggtaagggaagccctcccggttcccacaggctatgatgctgcatggcagagggcaggtataacacagcactacatattggaaattttttatttttctaaataccaatgcagttttgctacggttacaattttgaaatattaactgagcctcaaaatcaccctttctgtcaagcatatcttggcctctcccatgtctcagtgttgcctgcatttctcccaggacttgggggtggggtgaaaagcgtacaaaagatacttaaaagggctcctggggtacacaagcccagcaggtcctgagtgaagccgtgggccctccaaatgctcgttttatagcaacctctctctaccctagttctccaaattcacttctgccttcctcaggtttgatatctggcaggtttgactatccagaggaaattaaatatttttatataaaattaaattataataaatattgccaaatgctttcctttagattgttccaagtctaaatgttaacctcaagctactgcaatttagacaatgaaatgggctgggtctacccccagccaccagccctcatcctctctacccagtgctctggtttatgcttgtctcctgactgctctgcttaaaggtgaaagtagcaggaacaacaacaaaagccaaccaaaaacaaggtagccagtgcaagacatctcactcttctgacatcctgcagtccccaccagtcctgaccgtgggcccctcaggggtctgggagtgtgacgttgtaatcttcatccgtctctatcccaacttcctcctgtgagacagggagacaagtgaatgagatgtcaccaggataagaccacagggaagcaaagaaggaagagagctccacttacaaagaactgcttcttgctcttggggtatccttcaagtattgcatcagacagctctgtagcctgacaagaaataaaaccacccgttttcagatgggcaaggcactgcctgtcagtttatgatattgtgt

SEQ ID NO: 1043 - DNA, 2474 bp, Homo sapiens
cgggccgggggtcgcctcccgcctcccgcctcccgcctcccgccgcccgccgcccgcgtcgccctcgccgccgttgggccgcgccgcgccgccatgtcgggccccggaccgcgggagccgccgccggaggcaggcgcggcaggcggcgaggcggccgtcgagggcgcgggcggcggggacgcggcgctgggcgagccggggctgagcttcacgaccaccgacctgagcctggtggagatgacggaggtggagtacacgcagctgcagcacatcctctgctcgcacatggaggcggcggctgacggcgagctcgagacgcgcctcaactcggcgctgctggcggcggcgggcccgggcgcaggcgcgggcggcttcgcggcgggcggtcaggggggcgcggcgcccgtgtaccccgtgctgtgcccgtccgcgctggcggccgacgcgccctgcctgggccacatcgacttccaggagctgcgcatgatgctgctaagcgaggcgggcgcggcggagaagacgtcgggcggcggggacggagcgagggcccgggccgacggcgccgccaaggagggcgcgggcgcggctgcggctgcggctggacccgacggcgcgcccgaggcccgggccaagccggccgtgcgcgtccgcctggaggaccgcttcaacagcatccccgccgagccgccgcccgcgccgcgcggccccgagccccccgagccgggcggggcgctcaacaatttggtaactctcattcgacatccatctgaactaatgaatgttcctcttcagcaacaaaacaaatgtacagcattagtgaaaaataaaactgcggctacaactactgctttgcaatttacatacccactgtttactacaaatgcttgctctactagtggaaattctaatctttcacagacacagagttctagtaactcatgttctgtacttgaagctgccaagcaccaggatattggattgcctagagcattttctttctgttatcagcaagaaattgaatccactaaacagacgttaggtagtagaaacaaagttttgcctgagcaagtttggattaaagtgggagaagcagcgctatgcaaacaagcactgaagaggaatcggagtagaatgcgtcagttggacacaaatgtagagcgaagagcccttggagagattcagaatgtgggcgaaggtgccaccgccacacaaggcgcttggcagtcctcggagtcctcacaggcaaacctgggggagcaggcccagagtgggccccagggaggaaggtctcaacgtagggagaggcataaccgaatggaaagagatagaaggcgcagaatccgcatttgctgtgatgagttgaatctcttagtgccgttctgcaatgccgagactgacaaggccacaactctgcagtggaccacagcattcctgaaatacatccaggaaagacatggagattctcttaaaaaggaatttgagagcgtattttgcggtaaaactggccgaaggctaaagctgaccagaccggactccttggtgacctgtcctgcacaggggagtttacagagcagcccctcgatggagatcaagtgatcggactgaacaggaatcctcggggggtgaacagccattccttcgtgacctgtgcacgccttctgcaaccctggagctctgctcggctagtctgactcgaaaagggcgtgactcaagctgacgggactccagtagggactttgagagcacattttgtaaaaatatttatctagacgcaaatgcttatccatgaatgtcctcttagaccatttggggatgaagccatcttaataattagtaataattaattagtaataattagtaagcattttctcaatgctctgattccatcatgttttcttaacatgataacttaaaaaattgacatcctttgtactttctttaatcttaaaaagtacacggctttttacttatttaccttttaaatatgcccctttagcaattggaacaagttaaattgttaactaaaaacagtttggaaattttatttcattcgttatatcacacccccttgtcatgactctgagtcacgtgctgctgtattgcaacgtgcaggaccattttaaacctgtgtgctaaaaattttccagatacttgctttaaagctacttttgtccacaaatgaaatactgtcacagtagacgcttaaatgccacgttttcataccaagagtcattcattacttcatgtgtcacaaactgtggtgtttggaattgggtttttcaatgagtggctttacttatcaatcacaacaggtaatagcaatagacgttagtgcaatacaaagtcaccctcaataaatactgttaattggagatgtgagtttgtacacaaaacatcagactagacctttgtatgggagagaatttactgtacattaaattctttattttttgttaaaaaaaaaaaaaaaaaaa

SEQ ID NO: 1044 - DNA, 9448 bp, Homo sapiens
ttccgaacattcttagcatcgctcgcgccgcgccgcgccgcctgagccgagccgagcctctgctgccgccgccgcggccccgccgcccgccgcgggcgcccaccaagcactttgcagactcgcttccaccctgcgggccattccgcgcggcggggcccgggcccggggcggccgcgtccaggcacaggccatgcagtgacgcccccccacccctccacctttgcccggagcgcgggcagcagcccagcgcgccagccggccccggggcaggagcggtgctaggcaggggtggggtggccgggcccagggaccgggagccggggagggagccgggcaccgagcagagggcgggggaagcggcgccgaagtttgcctcggactcgccgggcgctgcggtggctccctgggccgaggactgttgctgccgctgccgccgccgcttcattgcacattcaagtggaaaattttcaggagtcagcagaaacattgtgtccaaaaaagactgagtcgcagttaccaccaaacccaggaggagactctccctggaaaacttcccttccctttcggtttattttcttgaaaaggctccaggcttcggcttggaaaatcccaccgccaaaattgagcccagcagctggagcggcagtgagagccctgccgaaaacatggaaaggatgagtgactctgcagataagccaattgacaatgatgcagaaggggtctggagccccgacatcgagcaaagctttcaggaggccctggctatctatccaccatgtgggaggaggaaaatcatcttatcagacgaaggcaaaatgtatggtaggaatgaattgatagccagatacatcaaactcaggacaggcaagacgaggaccagaaaacaggtgtctagtcacattcaggttcttgccagaaggaaatctcgtgattttcattccaagctaaaggatcagactgcaaaggataaggccctgcagcacatggcggccatgtcctcagcccagatcgtctcggccactgccattcataacaagctggggctgcctgggattccacgcccgaccttcccaggggcgccggggttctggccgggaatgattcaaacagggcagccaggatcctcacaagacgtcaagccttttgtgcagcaggcctaccccatccagccagcggtcacagcccccattccagggtttgagcctgcatcggccccagctccctcagtccctgcctggcaaggtcgctccattggcacaaccaagcttcgcctggtggaattttcagcttttctcgagcagcagcgagacccagactcgtacaacaaacacctcttcgtgcacattgggcatgccaaccattcttacagtgacccattgcttgaatcagtggacattcgtcagatttatgacaaatttcctgaaaagaaaggtggcttaaaggaactgtttggaaagggccctcaaaatgccttcttcctcgtaaaattctgggctgatttaaactgcaatattcaagatgatgctggggctttttatggtgtaaccagtcagtacgagagttctgaaaatatgacagtcacctgttccaccaaagtttgctcctttgggaagcaagtagtagaaaaagtagagacggagtatgcaaggtttgagaatggccgatttgtataccgaataaaccgctccccaatgtgtgaatatatgatcaacttcatccacaagctcaaacacttaccagagaaatatatgatgaacagtgttttggaaaacttcacaattttattggtggtaacaaacagggatacacaagaaactctactctgcatggcctgtgtgtttgaagtttcaaatagtgaacacggagcacaacatcatatttacaggcttgtaaaggactgaacatggttatttatatatatagatatctgtatatacacacacacatatgtgcacacacacactctctctccattatcgaacgactgactgtaaacctcaccacacagggtggtgccctggccccgaggtcaccccgacttttctaaatcttgtttgagtgaagtcattttttcatgtgttcatactatcattgtagctgtgaagttctggtacagttgtaaaaagagaaattgagttgtttctctatgttcttcagatgtgcagcccacaattcctcgggaaaggtgaacctgaacaacccaagtctctctctgcagagccctgtttctaattgtggtagaaaatattgagacagagcatttgccatgggacatttacagcctttatacaaatgtatttagttctcttttttccaacataaaattcttgttttaagatacaagtaaaattaatctttaaatataaatgtaaattagtacacaaaactaagaatctttagacttatctttgtaactaattagggtggaagttatgaaagaatgtaattcactaaattattttttaaatgaaacctttttttttctttttgaaaccaaatgttaaactatagccttaagaaatgcttggtagaagtgtcctaatgagacaaatttgtacttttatcctcaaggttaacactaatctcctaatccattaaactcttgaacaggtattacaaaggaagaaaacttcaccccttatccttaacatatatagtatatttaaaaaatataaaattgtattgtactaatgtgatgatggattatttaatgaaaaagaaaaaatggctctttttgcaataagtagatacatactgaaaaaatctaaacttacaatgtttatagtcttgtgtgtgcagttatattttatatggacgaccaaattttttattaagatgagtaaatatttgaaccactgaattttaataacaaaattttaaaattggcatgaatacggaatactgcactgtgagatgcaaagtatacagaatctgtggctgggagaaaatttcatcaaatagacaagtaaaaggctcatcagttttagcatctctgctccccagaaaattgtaagcatcctcaccagcctgtggatacattctttatttctagtgacccaatatgcatattaacctgctataactagggctatatgtgtaggtatgtgtatacatatacacaaatgcacatatagagttaacacatttagtgaacacttgtttagtgtcactcagtttgctaggtgctgatatgtacgtatatctcaatgtgtctgtagacttagatacatcctcttgaagcacatccatttctttagcgtctctcagtaagttacagtacttgtttgacttaggtttaagaggcccagctacctatctctgaccttttcaaataggctcatttgggagattcttttgccaggagagattcaactttccaatctaagtattccagagcattgcccaggcagagttggtttgatgtggccagatgttttgagttatttcccttaagtgtttcactggggagagaacagggagtgctcctccagcttcccaaagaaatatgtttttgtaagtggtaggaacatgtgcacacaatagaacatgaaataagttttttaacttgtaaaacatgtcaagatttttccaccaagctagaaaataaaaaacttagttctaccacatccaattaacttacacacccccttccctgtctcaacacctgctttgaccctgcttttctattattacatcagtcagcatcttgtggtccctaacatgaggatgtggctggctcgtgggaaacagcaaaacactaagcctgacctctcccaaattgggaagaccagaggagaaagtgcaaaactgtccccatttggaatgcccattccttctagaaaccagttggacagtgctcctctgcccttcataaacagactactgttgggtccctgattccaggctggcctgtgaaggattgccccaggtgtcccctttcacggttgtcacatttacagtgacttctgttgaacacccctcttagggatgtttcttttgctcttatttcctgcatctttccttaagggaagccccatcctctcccaggaccaggagtttatgaccaggcgagcacaaatggctaaaagccaagctgtcctagaacttcagtgggagagctgtctggttcatattctacccaggaatggtacttttcagtgcagccaggagggctcttgggatttcctttccaaagcacaaaaatactgggacccaagaagaacagctagaggacaactctgttggcacagagacggggacagcccagtctgctgacctcacagggtcagctgggcccccctggtgcttcaccacctgcatcctcttgctcagaatgcctttgcagttgagttttctgggtttctatgattgaccttgaggtttactccttgctcttacaacatttctaaggatttttaaaagtttacttcttgtcttgttcttctaaagctttctccaggacagatattttccctgtcttaaccactggtccagtcatcccagtgggcttctctttgtctctcccagattagacctttgggtgagattggcatcacaacatctaatctgagtctgtcttttgtccttcattctgtatggcagtctccctttgttataaaagctttctaaagcatactaaagaagccttcccagagccccgtcttgcttctcttccaggtgctctatcccctcgagaccctctggtgccaggcttgcttcacggccatcttgtgttgtcactgcagagtttggaggccagttttccacagcctaaacagggaggagctgcagaatggggctctggtctctgggcattcatttccctcatagaggctgagaataaaacaaggacttattcacacatgttctagaaccccagaatggcccaagttacctgagaccagggtttctcaaccttgacaccattgacattttggactgggtaattctttgttctgcagagctgtcctttgcactgtaggagatttactaatatccctggcctctacccagtagtaccactagcacctattccccacccagcgtgtctccagatattgtcaaatatcccatcgggtgcaaaatgatccctggtcaagatctgttgcccaagatgttacaggtcacaatgaccacatttgaaattgttttccctttcattttaccctgtgaaagcatctctcctagagccttgcaagaggcaggtgacattgtgtccatatttcttcctgtttcagaacttctgtttcacaacaatttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccgtaagcagtgccttagtaataccttagtcatgccgccagccttttcttacaccaattcctaatgttcatttacgaattggcccaatattggaaacaaaacaagcaaaaattgtcttcatttttgttttgtaagcccattttttctccagttctataggaaactgactgcttggtgtaaaatccgaaactggacacaagtcagttctttcaccacactcaaatgtatataccaaaacaaaaggttgcaacttcatagtttactatgaaaagcaaattgtactttttaatgttgccttttaaattcatgaccaaatacttagctatttgtgaatcttctgcactctagcatgaaagtgcctttggtttgagattccagcttagaaaagtgctgccataataacgataatttgtagagagaccaaaaatattttgagatcaccgtaatgcctttggtttaccgggatgagtaaccaaccacaggcctctgttcacaagagcacgacgtggtccccgcctgctgctagtctgtctgccactgggggcctcccaacatccatagcacacttcagcggaaggaccccagaaactgttgtgtttgtgtgtgctgatgacctagtgtgtcatttcacctcgtcacccagccctgcgtccggatgaggggacttctgcacaaatgacagaatctcggctggtggacagatactacagctttctcctcctccttgtgttcgtgttcagtctctgtggagactttcttttccattcaaatgacagtgcgcacttatctggtttacacaatgataccattttgaaagttggaagcctcaaactgagacgacagtgcagaacaaaacaaaagtgagttagggtcgttaaaattgaagtgttcttcttagggcaaacatgttgactccgagtattgtgtatgaatgtgctacgagaaacttccaaagagcaccattcacaatttggcattttcaaagaatgttccagccctcaaaggggcaactctttaaagtccttgttggcttttatccaaaccttgtagaaattgggaaagctgatagaggtaaggaagacgagtgaaaaggacaagaaggccaaacaccagccaaaaagaaactaggaaaaaaagattttctttgctaatatagatgtaaaaataacatcagacatctttgaaaattagcctctaaactcttaatacatacgttctgtgtgtctctacctggcgtctttaagaatatcctctctgggctctgaaattttaggagtgattcttatccactccaagttgtaagtatttgtagaaatttgtgcaaacaaacaaaaactatcaaatgaaaagaaaatgtactcaacctaacttatagttagcagctggaattctcaactcttccctgccagcactataccacagtgtggaagaaattagtcaaatgcttgttttcctgcttctcttttcaactgttactgtgctttgtttgaaagtagttttctctctcaaagccgttgcttatatcgttaagaatgaaggtttgtgtttaaaatttattgcattgcaaagggtagtttcactgaagtcatgcaccattaaataagatgaaatatttgtatttattgtcctacttcctaagccgtaacttcttttcctctgtgaatttgcattgagtcactcatgctacactacatcgctttagtatttgagatggcatttatgtttcctctcgtttatcatgaaatggggtcagattccatcagattccacctctgtcaggtggactcttgtctgccttccatgatgagattttttttctccttcccctttctttaagagaggctgacagatctaggtgtcaatcaattggaaaccagtctctgattttttttcattagttattttctatcattagtttcactgtgtaaattagatatcaactgcacttctttaaaaaaaaatacatctccctattacctccttgaaagatttacttctgtaggcctttttcaataggctcatgactgcagacaaggaaaaaaaaagtaaaaacaaaaacagtatgtgcctgaaaatgacaaaaaaaaaatttgtaacatttaaaaaagaaacctgaatagcctttaattctttaataatacacttaaattttatgtaaatcggttttcgccacgtgtgtttgttcacattctaaatgacttaatgggattctcacggtctgtgtctttgtgtcacgtgtataaaatgggcttgtgatgtaagcgtttcatctggtcagtggttcctttgatattgtactgctgctgggagtgggctgtggaacctgccttcgggtaactgggttcctcttgggtagattggagagatgggggtgggcgtgggcaaattctcacacatgttttcttaacctatttgcagaaactttcaaaaggcatttgattaaacctcttggcagtacagtattcttgtatttgttaacgtctgtgtttaggtactggtacctttttgttttaaaatgttctaagtgttggctttaaagtgaatttatctttagtatgatagttatatgaaaattataggatttgtgtgcagagaatttttttataaagtgctttgtaaaaaaaaaaaaatgtattctagcttttgcggtacatatgtgtgataactttaatacccatgacagttaagtgcaattatttcatcactctaaaaatgctatttttgtgtcagttcctgcaggtgttttcatgtctttgcaaagtgacacattttgatgccttcttgataaagtggtagacattttgtagctttctagaaactttgtattcatacggtatcaatgaaaaataaagaaaatgaaagtgtgggtcaccttttttatctgcaaaaaaaaaaaaaaaaaa

SEQ ID NO: 1045 - DNA, 2220 bp, Homo sapiens
cccacttttcccaaacaaagctcccggcaactttctccctcgcagcgccccgcccgcccgcggctccccagccccaggccgggaggcccagatgggggaaccccgggctggggccgccctggacgatggcagcggctggacgggcagtgaggaaggcagtgaggagggtaccggcggcagtgagggggctgggggtgacgggggcccggatgcagagggggtgtggagcccagacattgagcagagcttccaggaggccctggccatctatccaccctgcggccgccggaaaataattttgtctgatgaaggcaagatgtatggtcggaatgaactgatcgcccgctacatcaagctgagaacggggaagacccgaactcgaaaacaggtttctagtcacatccaggttttggcccgaaggaaatcaagggaaatccagtccaagttgaaggaccaggtttccaaggacaaggctttccagacaatggcaaccatgtcctctgcccagctcatctccgcgccttctctgcaggccaaactgggtcccactggtcctcaggcctctgagcttttccagttttggtctggaggatctgggcccccctggaatgttccagatgtgaagccattctcacagacaccgttcaccttgtcactgactcccccatctactgacctcccagggtacgagcccccccaagccctctcacccctgcccccacctaccccatcgcccccagcctggcaggctcggggcctgggcaccgcccggttgcagctggtagagttctcagccttcgtggaaccgccagatgcagttgattcttaccagaggcacctgttcgtgcacatcagccagcactgccccagccccggagcgccgccgctcgagagtgtggacgtccggcagatctacgacaaattccctgagaaaaagggtggcctccgagagctatatgatcgtggccccccccatgccttcttcctggtcaagttctgggcggacctgaactggggcccaagtggtgaggaggcaggggccggtggcagcatcagcagtggtggcttctacggagtgagcagccagtatgagagcctggaacacatgaccctcacctgttcctccaaggtctgctcttttggcaagcaggtggtggagaaggtggagacggaacgggcccagctggaggacggcagatttgtgtaccgcctgctgcgctcgcccatgtgcgagtacctggtgaatttcttgcacaagttgcggcagctgcctgagcgatacatgatgaacagcgtcctggaaaacttcaccatcctccaggtggtgacaaacagagacacccaggaactgctgctctgcaccgcctatgtcttcgaggtctccaccagcgagcgtggggcccagcatcacatttaccgcctggtcagggactgaagggggaccccaaaactggctcaccccccagaacaccctcctcccagggagggtcctccagctcacctcatgcttcttatttggggagagggctgtgatgtaaaggggttgacctcagaggcctaagcaactggggccatcccccccattagaggggcccccaaaacttggttggagagctgaacaggctgggactgaggaaaggataaaccccgatattgggacctcacagtgggtgtctgaaaggacagatcactccggagtatcagggattgtggggacaggagtgagacaaccccccaggtacagcactggcttttcttttcagcccctgacaggccacccccactcctctgcatgtcttggagagcgctagttacacattggcttgtcccctttactttttcccagccacccctccccctgaaatttctgcccctctctaccaccctcactccatgacctgtgagatcacaaagtgaagatgaaccctttctgtgcaggagcagagccaggtgggccctggacattttttttttttttaatataacgagatatttataagtgggtgctagggtcttgactttatctccgctgcacaagcagtgtgttgaactttctaatctcatccctctcctaagtgagccctgagctagacggtttccttcctcccctctcaaagtttgtttgtttgtgttctgacagaggataaagctattttaccaaaaaaaaaaaaaaaaaaaaaaaaaaaaaaaaaaaaaaaaaaaaaaaaaaaaaaaaaaaaa

SEQ ID NO: 1046 - DNA, 3023 bp, Homo sapiens
tcctcaacacaaactttccgtcccgctcgctccctcctccgcgctcggcgcctcccgctccagcccggctcattccgcacattccggccagccccctccccacgaccccccttccccggccccccttgcggctccctcgggcccggcggagcggcccggccggagcgcccccgcgagctcggaccaggctcagccgcccagtgggctcaggcccagagcccagagcaaccagcacaatagcgtccaacagctggaacgccagcagcagccccggggaggcccgggaggatgggcccgagggcctggacaaggggctggacaacgatgcggagggcgtgtggagcccggacatcgagcagagcttccaggaggccctggccatctacccgccctgcggccggcggaagatcatcctgtcagacgagggcaagatgtacggccgaaatgagttgattgcacgctatattaaactgaggacggggaagactcggacgagaaaacaggtgtccagccacatacaggttctagctcggaagaaggtgcgggagtaccaggttggcatcaaggccatgaacctggaccaggtctccaaggacaaagcccttcagagcatggcgtccatgtcctctgcccagatcgtctctgccagtgtcctgcagaacaagttcagcccaccttcccctctgccccaggccgtcttctccacttcctcgcggttctggagcagcccccctctcctgggacagcagcctggaccctctcaggacatcaagccctttgcacagccagcctaccccatccagccgcccctgccgccgacgctcagcagttatgagcccctggccccgctcccctcagctgctgcctctgtgcctgtgtggcaggaccgtaccattgcctcctcccggctgcggctcctggagtattcagccttcatggaggtgcagcgagaccctgacacgtacagcaaacacctgtttgtgcacatcggccagacgaaccccgccttctcagacccacccctggaggcagtagatgtgcgccagatctatgacaaattccccgagaaaaagggaggattgaaggagctctatgagaaggggccccctaatgccttcttccttgtcaagttctgggccgacctcaacagcaccatccaggagggcccgggagccttctatggggtcagctctcagtacagctctgctgatagcatgaccatcagcgtctccaccaaggtgtgctcctttggcaaacaggtggtagagaaggtggagactgagtatgccaggctggagaacgggcgctttgtgtaccgtatccaccgctcgcccatgtgcgagtacatgatcaacttcatccacaagctgaagcacctgcccgagaagtacatgatgaacagcgtgctggagaacttcaccatcctgcaggtggtcacgagccgggactcccaggagaccctgcttgtcattgcttttgtcttcgaagtctccaccagtgagcacggggcccagcaccatgtctacaagctcgtcaaagactagggtgccctctgcgcctccttaaggatgcagggtgagcatctcctctccacacctgcctggcacccctgggggggtccaggattgaggattcatctacctgccaggcctcaggcccaggacccaggaggcctccccacctaccccagcacacacactccctgccactgttctgcgctttaattgtgggagaagagaggagaggagggctcagcggtggggcagcctgtccggggcgctgacccaccatcaccctgctctgcccagcctcgcgtgacctcagagaggtggggataggggacaccttcagcctccagcatgtgtggccactgtacccccacccacccttgggggagcatgatgggcaggtgagggcaggatggagaccaagggagtcagtgagcagaggccctgggagtgtccggttggggttggactgaggacagaggggcccacacttccttgcccctttgtgtcccaggcctggtgcccagactccttgcatggcttgtgtggtcctcagactccgcacagcgagcgtaggtctctgggtttcagatgaagtgcccaggctccaggaagttgagggacccacaggagaggtgggcagagctggagttctcatccagggctgcttgtccccagagcccaggtttatactacctccctggggcgggggctggccgcagggtaggggagaggctctgcagtgtggagtggagcctcatcgaggggcgctgggttaggggagcacctgtttcagactgggcatgaagaagggagcacagcagctactagaccccattagcacctcattagcccacaagccagccaggggccccaggaagatggggcaccccccagcaccctccagattgagagcaaggtagaggaaggagtcccagcctctgggcagaccagaggcccagagggagagagtagcagaaggcttttgatttttctcttgcctgaggcttgaatctgacaaacccttggtgggcactgctcccttaggttcttccccacctcaatctacctgcctagagtagcagctcccagacccagttctgggactgaaggttaacccttcacctgctgtcccttcttaacacccaggcccccagagccagctgggcctgtccagcagccacctgtgggtatttatgagtttcatatgaagtactgtgccccttcccttcctcatcccgaccctgcccgagcttcctgaaggtcctcactgtttgcatatcgctcaggccacctccaaaccccacctaggttttataatgtatattatatatttttttgtgtatttttaaaatccagctgtgatgggttatatcataaatgcagcttggggttggagcaggggccctcaaaggcccagctcctgctcaaaaaaaaaaaaaaaaaaaaattaaagttatttgtttgtgggtcagtcatgtaaaaaaaaaaaaaaaaaaaaaaaaaaaaaaaaaa

SEQ ID NO: 1047 - DNA, 1780 bp, Homo sapiens
gtggccccgccgccactccctccggctccctccctcccgccgcggcgcgcatctcattccagccctcattccgcgcattccagcgtcctcctcgcacactcgaggccagggggcgggagggccgcagctccggcgccgccgcgtcccgccagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacgcagagggcgtgtggagcccggatattgagcagagtttccaggaggccctcgccatctacccgccctgtggcaggcgcaaaatcatcctgtcggacgagggcaagatgtatggtcggaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatggccctcgcccggggccccggccgcccagcagtctcagggttttggcaaggagctttgccaggccaagccggaacgtcccatgatgtgaagcctttctctcagcaaacctatgctgtccagcctccgctgcctctgccagggtttgagtctcctgcagggcccgccccatcgccctctgcgcccccggcacccccatggcagggccgcagcgtggccagctccaagctctggatgttggagttctctgccttcctggagcagcagcaggacccggacacgtacaacaagcacctgttcgtgcacattggccagtccagcccaagctacagcgacccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggcagccccctgaagtgccaagagagctgagaggagcagttgtgactctacccaggaacaaactgtgcctgaacctgaggtgcccaaccccaaataaacccaagatgctgtgtattttcagaggaaaa

SEQ ID NO: 1048 - DNA, 4382 bp, Homo sapiens
cggcagctgcagcgggtcgcacggctccggcccatctcggggggcgggcgggggaggcgaggtgcgcgagccgagtccggggcacgatgtccgacgcgggcggcggaaagaagccgcctgtggacccgcaggcaggacccggtccggggccggggcgcgcagctggggaaaggggcctgtcggggtccttccccctggtcctgaagaagctgatggagaaccccccgcgcgaggcgcgcctcgataaggaaaaggggaaggaaaagctggaggaggacgaggccgcagccgccagcaccatggctgtctcagcctccctcatgccacccatctgggacaagaccatcccatatgatggcgaatctttccacctggagtacatggacctggatgagttcctgctggagaatggcatccccgccagccccacccacctggcccacaacctgctgctgcctgtagcagagctagaagggaaggagtctgccagctcttccacagcatccccaccatcctcctccactgccatctttcagccctctgaaaccgtgtccagcacagaatcttccctggagaaggagagggagactcccagtcccatcgaccccaattgtgtggaagtggatgtgaacttcaatccggaccccgccgacctggtgctctccagtgtgccaggcggggagctcttcaaccctcggaagcacaagtttgctgaggaggacctgaagccccagcctatgatcaaaaaggccaagaaggtctttgtccccgacgagcagaaggatgaaaagtactggacaagacgcaagaagaacaacgtggcagctaaacggtcacgggatgcccggcgcctgaaagagaatcagatcaccatccgggcagccttcctggagaaggagaacacagccctgcggacggaggtggccgagctacgcaaggaggtgggcaagtgcaagaccatcgtgtccaagtatgagaccaaatacgggcccttgtaacccgtgccccccgcccgggcggggtactgcctgcacctcagacctctgcctgggggctccctgtaacccctcacacgcgtggagacttatgactcgtcgtgggcgcatggcggcgcacctgctgcaggagcggccacgtctcagcttcattataccatggcctgcgcacgtggcgacgtccctgaggggccagtctcctcactggtggggaacgcaagagaatctgcgtagatgggtgactcagccttagtttctattcttggatgtcccagttgaatcagaaggggacctctggagtacacacctctctcctgggcgctcagggtccctggactctccctcagtctccagcctgggctgccgagggctatctctgcagaatgagttgtgatcattgtcaccctatgtcttctcaggtagcagggcgcgtttccacttaaggtgtgtctgtcacgcacctcattctccccagacagtctttgagtaacatctgttcccatcttccttggaagcaggacacaccagctcctccgtcagtgtctgcatgggtagcaggctgcaggagtggggtctctgcacagcctgggatggggcttggggctggggcctgcagcagaagtgtgcccagcgtttctcggctcccgcaccccttttcccttatggctctgaggccatcggctgtctctgcatttcattggctgtggaggagagactcctaggatggctgctgtctgagccatgagtgccagggctgagagaggcctcttcatttcctctccaggctactcagaggccatgtgaagctcgtttgtcccactagaccaggcctctgggcctgctctttctttccacccaatgtccagtcttggatcatagatttaaaaggaaaacccctcttatctaggaggctttaacttcctggaccccaggattcaccttcctagtggtgtttagaaaatgcctccacagcccccttccaccatgggcatgagagctggggtgtgtttcttgagaagctcccttttttcttgctctgctcaccggtgtggcctgggctggagtgcactctccctgggggcagctggggcctcgcaattcttgcttcaggatctctcccatgcgagctgcccggagggtgtcagcagggcaagacacctagtctagagtcaccaaggtcacagtgccactttcacgggatagcaggctcttgggacttttacacaggcctagggtcccctcagtcttggtcccaggagatgggggccactcgtgaggctggccatgctgtggcttctcacagctgtggtctcccctgcctcacaacgactcctttctcttgtgtggcgggactcgcccttttgctgtgctcagaagattcactgaggaaactcatggaagcctctgctcatttgggtcactgggacacccctgagatgggtgtgtttatttgctcagggcgggcagcctatggtgaagaggagacagaggcgatgggcgtgcttcgtcctccgtaacactggctttatttaccgtggtggttcagagtcccaggccctgacctctaaagacttttcataacagacgttaagaccaagccgtggacctcaccccaggggaatgccacggccctttggggacctgcacacccacctctccgggggacttgacaaggggccctgaggccaagggaggtcactcctccctccaggcccctgacttttactttgtggttctctaaaaaccatgtacacactttcactctattgtaaccacacagggcaggcgcatccagcatgtcagtgtcctgccccgggcagctctccctcccgggcacgctccctctggcctggtggatcaccaagagggcggttctcattttgttattagtggaagagccttgagcttaaaagctcttcattttctttgccggaaagtatatggtttgtgtttttgcagttttatttttttaaggatggacactaaatctctggtgtccatgttccgagcccggtggctgggatggtggctcgatgtgtctcctctttatcccgccctctgcctgtttggtgccctcccttctttcccccaggcagtgggtatcgggttctttcccaaagtgcttacttggaaagagtgtggctgctggactcttttcgaaatgcccctctgagtcaggagcctggtggggacaagatggaggatgtccacagaggctgacctgtgggggaaaagaagtgctcaggtaaggttgtctcctctcctgtcctaaaaaaatccatgcttgcaggagagggttggtgcctgctcagtttctgtcgagggaatgggagtctcctcggctccctcctgggccctctgcttcttggaggccgaccgctggagactgcggctcctgtgcttggatctttgacatctgtcagtcactggaggctagagaagttgactttaccttggctttctgtgggttcccgatgggcttggaagtgccgtctacttcctaagcatcctgtctaaagctttgtggcaccctcagtgcaacctcagaacagacaaatcatgaatgagctggaactttgcaagaatattcatattataaatgtctcatctgatggaggaacgtgtgcatttagagagagggagagttttcaaggtttatggcaactttgtggaggacctgggtaactcttacccttggccaaaggaagaggttttcctgtctggcttctgaggttggagggggcacttagcagtgaaccttaagtctgggtacatgtaaccctgctgaggggctgtgcaggccgctcctacggtcctttggcctgaggcagggcgggaggcatgcaagccagtgggggaaaacccctctgaagctgggcagccctctacctgggccccgggagccgtgctccttggaacgcaaagggccgaggagcatctggttttcatggcaaagctctactccagagctcctttaacatctgctaattaagtgcaataaatttttctagaaaatggcaaagatgacttccaggtggatattgctctcttacggtgttggggatgccagaacaccacttggttttatttttctaagtgcatgtgatgtgatagagtgtgtggggctctgtgtccttccctgggagctggcattccagcgggcccctctctttacctttgttgggggaaggaggcaagagagaaattccttcttcccagccagagagggcagaagcagaccgtagcccattggccttatgtgcgtgtgtgcgtgcgagtgtgtcactgctggtgggccggagtgatgtggtgggagggaagccgggaatgtatccttttcagacaaaattaaatattttgaaatgagaaaaaaaaaaaaaaaaaaaa

SEQ ID NO: 1049 - DNA, 1670 bp, Homo sapiens
gatttcctcccacgcgaccttccagttctcggagccaggttaggggtttggcggaggaggactgcggggcgcgggcctagggccccagcagccacggccaggggagcgctcaagacagaaagccggtggcttcctcacctccacctgtaatgcaggagggagaattggctatttctcctataagccctgtggcagccatgcctcccctaggcacccacgtgcaagccagatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtggacccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgagttgtggatccaaatgggctcgccagactctggggaaatcacaagaaccgggtgaacatgacctacgagaagatgtctcgtgccctgcgccactattataagcttaatatcattaagaaggaaccggggcagaaactcctgttcagatttctaaagactccgggaaagatggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaaggctgggaggcctcccatccaggacactgggggcaggagtgtcatcttttgggcagggcaatcctggggctaaatgaggtacaggggaatggactctcccctactgcacccctgggagaggaagccaggcaccgatagagcacccagccccacccctgtaaatggaatttaccagatgaagggaatgaagtccctcactgagcctcagatttcctcacctgtgaaatgggctgaggcaggaaatgggaaaaagtgttagtgcttccaggcggcactgacagcctcagtaacaataaaaacaatggtagctgaaaaaaaaaaaaaaaaaaaaaaaaaaaaaaaaaaaaaaaaaaaaa

SEQ ID NO: 1050 - DNA, 3351 bp, Homo sapiens
gcggccgctgcgactccggagccggcggggggctccggtccttccctgcgccaccgcacaggacatctctctggctggggagcggcggtgagacccgccgagggcgtctgtgtccctcctcccccgcggtcctcggtgcgtccgcacgcccctcctcctcggctccctccttcttctctccgcgcctctccgccccctccccgtctccgcaggccgagtggtgcggcccgcctccagctgaccggcctggaatcccggctccgagccccggactcgcgcccgcccgcgcgcccgctccttccccctccccccgccccgagccccccgacgccgccgccaccgcctcctcagagcggggcccgggcccagccgccgccaccgctgccgccgccgagctccgccgccgccgagcaccatgggagacgctgggagcgagcgcagcaaagcgcccagcctgccgcctcgctgtccctgcggcttctgggggtccagcaagactatgaatctctgttccaaatgctttgctgattttcaaaagaaacagccagacgatgattccgctccaagtacaagtaacagccaatcagatttgttttccgaagagaccaccagtgacaacaacaatacctcgataaccacgccaactcttagtcccagccagcagccgcttccgacagaactgaatgtaacttcaccgagtaaagaggagtgtgggccatgcacagacacagctcatgtctcattaatcacaccaacaaaaagatcctgtggtacagattcacagtctgagaatgaggcttcaccagtaaaacggccacgactacttgagaatacggaacggtccgaggaaaccagtcgatctaaacagaagagtcgacgtcggtgcttccagtgccaaaccaaactggagctggtgcagcaggaattgggatcgtgtcgctgcggttatgtgttctgtatgttacatcgcctccccgagcagcacgactgcacattcgaccacatgggccgtggccgggaggaagccatcatgaaaatggtgaagctggaccggaaagtggggcgctcctgccagcgcatcggggaggggtgctcctgaaggccaggcatggccaccacgtgacgctgttcttagttcactaatgttagccttatttaggacaaagtcagccagacaccttgtactgggcacgcgtcagactgcagccagtccgtttcctttctttagccagccatcctggtactgtagtttaggggttgatggtggttgaaattgatttctggctggttactaaggtgcctgctagccattgtataaaattaaaacatgaagaatattttttttttgagcatggctagtggatttaaaacaacacatacctgtcactgctggagtcaaacttataaaaagccttaagtggaaagtgttccagacggagactctgagttaatagaggagtagaagctggtgttaaagttcccacgacgcacatggctttgccagaaactctgtttaatgatcggcctttcacctcttcacttatccttagtcccagtagccaggatacctgatggccacgtgtgccttggccacgggaggctgctgagattggccacgtggctgggctgggtggtggcctcactctcccacagagctggaaatggggggtgggggacagattcttacggaaatttttttacctgacttgctatgaaaaaactcatcacacaagaagagaaacagtaacctcactttgaaaattagctccactcaagactagtccacgaacgagacccgccttttctacacaggatccaaggtcacgagaagcagccagagtgccccgcctccgccggctctggtctgccattcgccagtgcagggatctggcacggaccagatgtggcgaatggcagcacagcgcggtggctgggtctgcacactggcctctgcagccagatttctatattgggagttttttaaaaagacatttcatagccaacaagaatcagtagaagtgctgggagcagcagctggggaagctgccgcccacgggctctgccccttccagctggagccgcccgtgcctccaggggccaagaggatgatgtcgtggcctccattctcgtttctatgcagccccatagtccaaggacacccagtccacatctaccatatagcaagtttagtaagggaaggcagcatacgtcccagggacagtgggtttggatctgtctagaacagcggtttgtggctgtggcccagctccgagagtgatatttgctctggtaggtgagggcctgagggtacatttctccacctgtgccccctcatgttcacagaggatttcagcagctgcaactgcgcacgccaggtggggaagggtgggggtgggcctggttgccccatgttaggaaatcactaccagtcaggtggggctggggctgggtggacaggatcaggattcccttgaaagcccaggcagggtgagcagtcccagtggtcctagtgccgcatcagatccaggtgggtgagggcaggaggcccctgcggaggcagcgtggatctgcccacacataggctactggaatagtttaacccagcaactttcctttttataaaacaacaaatggttcaactctgtctgcaaattaacagctgaacacctgcaactgcaaatgttttttgatccgacgtactgaaataggaagtcatgctcttcccaccctccacccaccagagtggaacccgctgcaaaatccccagccttaattcttgcttcaggacccagaccggtgtcttgctctagggcaacccagggcagaggggccaggtctgcccagcgtttaccactgctgtcaagccacagcccttggccaccatacgggccatcctcagtgaggcagccccccataggcttccgccaagctctggtcccgaagaggctgtgcgagcccttcccggccctccccagggccccccgccccctcctctgcctgctgcgtggaggcagccatgggaaggagcccaggggagctggcctgggggagcgaagcccatgttcgcttcctgacttagagctggggggggtggggggtggggcttgttcccctgcagtatctgttctgtgaagtttgttaaatgtaaggaaagcttaaattcttgtatctttaaaagagaaaatcttatttaacccttttgtgttctagatttacttacacacatagcctagagctcagttttagttttaacattgtgaaaatattaaaagaatcttgtaactttattcttttttctcctgctgaaaaaaaaaattaaaccaatcgtatgaaaaaaaaaaaaaaaaaaaa

SEQ ID NO: 1051 - DNA, 105 bp, Homo sapiens
atggcgtttctccgaagcatgtggggcgtgctgactgccctgggaaggtctggagcagagctgtgcaccggctgtggaagtcgactgcgctcccccttcaggtag

SEQ ID NO: 1052 - DNA, 3300 bp, Homo sapiens
acgggagctctttcccttctctcctcctcctcgcccttctcctcgccctcctcctcctcctcgccctcctcttcctcctcctcctccttgccctcctcctctccctcctccttctcctcctccacctcctctccctcctcctcctcctcctgcgctcaccgccggcagccagcactttgcgctcacccagagagtagctccacttgggtgcgagaccgagaggggcatatccgttcacgccgatccatgaaaatgctttggaaattgacggataatatcaagtacgaggactgcgaggaccgtcacgacggcaccagcaacgggacggcacggttgccccagctgggcactgtaggtcaatctccctacacgagcgccccgccgctgtcccacacccccaatgccgacttccagcccccatacttccccccaccctaccagcctatctacccccagtcgcaagatccttactcccacgtcaacgacccctacagcctgaaccccctgcacgcccagccgcagccgcagcacccaggctggcccggccagaggcagagccaggagtctgggctcctgcacacgcaccgggggctgcctcaccagctgtcgggcctggatcctcgcagggactacaggcggcacgaggacctcctgcacggcccacacgcgctcagctcaggactcggagacctctcgatccactccttacctcacgccatcgaggaggtcccgcatgtagaagacccgggtattaacatcccagatcaaactgtaattaagaaaggccccgtgtccctgtccaagtccaacagcaatgccgtctccgccatccctattaacaaggacaacctcttcggcggcgtggtgaaccccaacgaagtcttctgttcagttccgggtcgcctctcgctcctcagctccacctcgaagtacaaggtcacggtggcggaagtgcagcggcggctctcaccacccgagtgtctcaacgcgtcgctgctgggcggagtgctccggagggcgaagtctaaaaatggaggaagatctttaagagaaaaactggacaaaataggattaaatctgcctgcagggagacgtaaagctgccaacgttaccctgctcacatcactagtagagggagaagctgtccacctagccagggactttgggtacgtgtgcgaaaccgaatttcctgccaaagcagtagctgaatttctcaaccgacaacattccgatcccaatgagcaagtgacaagaaaaaacatgctcctggctacaaaacagatatgcaaagagttcaccgacctgctggctcaggaccgatctcccctggggaactcacggcccaaccccatcctggagcccggcatccagagctgcttgacccacttcaacctcatctcccacggcttcggcagccccgcggtgtgtgccgcggtcacggccctgcagaactatctcaccgaggccctcaaggccatggacaaaatgtacctcagcaacaaccccaacagccacacggacaacaacgccaaaagcagtgacaaagaggagaagcacagaaagtgaggctctcctcccgccccgcccctcccacgcctcaccagccccccgcgcgcccaccctccggcgggtgacagctccgggatcagcaacccttcctgctgctgctactgctgctgctgctgccgccgccgccgccgccgctgcccttgggtccccccgagtctccgggactgccctctcgactgtcagtggggcagcctctccgactctgcacccgcctcgacctccccacccgctcccacacccctgtgccctcatgtggagcctaagagaacagaacaggccgtgaagccagcagagaaaagttctgccaagtttgtgaacccttttttttttaaacaaaacaacaaatcaacaacagcaacaacaacaacaaaaattaaaaacttttttctaaaaaaaaagtgaaaataaaaaaaattatatgcgcttcatgggactgagtcaccaccttcccttacatacttcagttcagattgtagccatacttaaaaaaaaaaaaaaagccaaaagatgatgacaacatttttatcagtattgtgaataaacttgaacacaaatacacgaagttccatgtcatgtcttcagttgtagaagtttttcctctttaaggtaaagcgaccaacttgaactttctctggcaacacgattcgcagttatataagggaatcagtgttcacgtctctgtatatatttatttatgtgtaatttaatgggaattgtaaatatggtgagtctgttttaagcctttttttttttatttatctgatcttgtttacctcttgtttagtgggttttgaatcttccctattagttcttcatgtggttcatggtactgatttagaaatccagtgtttgggggatttttttctctgggattcatgaatttagccctgttgtagcatgttaaaggtgacaaacagctggacaaatttttaaaaagtaaaataaaattttatctataattagtattattacatttagcttttcattgaaccgaaagaaaaaaagtgatattggaccctggaaagattttgaaacttgagtggtttgataacccttctatgtattgtagggagaaaaaaaaaagtttattttattccactgtcctcccttaaaagcatcatttgagcaataaatgaatattgtctttaaaccaagggttagggaattttcctctctctctctctctcctctctctttctgttcaaagaacttcaaacatttgggaccacctggtattctgtattttcactggccatattggaagcagttctagttgcattgtattgagttgtgctggcagtagtttccatgcctgtcaatgtatcatagtcctttgttgcccagataaataaatatttgatacgctttatgtcgatttttttttattcagtggctgtctttacccaggcgtatttttgttcttggcagtattttttattcagtatggttacagtaattgagtttaactctcccttggcaattgctccttgcaataagcagctgaacccattgtttccctcaagtataataaaaacttactttcaacttggagttcagagcagggtatcatttagatattccactgtgtctgtattcagacaaatgacacaataaaacccaatgtattcttttggataaaagattgtttgtactgctaaaggaatgacatactgtcttttccttactagaaacattaattttattattaaaaataaagttttattttattta

SEQ ID NO: 1053 - DNA, 5770 bp, Homo sapiens
ttctctttgctgaggcttacttgtccagcctattgtttgagacaacagatataagttgcgatgggagaggagcgtcggatttggtgtgtatcccccatttccaattatagatggatcattacagacagcggagtcctgagaagccagacatctgctcctcacatgaatgcactcacctcctagagaccaggctgccatcatgctctggaagcttgtggagaatgtcaagtacgaagatatctatgaggaccggcacgatggtgtcccgagccacagctcgcggctctcccagctgggctcggtgtcccaaggaccctactcgagcgccccgccgctgtcccacaccccgtcgtcggacttccagccgccctacttcccacccccctaccagccgctcccctaccaccagagccaggacccctactcccacgtcaacgacccctactccctgaacccactgcaccagccccagcaacatccctgggggcaacggcagcggcaagaagtgggttcggaagccggctctctcctgccccagcctcgggccgccttgccccagctctcgggccttgacccccggagggactaccactcggtccgccggccggacgtgctgctgcattcggcgcaccacggcctggacgcgggcatgggtgacagcctctcgctgcacggcctcggccatcccggaatggaagacgtccagtcagttgaagatgccaataacagcggcatgaatctattggaccagtctgtcattaaaaaagttccagttcctcccaaatcggtgacttctctaatgatgaataaagacggcttcctgggaggcatgtctgtcaacaccggcgaggtgttttgctccgtcccaggccgtttgtctctgctcagttcaacttcgaagtacaaagtaactgtgggagaagttcagagacggctgtcgccccctgaatgcctcaatgcatctctcctcggcggagtcctcagaagagccaaatcgaaaaatggggggagatctttgcgagaaaggctagaaaaaatcggtttgaatttacccgcgggcaggcgcaaagcagcaaatgtcacgttactcacctccctggtggaaggagaagctgttcacttagctagggattttgggtacatttgcgaaacggagtttcccgccaaagccgtctctgagtatttgaaccggcagcacacagacccgagtgacctgcactcccgaaagaatatgctgttggccaccaagcaactttgtaaagaatttacggatctactggcgcaggaccggacaccgatagggaacagccgacccagccccatcctggagccggggatccagagctgcctcacgcacttcagcctcatcacgcacggcttcggcgccccggccatttgcgccgcgctcacggccctgcagaactatctcaccgaggcgctcaaaggcatggacaagatgttcttgaacaacaccaccactaacaggcacacgtctggggaaggcccaggtagtaaaactggcgacaaggaggagaaacacaggaaatgaaaaatttttaaaaaaagaaggaaaaatgttttaaatacaaaaggaaaaacagacaaaaatttaattttagctttaaaatattggattggctttggaagaattatattaggtagaatacacatacaatcaaaattttaaaaaaaaaagctaaataacttaaaaaaaaactgaggcgtacaacggagcaacaatatcggttctcagtgtctatttcaagatacatttggagacaaccgtccggattttccacttcggttctttcgagtttagtaatactgataataaaagaaaaccatgatttccccttccctttggaaaataaacataagactaaacatgagaaaaacgctaacttattggaagaaaatcggagaaacgttggtgtcaatgctttgagagctggttgactgagacgcacgaactttttaattttaaatatatttttaggaaactctcgcagtccccgccctccatctcacctcacccgtctcccaaccacccttttccatgttaccctcccttcctcacattgttacgggaatcttctgggatgaaaatgagtgtggttggcccttttgcgttgtttcagtcctctcggtacctccccgcccagccctgcgatcttaactcaccgggcccggctccccggccgcttgcataattagggagggcgagggcggggcgggaggcctgtggagaccaggcggaggctgcaatttttggtgccggccggcagagcaggttctggcggctgaggaaaatccggaccaataagttgattcaaacatcatcagttcctttcagaaatgttactagctcccagccttgccagcatctgcatagagagaatctcacatttattatatttgtgtcatctactaattttatgaactatagtaaaaaaaaaaaaacacacacacacacaatatgaatacgttgattagtatgtaattccttcggaggggtatgtaccatttcattctcttctgttttccaaagctttgcccgcatggtttatgagcttcttcaaagaggacttgggcttcctacacaatctataaggtacagagaaaaaaaaatccgatccctttttaatcaaagcctgtgtgtcagaattctgcaggtgcacttctttaaagaagctcaaagggaataatttagaaagtggccaatatgatggaagcagctttgaatctacatgctaacattcctcaacactccaattccggtggaggtggcaggggagggggtctgcaaaatgaattttaagggaaaagagtaaggattcttagagccctatattctaatagtattgccctgcatttaaaattgatttgatttccctgggttctttggtgattgctgtttaagcaaggaaagaagcagctttacgagtggacgtggggaggagggcggcacaagcacccacatttctgtaacaattgctttcttacaagatgctttatgaatgaggcatttttccctcccagacgtgcacttgttttggcatataatggcaaaataatgcaaagtgaagggagatgtatttcagctttgatttttaccgtctggatacatcgggactattcccagtggataaagtttcatgcatttaatatttctcacttctggcagcccagctcctttcttgggctccatcttagcattatcatgaaataagatctggaatccattgtctgcacctccgcaaaagcagtgagaaattatcccgggataagggtgaatgagagaggtctctaaatatagtgttgatacactcacctatttaacaaagtagacgagatctttgcaataccccttaaagataacgacatagatgttgttctgcaggatttatagttaggacccactcaattctccaggactcccggttttgcccccctcccgctttgccttggtgggggtggggattgggggagtggggattgcgttggggttttaggaatctgctgagagctttgcccatttttattaaaagaggaaagggaagttaggaagctcgtctcaggtcaccaaaagggcccaagcaactgttagggccacactgcagcccatctccaacccctagcttcgtttagcacttctgatcttcatggcccagccctagaactgttgagaggaatgcaatggccaagagctagacgttacggagagtgtagtcactctcttttcccagctcagaggcctgcgccttcgtccgagagctcggccgatcgcattagatgtgttctgattgcacaaggccaggagagaccacactgaaaacgatcgtctcctttccttgcagggcaacgcgccccacgcgtgtgacgtgcgagagacgcgatggacgcgccttgctcttactgtgcaggtcctgagagcgtgtgggccacaggcgcccagtcgtgttgaggacatagaatcagccgctggaggggctgccgactgcgcgggcccttcccgctctcggtctcaccctaagggctaaggcgaccgagaaagccccattctccagtaggtaatggggcggcgcccggtgggctgcaggtggggagggctcccagcgccgccagcggccacccggggcgccggctcctggagggagagtggcctagaaatatccaaggaatccgaagcttcccctcctccacctctgccagtacggaaacaccccaccgtcacaatcctaaagcggggagatgggatgggaattgtcttacttggcaaggcagggtaccttcattgccagacgccctcatttgtgtgttcctccttgctccagcgagatagaaccttttgcgcccccaaccccgtttcgtggagtgagcccactaccccttctccctccctcacttctcctttcatgtaggacccccgcccccttgctttccttagccaggcccgctacatttatctgataattgagttattaaaagatttggtttccttgggcctataaatcaataaacagtaggattaacgcaatagtttgccttttaagtcaagggagacgtttaaggcaagcccctttgagctttgttttcaaaccaaacaggtgagttgcagctctccccccggcccctgcactcttcagacatttggtccctgcccactcctaaacgctcagtcccaaaacaaaatagcgaaagacaggaggagtcaggatgtggcagtgctgccttcacactttccacttcgcaagttcttttaaaggttccaaagatctccagaccattctctgccaaaccctgccgcctcctgcacgtattgcaggtctctggggagcaagaaatgtcctgtttgggtgaggattccgtcacctaaaaagatctttaacttctcccccaaagtgggaaggtaactttctcccccttttccccaccaccttcactcctacacccccaattaccttgcattttctttccttccttctggcctccacacccatagctttcctccatccccacttaaagaaccgaagaggcttttaaagacctggctgctttgttttccttggccaaggaagccactttctctcaagcaattatttcatatcctacgaaaactttggtcgaatggaaaactcgaaacctcgagcttatctacacactgttcctctgctacaatgctttcctagttaagagtgtttatagagaatttgtcatcacatctgatatcctgtacttgtaatacattatgtggaaaggaaataaccttaaaccgtctgatgttgcctcaagagcccaaacggcgtttccccacctttgacgatgtatgtgaaattactggcttaaaaaaaaaagtatcaatttttttttaacggaatgaacactatccttctttaaatgccaaaatcgactccacctttgagttggtctctaattctctaacattgtttttgccacacaatcaagaaatatcaatctattgactcttcacgagaagagctctggagggtattcatgttaagtttgtatatatttatttatgcttaatttaatgggaatgtgtaaatatggcgagcaagtagtttgggattatttatctgtgaatctatacctctgtgaatgggtggttaaaaaacctcttgaccctagatagaatcctatctgaatttttctgttctttataaacaagctgttatggtaatgggtagaaattggtttattgtccagtgttaatctgatttacataaataaaaagattgttgtgttttca

SEQ ID NO: 1054 - DNA, 2040 bp, Homo sapiens
acaataaaatgtgtgcaaatactctccacagagataagtccccacctcagtcggtatagaaaagcatgataaaggttggaaaaaatggataaaaatgttgaaagaacctccagttccttattaggcgaagatacaatatttattccttgtctcctgggataaatctcttctgcctattgtcctcccagttctcagtgctgatgcttaattttcaaaacttctatattaccaagggacctacgacatcagccaaagaaatactcagcaagtacaaaatctgttccagggagctgcttttgtgcagagggaaaattttgttcctacaggtttttaagtgggtacgaggcaaggagctatctgatccgggcaaaaccattacaatttagatatctacctatagaacattttttttttcctttaaaaattggaaaatacaagaagtttggatttttttttcccgattctttttttggagggggaaattgcatcgtaagctttcggagaaacccaacatgtcaactacctttccgggactagtccacgatgccgagatacgtcacgacggatcaaacagctaccgtttgatgcagcttggctgtctggagtcagtagccaattccactgtcgcctattcctcctcctctcctttaacttactccaccaccggcaccgagtttgcgtccccctacttctccactaaccaccagtacaccccgctccaccaccagtccttccattacgagtttcagcacagccacccggccgtcacccccgacgcctactctctgaactctctccaccactcgcaacagtactaccagcagatccaccacggggagcccaccgactttattaacctgcacaatgcgcgggcgctcaagtcgtcctgcctggacgagcagaggcgggagctgggctgcctcgatgcctaccgccgccatgacctgtccctcatgagccatggctctcagtatggaatgcacccagatcaaagactcctgccagggcccagcctggggctggccgccgcgggagcagacgacttgcagggctctgtggaggcccagtgtgggcttgttctcaatggccaaggtggagtgataagaagaggtggcacctgtgtggtcaaccccacagacttattttgctctgtccctggccgtttgtcccttcttagttctacttccaaatacaaggtgaccattgctgaggtaaagaggcgcctctccccacctgagtgcctcaatgcttcactcttgggaggcattttgagaagagcaaaatcaaagaatgggggccgctgcctgagagagaaattggataggcttggcttaaacttaccagcaggaagacggaaagcagctaatgtcaccctccttacttccttggttgaaggggaggctttgcacttggctcgggattttggctacacttgtgaaacagagtttccagccaaagcagtaggagaacatcttgccagacaacatatggaacagaaagaacagacagcaagaaaaaagatgatcctggcgaccaaacaaatctgtaaagaattccaagacctcttgagccaagatagatcaccactgggatcctccagacccactccaattctagaccttgacatccagagacatttaacacatttcagtttgatcactcatggctttgggactccggcaatatgtgcagctctaagcactttccaaacagttctcagtgaaatgctgaactacttggaaaaacacactactcacaagaacggcggagcggcggattctggccaaggacatgccaactcggagaaagctcccctgcggaaaacttcagaggctgccgtgaaagagggcaaaacagaaaagacagactagctacatcaaacagaatctatttccagagagtcttgctgctgatattttttctaatatatatatcattgagggtgactaatcttcagtggaccaaatctctacccttccccaaccctccataaaaaaacaaaaatggaaatgaaaaatgaaacaaaaaaggacaaaacca

SEQ ID NO: 1055 - DNA, 2895 bp, Homo sapiens
cgccaggacacactgttcgggcgcggctttccccgtccgcggagcggtcttgacactcgcggcggcagcatctacgctcgcagagccgccgatgcgtgtccagtgacccggacagcaaggcccgcgcgcggcgggggcggcggcagacgcctggtcaccgtgaccccgattttggatttaccgcttgggggctggggggatcctggatttaactggcgactgttttgggggacgccggacgccatgttgtggaaaataaccgataatgtcaagtacgaagaggactgcgaggatcgccacgacgggagcagcaatgggaatccgcgggtcccccacctctcctccgccgggcagcacctctacagccccgcgccacccctctcccacactggagtcgccgaatatcagccgccaccctactttccccctccctaccagcagctggcctactcccagtcggccgacccctactcgcatctgggggaagcgtacgccgccgccatcaaccccctgcaccagccggcgcccacaggcagccagcagcaggcctggcccggccgccagagccaggagggagcggggctgccctcgcaccacgggcgcccggccggcctactgccccacctctccgggctggaggcgggcgcggtgagcgcccgcagggatgcctaccgccgctccgacctgctgctgccccacgcacacgccctggatgccgcgggcctggccgagaacctggggctccacgacatgcctcaccagatggacgaggtgcagaatgtcgacgaccagcacctgttgctgcacgatcagacagtcattcgcaaaggtcccatttccatgaccaagaaccctctgaacctcccctgtcagaaggagctggtgggggccgtaatgaaccccactgaggtcttctgctcagtccctggaagattgtcgctcctcagctctacgtctaaatacaaagtgacagtggctgaagtacagaggcgactgtccccacctgaatgcttaaatgcctcgttactgggaggtgttctcagaagagccaaatcgaaaaatggaggccggtccttgcgggagaagttggacaagattgggttgaatcttccggccgggaggcggaaagccgctcatgtgactctcctgacatccttagtagaaggtgaagctgttcatttggctagggactttgcctatgtctgtgaagccgaatttcctagtaaaccagtggcagaatatttaaccagacctcatcttggaggacgaaatgagatggcagctaggaagaacatgctattggcggcccagcaactgtgtaaagaattcacagaacttctcagccaagaccggacaccccatgggaccagcaggctcgccccagtcttggagacgaacatacagaactgcttgtctcatttcagcctgattacccacgggtttggcagccaggccatctgtgccgcggtgtctgccctgcagaactacatcaaagaagccctgattgtcatagacaaatcctacatgaaccctggagaccagagtccagctgattctaacaaaaccctggagaaaatggagaaacacaggaaataaaattggaacgaagaaaggttaggagagtagggaaggaacaggactgcaaaaatccttctccaccgcacagactgggaacccctcctggcctgggggaagagtttgttacctaccttactatttaaagagccttcactggttctgcatcacccgcccctggacttcttagttgtttctctagcgctgagctatctcctaactttggacctattatcagaaggtgacaagtactggctctttattcattaagctttttttttttgaaccccattctttccttctctgaaagtggtgctataagttttagaatcttttaaatacattccctgggccaacagacccacacacttagccattgaaatgtcaaattgatgtgccctagatcaacagatcaacaataccttttttttcagtgttaaggtaatggttggtttttgtgtccgctaaatatttaccttgaaaaaaagaaaagtgtgtatctagcttcttcagagatcaagtcctctggtaggaggcaaaggttctatctgcttagcaactagttaataagtggtatctgacacactctaaaccccgtgttcaaacgggggccttctggttttaggaaacttgtagaaacgaagcctgctgattgatttttttctcctttttttttttttttttttttaactttgaaagttaactcttcaaatgggagactctttgaaatgacatgttcctttaaggtactgaagctttatttgcatatttatttcagatgtttcgagtaaacttgaaaagggtaggcacgaagcaatttgttgctgcttgtcacccccaagtccccgtggaggttctgtattttaagaaacagtgcgttgagtgtacagattttatttatgcgtaatttaatggggtctgtaaatactggtgcacttcttacgacttttttgagacatgggatccaattttaatattaacttttaatggtgatggggtaatctataacacatcataaggttttattcatatatatacagggtattaagaattaagaggatgctgggctctgttcttggcttggaagattctatttaattgaaactctctgttcagaaagcaataactttgtctcgttcctgttgggctgaaccctaaggtgagtgtgcagtacagtgtgtgtgggtgaaatggagatttggaattgaactctctgcctgtaaatgttccccaaataattgttgtgtgtatgatacgtgtataataaaagtattcttgttagaatctgaaaaaaaaaaaaaaaaaaaaaaaaaaaaaaaa

SEQ ID NO: 1056 - DNA, 2147 bp, Homo sapiens
cacacacacacacacacacacacacacacacacacacacacacacatacacacgcccggggaggcaggccggagagacctccctcccgcccctcccgcccgcctccctcccctcgccgccgccgccgccgccagcatctgggaccggccgattctgcacctccgtccggcgctgccctttgattcggatttccatcttgcattctccggctgatcgcgggacctggctcgtgcagaggaggggggccgatcgctatggagtatttcatggtgcccactcagaaggtgccctctttgcaacatttcaggaaaacagagaaagaagtgataggagggctctgtagccttgccaacattccactaacccccgagactcagcgggaccaggagcggcggattcggcgggagatcgccaacagcaacgagcggagacgcatgcagagcatcaacgcgggattccagtccctcaagaccctcatcccccacacagacggagagaagctcagcaaggcagccattctccagcagacagccgagtacatcttctccctggagcaggagaagaccaggctcttgcagcagaacacacagctcaagcgcttcatccaggagctgagcggctcgtcccccaagcgacggcgggcagaggacaaggacgaaggcataggctccccggacatctgggaggacgagaaggcggaggacctgcggcgggagatgattgagctgcggcagcagctggacaaggagcgctcggtgcgcatgatgctggaggagcaggtgcgctcgctggaggcccacatgtacccggaaaagctcaaggtgattgcgcagcaggtgcagctgcagcagcagcaggaacaggtgaggctgctgcaccaggagaagctggagcgggaacagcagcagctgcggacccagcttctgccccctccggcccccacccaccaccccacggtgatcgtgccagcaccgcctcctcctccctcccaccacatcaatgtcgtcaccatgggcccctcctcggtcatcaactctgtttccacatcccggcaaaatctggacaccatcgtgcaggcaatccagcacatcgagggcacccaggaaaagcaggagctggaggaggagcagcggcgagctgtcatcgtgaagcctgtccgcagctgcccggaggcccccacctctgacaccgcctccgactccgaggcctcagacagtgacgccatggaccagagccgggaggagccgtcgggggacggggagcttccctgactacccccccagccctcctctcccttctgggggctggagggagccggggcagccacagggagagacatgggcgaatgagtgagaaatttttacaaaattacgatgtcatttgggtctcttttatgacctctttttcaatactgtaaatcgacctttgaacgaagccactcaacccgaggtcccggggctggggtgtcgcagagcgtgtgggagcatcggcaccccagggcggggcctcggccccgggggctggaggaagctgacacggagatgcctggcctctctctgccaaaaagcattttttcctttaaatatgttttttaagaacagggaaaattaaacaaaaccccaggttatttcttccctgcccagagccagcctgggattgtcagccttcaatcccctttccttcctctttttgggttttcttctttctcctttaagcacttacatggttgggggtaagactaggctggggcattctgggggcccggaggtctccgttgcttcttggttggggtttgctgctgctgtgcccccctcccccttccccatctcggcactagaattcgccactctcccaccccccagcccccacctctgcctccaggtctcatcttccaccccaaaaatgtctgtctctctctttttgttttgtttgttgttggttttttatttctttttggtttgctttctgtttttgttttgtttttcttttttttctttcttttttttttttttttacaattttgaggtcttcgtgttcaaggagaagctattatattttgttaagaaagtggggagaaaaaaaccaagaggccaccgtgcctttgtaaagaaacaaaataaagtttgtactttgttttttaaaaaaaa

SEQ ID NO: 1057 - DNA, 1289 bp, Homo sapiens
tttctttcggagcggcggtgaaggtcctgggtgaggtagggttggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacagataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacagatgctttctgatgcagcacctgggaaactgagaattgttcatggagatgtcttgacatttaaggtagaaaaggctttttcagaaagtcttaaaagaccctgggaagatgatcctccaaatgtacatattattggaaatctgccttttagtgtttcaactccactgattatcaagtggcttgaaaatatttcctgtagagatggaccttttgtttatggcagaactcagatgactttgacttttcaaaaggaagtggcagagagacttgcagccaatacaggaagcaaacagcgtagtcgcctctctgttatggctcagtacctctgcaatgttcgacacatctttacgattccaggacaagcttttgtccccaaaccagaggtggacgtgggcgtggtgcacttcactcccttgatacagcccaagatagagcagccattcaagctggtggaaaaagtggttcagaatgtatttcagttccgaaggaaatactgccatcgagggctcagaatgttattccctgaagcgcagcgcttggaaagcacgggcaggctgttagagttggcagacatagaccctactcttcggccccgccagctctccatctcacactttaagagcctctgtgatgtatacagaaaaatgtgtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtaaaaa

SEQ ID NO: 1058 - DNA, 1799 bp, Homo sapiens
ctagtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagtccttaggaaaaaatctggatggaaaactacgagtgattcactgtgacttctttaaactagatcctagaagtggtggagtaataaaaccacctgctatgtcttctcgagggctctttaagaatttgggaatagaagcagttccttggacagcagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacgttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggatgaaacagtgtctgctattttattcacaattgaataaaatgaaaacttcaattaattgtggatttgatcagattgaattcgttttgtttcagattcctatttaaatatttcacttgtactgttgctgatttttgcatcttcttgaagagcaagagtctgtacattattaagcttagaaagtaagcaaaactgatttactggtttgcctttcagtttgttgaaatgtattgtcaagtactgtacaatgaaattgtttaaattttaatatgatttaagctttttagaaattaaaatattttaaataagaaaaaaaaaaaaaaa

SEQ ID NO: 1059 - DNA, 3715 bp, Homo sapiens
gacgtcatgttcgccgggcaggcgaggaaagaggacgccatgattggttggcgctggggcggcggacggtggaagggcctggcgagtctaggttttacgcctgtgctggactttctccttccatgtttccaggccgtggggggctacagagggcgagaagtcggctcagcggaaacctggatttggttctaagccgtggggttgagaaggggtgaccggaagtgatcgtgggactgaccggaagcgaggcctggaggggaaagagagagcgagacctgggagggagggggcctccagcagaaaggggcgggggaaaaggtgcaaaagcagcgtgggagcgccgggctggcttcctgcggctgctgctggtctgactgggaagcagcaagccaccactacgaactctcaagaggagtgggagtgcgggagtccagagctgcctctgggaagtctgcagtagttgagcaaaggggtcctcacgttcctgagagctgggcaggggggattttggaacctggggcagccaagaacgagcagccaagggtacgggagattagttgtgcacagagcagtgctggtcgggcttgggggtggctggtgggcactgcgtgggaaaccttggtttgtagttttcttggtttgcgttactcctgttgggtagaattaccctccgcgcctttgtacaagacacggtgtctcctggggcaaggaaggagccaggatggcctgggctctgaagctgcctctggccgacgaagtgattgaatccgggttggtgcaggactttgatgctagcctgtccgggatcggccaggaactgggtgctggtgcctatagcatgagtgatgtccttgcattgcccatttttaagcaagaagagtcgagtttgcctcctgataatgagaataaaatcctgccttttcaatatgtgctttgtgctgctacctctccagcagtgaaactccatgatgaaaccctaacgtatctcaatcaaggacagtcttatgaaattcgaatgctagacaataggaaacttggagaacttccagaaattaatggcaaattggtgaagagtatattccgtgtggtgttccatgacagaaggcttcagtacactgagcatcagcagctagagggctggaggtggaaccgacctggagacagaattcttgacatagatatcccgatgtctgtgggtataatcgatcctagggctaatccaactcaactaaatacagtggagttcctgtgggaccctgcaaagaggacatctgtgtttattcaggtgcactgtattagcacagagttcactatgaggaaacatggtggagaaaagggggtgccattccgagtacaaatagataccttcaaggagaatgaaaacggggaatatactgagcacttacactcggccagctgccagatcaaagttttcaagcccaaaggtgcagacagaaagcaaaaaacggatagggaaaaaatggagaaacgaacacctcatgaaaaggagaaatatcagccttcctatgagacaaccatactcacagagtgttctccatggcccgagatcacgtatgtcaataactccccatcacctggcttcaacagttcccatagcagtttttctcttggggaaggaaatggttcaccaaaccaccagccagagccaccccctccagtcacagataacctcttaccaacaaccacacctcaggaagctcagcagtggttgcatcgaaatcgtttttctacattcacaaggcttttcacaaacttctcaggggcagatttattgaaattaactagagatgatgtgatccaaatctgtggccctgcagatggaatcagactttttaatgcattaaaaggccggatggtgcgtccaaggttaaccatttatgtttgtcaggaatcactgcagttgagggagcagcaacaacagcagcagcaacagcagcagaagcatgaggatggagactcaaatggtactttcttcgtttaccatgctatctatctagaagaactaacagctgttgaattgacagaaaaaattgctcagcttttcagcatttccccttgccagatcagccagatttacaagcaggggccaacaggaattcatgtgctcatcagtgatgagatgatacagaactttcaggaagaagcatgttttattctggacacaatgaaagcagaaaccaatgatagctatcatatcatactgaagtaggagtgcggcgtttcgtgcccagtggctgctccttccttcacctctgaaaacggccctcttgaagggggatatgaatggagatttgaaggtctgcaagaacctgactcgtctgactgtgtgtggaggagtccaggccatggaggcagaatcctggccctctgtgttggcccaagctcttgtggtacacacagattactgcccaatatgcagttctgcagctgttttagttaaatttctggaccttgttgttgttaaatatcagtagaaactctacataatttagagtgtatgtagggcataatgatgatgggaattgtgtgatgtttaacaggaagatcttaaattttgtgatatggagccctgtaatttttttcttatataaaaatgggtatctatattcataagactaggtcttcaatctctttgtactggtctcaaatgtactggtatctctgctttttgccacagtttgtccctgaaaactttatcagtgaggagaaatacagaattttccttttggttcccctgtaataccacaactaatagtattttcagctaacatttattgaccaggcagtgtgataaattttttgaatgaccatcttgtttaaccccctaatcacactatctgaagtaggtgctatagtgacccccaaccgaagatgaggaaatggagacacacagtggctaagtagcttgctaggtgccaggagctggcaggcagtgatgctgaaatccaaaccaggcaatctggccctccttattcaccctctcataccaccagtgctacccattataacctgtgttcacttcgcttattactgtggcccttctggtgactacaacataacactgagtatgaactgaggaattaaccactgaaagagacaaagcacacctaaataatgatgaacaaatcaagacctacaagaaatgaacacatagatgctttttaagtgtcattagttatcggaatcaaagaatttgaggtggtgacaactggggattatctgtaactccccaaatttactgttcttgaatgacattctcaaactatttattaatgagttagtctcatccctgctttctgtttcctctctctgcatcttctcttggcataggaagttattttactcatgctatgttttttaatagaagctttacaaaaaaagatgcattcccttcctgttcacactcttaccatgtttttgttcttccttaagaatgattgtgtgtgtgtgtgtgtgtgtgtgtaagtgtgtaagtgtaacatcatgggttttctttcttcacttgtaaagttttatctagaaatacttttacaggttatgttgaggtacacaaagataatgttctaagattgtgtattggatttggatttgtgtgtgtgtgtgtgtgtgtgtgtgtttaaagcatttgataaggtttaaatgttttttatacagagatttttgttcattaaactcaatctgcatcatggtctaa

SEQ ID NO: 1060 - DNA, 3431 bp, Homo sapiens
gggggaggagggcggtcgtccggggttaggttgagggggggcgtcggtccgttctgggcgggggatgactcacagcccatcccatctcccagacgccgcccgcccgcgcagtgctagctccatggcttagcggaggaggcggcagtggcgagctggggggaggggggactcttattttgttagggggaccgggccgaggcccgaccggcctggcagggctcgcccggggccgggcgtcatgtctcatgcggccgaaccagctcgggatggcgtagaggccagcgcggagggccctcgagccgtgttcgtgctgttggaggagcgcaggccggccgactcggctcagctgctcagcctgaactctttgcttccggaatccgggattgttgctgacatagaattagaaaacgtccttgatcctgacagcttctacgagctcaaaagccaacccttaccccttcgctcaagcctcccaatatcactgcaggccacaccagccaccccagctacactctctgcatcgtcttctgcagggggctccaggacccctgccatgtcgtcatcttcttcatcgagggtcttgctgcggcagcagctaatgcgggcccaggcgcaggagcaggagaggcgtgagcgtcgggaacaggccgccgcggctcccttccccagtcctgcacctgcctctcctgccatctctgtggttggcgtctctgctgggggccacacattgagccgtccaccccctgctcaggtgcccagggaggtgctcaaggtgcagacccatctggagaacccaacgcgctaccacctgcagcaggcgcgccggcagcaggtgaaacagtacctgtccaccacactcgggcccaagctggcttcccaggccctcaccccaccgccggggcccgcaagtgcccagccactgcctgcccctgaggctgcccacactaccggccccacaggcagtgcgcccaacagccccatggcgctgctcaccatcgggtccagctcagagaaggagattgatgatgtcattgatgagatcatcagcctggagtccagttacaatgatgaaatgctcagctatctgcccggaggcaccacaggactgcagctccccagcacgctgcctgtgtcagggaatctgcttgatgtgtacagtagtcaaggcgtggccacaccagccatcactgtcagcaactcctgcccagctgagctgcccaacatcaaacgggagatctctgagaccgaggcaaaggcccttttgaaggaacggcagaagaaagacaatcacaacctaattgagcgtcgcaggcgattcaacattaacgacaggatcaaggaactgggcactctcatccctaagtccagtgacccggagatgcgctggaacaagggcaccatcctgaaggcctctgtggattatatccgcaagctgcagaaggagcagcagcgctccaaagacctggagagccggcagcgatccctggagcaggccaaccgcagcctgcagctccgaattcaggaactagaactgcaggcccagatccatggcctgccagtacctcccactccagggctgctttccttggccacgacttcggcttctgacagcctcaagccagagcagctggacattgaggaggagggcaggccaggcgcagcaacgttccatgtaggggggggacctgcccagaatgctccccatcagcagccccctgcaccgccctcagatgcccttctggacctgcactttcccagcgaccacctgggggacctgggagaccccttccacctggggctggaggacattctgatggaggaggaggagggggtggtgggaggactgtcggggggtgccctgtccccactgcgggctgcctccgatcccctgctctcttcagtgtcccctgctgtctccaaggccagcagccgccgcagcagcttcagcatggaagaggagtcctgatcaggcctcacccctcccctgggactttcccacccaggaaaggaggaccagtcaggatgaggccccgccttttcccccaccctcccatgagactgccctgcccaggtatcctgggggaagaggagatgtgatcaggccccacccctgtaatcaggcaaggaggaggagtcagatgaggccctgcaccttccccaaaggaaccgcccagtgcaggtatttcagaaggagaaggctggagaaggacatgagatcagggcctgccccctggggatcacagcctcacccctgcccctgtgggactcatccttgcccaggtgagggaaggagacaggatgaggtctcgaccctgtcccctagggactgtcctagccaggtctcctgggaaagggagatgtcaggatgttgctccatcctttgtcttggaaccaccagtctagtccgtcctggcacagaagaggagtcaagtaatggaggtcccagccctgggggtttaagctctgccccttccccatgaaccctgccctgctctgcccaggcaaggaacagaagtgaggatgagacccagccccttcccctgggaactctcctggccttctaggaatggaggagccaggccccaccccttccctataggaacagcccagcacaggtatttcaggtgtgaaagaatcagtaggaccaggccaccgctagtgcttgtggagatcacagccccacccttgtccctcagcaacatcccatctaagcattccacactgcagggaggagtggtacttaagctcccctgccttaacctgggaccaacctgacctaacctaggagggctctgagccaaccttgctcttggggaaggggacagattatgaaatttcatggatgaattttccagacctatatctggagtgagaggcccccacccttgggcagagtcctgccttcttccttgaggggcagtttgggaaggtgatgggtattagtgggggactgagttcaggttaccagaaccagtacctcagtattctttttcaacatgtagggcaagaggatgaaggaaggggctatcctgggacctccccagcccaggaaaaactggaagccttcccccagcaaggcagaagcttggaggagggttgtaaaagcatattgtaccccctcatttgtttatctgatttttttattgctccgcatactgagaatctaggccaccccaacctctgttccccacccagttcttcatttggaggaatcaccccatttcagagttatcaagagacactcccccctccattcccacccctcatacctacacccaaggttgtcagctttggattgctggggccaggccccatggagggtatactgaggggtctataggtttgtgattaaaataataaaagctaggcgtgtttgatgcgcttttaactttgaaaaaaaaaaaaaaaaaaaaaaaaaaaaaaaaaaaaaa

SEQ ID NO: 1061 - DNA, 1648 bp, Homo sapiens
cacttccagtcgccaccacctgtgcctggggaggtgttgaagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccgtccccattccatcacctggacttcagccacagcctgagctttgggggcagggaggacgagggtcccccgggctaccccgaacccctggcaccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgtaaaaaaaaaaaaaaaaaaaaaaa

SEQ ID NO: 1062 - DNA, 6631 bp, Homo sapiens
atcgtttactttggttgtcccttctggcatggtgcatatgttatgggaagagggattataatttggtgctgtttgtagagatgacaacactgataaaatccactcattgctggtcccagcacacctggaaagttctgcaaggcctcagctacagaaagcccagagacagaaagtaaactctttcatgacccttgatcatcagatcatcaatccaactcttaaatggtcacaacctgcagtgccaagtggtgggcctcttgtgcagcatgcacacacaactctggacagtgatgctggcctcacagaaaacccactcaccaagttactagctattgggaaagaagatgacaatgcacaatggcatatggaggacgttattgaggatataatcggtatggaatcaagttttaaagaggaaggagcagactctcctctgctaatgcaaagaacattatctggaagtattttggatgtgtatagcggtgaacaaggaatttcaccaattaacatggggcttacaagtgcttcttgtccaagtagtctaccaatgaaaagagaaattacagaaactgacactagagctttagcaaaagagagacaaaaaaaggacaaccacaacctcattgaaagaagaagaaggtataatattaattaccgaatcaaggagcttggcactcttattccaaagtctaatgatcctgatatgcgctggaacaaaggaaccattctaaaagcatcagtggagtacatcaagtggctacaaaaagaacaacagagagcccgagaattggaacacagacagaagaaattagagcaggctaacaggcgacttctacttcggattcaggaactagaaattcaggctcgtactcatggtctgccaaccctggcttcacttggcacggttgatttaggtgctcatgtcaccaaacagcagagccatcctgagcagaattcagtagactattgccaacaactgactgtgtctcaggggccaagccctgagctctgtgatcaagctatagccttttctgatcctttgtcatacttcacagatttatcatttagtgctgcattgaaagaggaacaaagattggatggcatgctattggatgacacaatctctccatttggaacagatcctctgctatctgccacttcccctgcagtttccaaagaaagcagtaggagaagtagctttagctcagatgatggtgatgaattataagaaataaacagacccaattcatcaactggaaagcaattctatgctggtgctatgcaattatgctctgtgtttcatatgttgctttggcttattttttttcttaaaggaatgtgttgttcatgaaaaactgatagaagcaacagaagaattcgcaggaagaaaaatcatagtgttaatgaattattgagggcgaaaaaaaggtgttttcttctttgactacggagtccaaatccacttaaattctgttttcctgaaaagaggtacagcataagaaatagctctttattgatgttttaaaagcagcaacttggtggtgtactactggaactaatgactgcaaagtgttaaacgactgaaatatacaaacagtctcttagttactcatttccatcttctcttcaactttcacatcagtcttccggaatcaagatcaacatatcaggtggtcattgcctttctccattgtctagtagacatgtctaaagttcaaactttataggataaataaatgtataatagattatctgtcacttgtggttgaaaggcaaatctacaataaatgtgagaattttccacaataaaatatggataacttataaaaacattggttactaaaattagatcctcattttattgtagttggttcaattacactaattctaaaagcatccatgcatatttatatctccagtctctgttcaggaaaaggaacatattgaatattttcctcaggaatatggaccagaattgtatcccttcacacaaacatacacatacacatatgcacatcattcaggtagtatatgttcttttgttttcttcatgcttctgactgcatcagaatcacattccaaattctcttttcttatgaagaagagatgtcagatcatcaattttagtaaataaaatataaaatgtccccctgcaaggacagttttcaggtacttaaaacttttcatcagtattggacagaaatcaattagttgttgatttggtttttctccaaatggataaaatattgaaaattgaattgccaattgacaaaataattattacaacaaactatttcttattattttcagttctgagaggaacgtaaggttctatttctataaacacttagagtgtcctatgatctttggttgcactgttagcatttattataagcacttataactatgatgcttcatttagatttttatctcttgcgcttgttttaggttaggaaattaagttaccaagcacgttgctctgtgctggacctccaagagtgatcatccgatcaatgagtattcatggaggcatactcagaactgcagtgagtcctgagaaaatgtagaagagttgaaaaagatatggtcttactcctaaggtagttaatgagaatgcatgaaaaacaaaaacaaaagatagaagacatatagaataaaaaatctaagcataaactgtaaatacagaaggtcagagaaaatgaaaatgactgacaaactttatgggaacagcagaatttgacttctctttgaaaggcattaattgagtgaaagtgagggcatataaaggaataataccaaccaaatgataaaagtgagaataataggggaagtatctttataggactttaattagaaagatctggatgccctagaagatgtctgttggggagttctgaagcataagactgacaacaggttgtgaaggcccttagaaaactatggtgaaataatatagtattaatataatagaaacaaatctttttagtagcagggaggatgctaaaaactaaaatatatattactaatgagtgagatgtaatctttcatgaatattaagctttgggataaattttgaaaggatcttttagttgcttctcacatggaaaatatgtcactatgaaatgtgagaccctaatgctgataaaagtagaaaaatagtaaatcattatggtataataattatctcaggcttagcttgtatcatttgctcagaatttggagaattaaaataattttattgtttgacatggaaaaataattactaacttctgggtacagtcattaaagcctgatagataaattcatctgaaatatgccatgtgaaacagctattagatacatcttctcaataattttcaagacgatattacatacttttaattttataacaaaattccacttcattatctgagttgataatttgattaaatgttaaaaattatagataaggaatatattttggagttcatagaaaacacaccactttattagatagagactggcttcagttctcattttatctgctcttctcatttcttcatattttgagtagacttgcactgatgatgtcattactcagtcattattttctgttctgttaaggtacaactactgggccttgaaatctatccttcacaatcttggctgagataaggacttggcacaggatgatagagcctggacacaagagatctggagagggaactgctatttgctgctacattcagattatgagatgtcagggaactgtaaaaagggtaatgaatttttaaagagagtaaagagttatgctgtgtcccggtcaactgaaatacattaaaaattaattagatggtagttcttaactttttaaggcagataccttgagaatctagtgagttatagaccctctccctagaaaagtatagaactgtttatatggacaataattcacatgcattcagagatcttagggatctcctgaatgttttcttggatcccaagtgaaaaattcctgaatcaggtctcttaggtgtgcggttaatgtcatgtataacaatggggggacccttacttatctaaatataattatcccaatcctaataatgatgaggttgcataggaaagtaatagtgtaccaaactttagattattcactaaaaaagttgttcatttatgaagtagtcgtttatcaaacatgtcctccccactcagcaaactatgccttctatttattatatatgggtcagtttcactataattactgagtgttataaacatctgaccataacattttgaaatgatgcaaataaatttccaaacaaaaatagtgtgaatttaaaagcaaattatttgagtatctaagaaacaagatagacttctagaaaaatttgactctctagaatatttcttgcagaaatgagatttttcataatagtaaaagaggcatatgtttatcaaacaatgctgtcacaaaaagcatcaactgtaatgggactattaatgcataattattgatttattcattcaattaatatacaattatcccttttcatttaaagatttaattcataattacaattataataaaacttcctttaaagtaagatacaataattttattgtttttcattcttttttcaacaaaatatcccatccaatcattttttatattattaaatattggctgctttttcttggattcacattaaacagccctttccaacttccaattgtcttaaaataatgatgacctcctgtgagtagatacagctctttacaatttttttctttagtgccttttcttcttgaatttttcctatatcaaatggagaatatatgtacagatggtattttctcagtttataggcatatcagtgaccatggctttctttatataggtttttaaaaaagccctaaataataaatagccagatgagctggggacattgagaaatagccttcctcttcctttttcaactcatttttttcccacctacatgactgtaaatcaaatatttaatagctcttacttaaaaaaacagatacaaagaatgtcttgatttggtgtgctcatttaccataatgtcatgaggggaattagatttcacaactttaaaaggaatatatttttattttattttgaaaaactgagtcatataggaattttcttatacttcaaggcatcatggaaacacttttttcctgtttggatattgtggaatttaaacgttcaaataaataaatggcataactaagtgttccaaatttttttacaatgtctttgaccctattcaaacactttaggtatttactgaccgtctgatgtgtaagatgtggaataaaactggaatcaattaattatttcactgtgttatcagcgcaagatcaaccatctgggtttcttaaagacacccgaaggattgaattttgtttcagtattgataatggcatagtctctatgtgctacatggaattacatcatttatccctccagtgccctatatgttgataagtatgtcagtttgacttagtatacatatatacagagatttcattacatttacctaataaatacaaaatacatttcgagtgttactgatctcctatgttacatgagcctcctgtaatcattgtgcattgatgttccaatgttttattgtttgtatgaattttaatttgaaaacaaggaaacaatccaaaagcagaaaaaatagcttttcttaaaattttcagtgctacattttccctctgaggtccatagagatttgaatgtataggagattatccgaaaacagctattttgattaaaaaatatatctcccaggattcaaccaacttaatgatgaagtactattgtctactgctttatacataaaagggaactttttatctgcttgtaaagggatttttatgtgtatttctgcataatcagatgacttctattgtgttttctactgatgaaattctctgtaaaatgtctttttcttacattatccaacaggcataaagaataacagtaaagacttttgtgtttgtaatactacctcttttatccctgcactactgttttattgcaaaaattctatattgtcactgtattttttccatagaatataaattttgttcttgtgctaaagctggtagtttatgtagcagacaaaatatacaaataaaagaagagactgattttgctgaaagaattatatataatcaagaagttacatattgttctttaaatatgatactgaattttaaaagcaaacgaaattcaagaatcttatctaacagcatagcagttgcttatggcatacaaggctaaaattaattcagctatttaatcttaataattattatgtagttaaaaatctttgactttaatagtgttttacatatacaaatagctgaagtaacattcctataattttaatctgacattggttagatcaagaaaacattgttaataagactgtagaatttgtaattattgctatttttcatttttaataacaaagtaatgtgtcttattttctaagaaaatggagaactttggtgtactttaatacatacaaaaatctttgtaaaaataccttaaaatgtaccaatattttctttgcatatattaaatgaaagactataattatgaaatgtt

SEQ ID NO: 1063 - DNA, 1812 bp, Homo sapiens
ggagaataaaataatcaggaggctgggtttgtgcttggctccaagcatgccctgctctctgacctggagactaccacctcgcacatgccaaggtcaggggctcccaaagagcgccctgcggagcctctcacccctcccccatcctatggccaccagccacagacagggtctggggagtcttcaggagcctcgggggacaaggaccacctgtacagcacggtatgcaagcctcggtccccaaagcctgcagccccggcggcccctccattctcctcttccagcggtgtcttgggtaccgggctctgtgagctagatcggttgcttcaggaacttaatgccactcagttcaacatcacagatgaaatcatgtctcagttcccatctagcaaggtggcttcaggagagcagaaggaggaccagtctgaagataagaaaagacccagcctcccttccagcccgtctcctggcctcccaaaggcttctgccacctcagccactctggagctggatagactgatggcctcactctctgacttccgcgttcaaaaccatcttccagcctctgggccaactcagccaccggtggtgagctccacaaatgagggctccccatccccaccagagccgactggcaagggcagcctagacaccatgctggggctgctgcagtccgacctcagccgccggggtgttcccacccaggccaaaggcctctgtggctcctgcaataaacctattgctgggcaagtggtgacggctctgggccgcgcctggcaccccgagcacttcgtttgcggaggctgttccaccgccctgggaggcagcagcttcttcgagaaggatggagcccccttctgccccgagtgctactttgagcgcttctcgccaagatgtggcttctgcaaccagcccatccgacacaagatggtgaccgccttgggcactcactggcacccagagcatttctgctgcgtcagttgcggggagcccttcggagatgagggtttccacgagcgcgagggccgcccctactgccgccgggacttcctgcagctgttcgccccgcgctgccagggctgccagggccccatcctggataactacatctcggcgctcagcgcgctctggcacccggactgtttcgtctgcagggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacacagacaagaactcccgtgcgggcctccactctattcccacccttgagggagcccccttactgggggagggtccttgcaattccagcgaatcggaggccaggccaggacgtccttgctccctgcaccctcactgttctgtgcactttttctacctacataaacacacgcattccacctctcaaaaaaaaa

SEQ ID NO: 1064 - DNA, 1618 bp, Homo sapiens
tctgacagcgccgaggtgcgccgagcaggagcagggaacaaaggagcggagaggggaggggagagagttgggcgagggagagcccccggccggctgccagaagatcccggcgggaggaagcccaagtgtcacttgaattccacccaaggagcgggcgcctgggatcagagcgtcctgtttagcaataacggctggagcacgtcctacaagttacgggagagtcggctgtgaaggagacgttcgcttatcccctgtgtccccgctcctggcccctccagacccccgccttgcctcgcgctgggaggggagatccagaatgaaaggcaagaaaggtattgttgcagcatctggcagtgagactgaggatgaggacagcatggacattcccttggacctttcttcatccgctggctcaggcaagagaaggagaaggggcaacctacccaaggagtctgtgcagattcttcgggattggctgtatgagcaccgttacaatgcctatccttcagagcaagaaaaagcgttgctgtcccagcaaacacacctgtctacgctacaggtctgtaactggttcatcaacgcccgccgcaggctcctccctgacatgctgagaaaggatggcaaagatccaaatcagttcacaatttcccgccgtggggccaagatttctgaaacgagctctgtggagtccgtgatgggcatcaaaaacttcatgccagctctagaggagaccccatttcattcctgtacagctgggccaaacccaaccctagggaggccactgtctcctaagccgtcatccccgggatcagttttggctcgtccatcagtgatctgccataccactgtgactgcattgaaagatgtccctttctctctctgccagtcggtcggtgtgggacaaaacacagatatacagcagatagcggccaaaaacttcacagacacctctctcatgtacccagaggacacttgtaaatctggaccaagtacgaatacacagagtggtcttttcaacactcctccccctactccaccggacctcaaccaggacttcagtggatttcagcttctagtggatgttgcactcaaacgggctgcagagatggagcttcaggcaaaacttacagcttaacccattttcaagcaaaacagttctcagaaatgtcatgattgccggggtgaaggcaagagatgaattgcattattttatatattttttattaatatttgcacatgggattgctaaaacagcttcctgttactgagatgtcttcaatggaatacagtcattccaagaactataaacttaaagctactgtagaaacaaagggttttcttttttaaatgtttcttggtagattattcataatgtgagatggttcccaatatcatgtgattttttttttcctccccttccctttttttgttattttttcagactgtgcaatacttagagaacctatagcatcttctcattcccatgtggaacaggatgcccacatactgtctaattaataaattttccattttttttcaaacaagtatgaatctagttggttgatgccttttttttcatgacataataaagtattttctttaaaaaaaaaaaaaaaaa

SEQ ID NO: 1065 - DNA, 1990 bp, Homo sapiens
aaggaacggacagcccgacctcttaggcgccgggaccctcaggctcagatcagtggccgaaggccccagagtttgcaaactcagctctggagttcagcagcaacagcagcaggaaaaacctgcccctgctcccccctcccgccacctcccctctcctcttctcccctcacccagcaggcacccccggttcccgccaggccctcctgccatgtcggacccagacgtccccaggggctcggatgtccccgccatgtggcccccttgttccaggggtgcctgagccccttcaaggagccccaacccacccccaaccttggcccagccctgagccccagggaccatgagcgggggcaagaagaagagtagtttccaaatcaccagcgtcaccacggactatgagggccctgggagcccaggggcttcggatccccctaccccacagcccccaaccgggcccccgccccgcctgcccaatggggagcccagccccgatccggggggcaagggcaccccccggaatggctccccaccacctggggccccttcctcccgtttccgggtggtgaagctgccccacggcctgggagagccttatcgccgcggtcgctggacgtgtgtggatgtttatgagcgagacctggagccccacagcttcggcggactcctggagggaattcgaggggcctcagggggcgccgggggcagatctttggattccaggttggagctggccagcctcggcctgggcgcccccaccccaccgtcaggcctgtctcagggccccacctcctggctccgtccaccccccacctctcctggacctcaggcccgctccttcactgggggactgggccagctggtggtgcccagcaaagccaaggcagagaaacccccactgtcggcctcctcaccccagcagcgccccccagagcctgagaccggtgagagtgcgggcacatcccgggctgccacgcccctgccctctctgagggtggaagcggaggctgggggctcaggggccaggacccctccactgtcccggaggaaagctgtagacatgcggctgcggatggagttgggtgctccagaagagatggggcaggtgcccccacttgactctcgccccagctccccagccctctacttcacccacgatgccagcctggttcacaaatctccagaccccttcggagcagtagcagctcagaagttcagcctggcccactccatgttggccatcagtggtcacctagacagcgacgatgatagtggctccggaagcctggttggcattgacaacaaaatcgagcaagccatggacttggtgaagtcccacctcatgtttgcggtccgggaggaggtggaggtgctgaaggagcagatccgggaattggcggagcggaaacgtgcgctggagcaggagaatgggctgctgcgcgccctggccagcccggagcagctggctcagctgccctcctcgggggtcccacggcttgggccccctgcgcccaatgggccctccgtctgagcctcccttcccttacaatgtgcctttggggctgcccggccttgcgtcagccgcctgccccctcttcctatgcagctttaatgtccccgtgtccccggggtgggagttcaaggctcagtaatggcctggtcccccggcccctgccccatctcctcatcatccccagccttgatggaggagggagggcttcaggacggggcgtcagagggagccccctctgggagggaaccaacccccaccctccctcctgggaccccccagcagtagacggcttgggggagtcggaggctccccggcagacaccccacccccatcttgttcccttgaggtgcctcctctcctctgcccaggggagggagtgtggacagtatctggaagttctgggattcaggttgttattaaaataataataataattaaaaactctgaagaaacttgaaaaaaaaaaaaaaaaaaaaaaaa

SEQ ID NO: 1066 - DNA, 2474 bp, Homo sapiens
cgcctctgccggaggagccgcggggccgccacactcgccccccgccccccccgcgctcactcgcactcacacccgggcgcaggaggcgggcggcccgggccccaccggccccccatggacgcccccagcacggggcgctgagacccccgcgtcgctgcccagcccggtccggcgcgccacgccgagggatctctggacaggacaagactccgaagctactcccccagcacacagcccgggacccacaaacccagcttgcccccagccctcccacctgccactccctggcccctcccaccgcccgccccccttggggcgcagggcatggtgtgaaaggccaagtgctgaggcgggtatcatgggtgctgtgccctagggcctgggtggcagggggtgggtggcctgtgggtgtgccgggggggccagtgtgcccaccccagtctcttggcgtgctggagggcatcctggatggaattgaagtgaatggaacagaagccaagcaaggtggagtgtgggtcagacccagaggagaacagtgccaggtcaccagatggaaagcgaaaaagaaagaacggccaatgttccctgaaaaccagcatgtcagggtatatccctagttacctggacaaagacgagcagtgtgtcgtgtgtggggacaaggcaactggttatcactaccgctgtatcacttgtgagggctgcaagggcttctttcgccgcacaatccagaagaacctccatcccacctattcctgcaaatatgacagctgctgtgtcattgacaagatcacccgcaatcagtgccagctgtgccgcttcaagaagtgcatcgccgtgggcatggccatggacttggttctagatgactcgaagcgggtggccaagcgtaagctgattgagcagaaccgggagcggcggcggaaggaggagatgatccgatcactgcagcagcgaccagagcccactcctgaagagtgggatctgatccacattgccacagaggcccatcgcagcaccaatgcccagggcagccattggaaacagaggcggaaattcctgcccgatgacattggccagtcacccattgtctccatgccggacggagacaaggtggacctggaagccttcagcgagtttaccaagatcatcaccccggccatcacccgtgtggtggactttgccaaaaaactgcccatgttctccgagctgccttgcgaagaccagatcatcctcctgaaggggtgctgcatggagatcatgtccctgcgggcggctgtccgctacgaccctgagagcgacaccctgacgctgagtggggagatggctgtcaagcgggagcagctcaagaatggcggcctgggcgtagtctccgacgccatctttgaactgggcaagtcactctctgcctttaacctggatgacacggaagtggctctgctgcaggctgtgctgctaatgtcaacagaccgctcgggcctgctgtgtgtggacaagatcgagaagagtcaggaggcgtacctgctggcgttcgagcactacgtcaaccaccgcaaacacaacattccgcacttctggcccaagctgctgatgaaggagagagaagtgcagagttcgattctgtacaagggggcagcggcagaaggccggccgggcgggtcactgggcgtccacccggaaggacagcagcttctcggaatgcatgttgttcagggtccgcaggtccggcagcttgagcagcagcttggtgaagcgggaagtctccaagggccggttcttcagcaccagagcccgaagagcccgcagcagcgtctcctggagctgctccaccgaagcggaattctccatgcccgagcggtctgtggggaagacgacagcagtgaggcggactccccgagctcctctgaggaggaaccggaggtctgcgaggacctggcaggcaatgcagcctctccctgaagccccccagaaggccgatggggaaggagaaggagtgccataccttctcccaggcctctgccccaagagcaggaggtgcctgaaagctgggagcgtgggctcagcagggctggtcacctcccatcccgtaagaccaccttcccttcctcagcaggccaaacatggccagactcccttgctttttgctgtgtagttccctctgcctgggatgcccttccccctttctctgcctggcaacatcttacttgtcctttgaggccccaactcaagtgtcacctccttccccagctcccccaggcagaaatagttgtctgtgcttccttggttcatgcttctactgtgacacttatctcactgttttataattagtcgggcatgagtctgtttcccaagctagactgtgtctgaatcatgtctgtatccccagtgcccggtgcagggcctggcatagagtaggtactccataaaaggtgtgttgaattgaaaaaaaaaaaaaaaaaaaaaaaaaaaaaaaaaaa

SEQ ID NO: 1067 - DNA, 3735 bp, Homo sapiens
ctccctcgagtccctgagtctctgtagtgcctcagctcctggatgtcctcccttaaaggagaagaacaatgcgggccgactagacgagtcccttagtttcctcgccggcgcagacaaatacggtttcagtccaaggaactaccattcccagaagacagcggggcgttccttgctgcatttctattggttggcgtttgttactcccagccaatagaaagtgagcttcttgacaagtgccaaaatggcgatgcctaccacctagaactggattgtgcgctggccgccaccgctgccacctgctcagagtgaaataatgaaggtggtcaacctgaagcaagccattttgcaagcctggaaggagcgctggagtgactaccaatgggcaatcaacatgaagaaattctttcctaaaggagccacctgggatattctcaacctggcagatgcgttactagagcaggccatgattggaccatcccccaatcctctcatcttgtcctacctgaagtatgccattagttcccagatggtgtcctactcttctgtcctcacagccatcagtaagtttgatgacttttctcgggacctgtgtgtccaggcattgctggacatcatggacatgttttgtgaccgtctgagctgtcacggcaaagcagaggaatgcatcggactgtgccgagcccttcttagcgccctccactggctgctgcgctgcacggcagcctctgcagagcggctgcgggaggggctggaggccggcactccagccgctggggagaagcagcttgccatgtgccttcagcgcctggagaaaaccctcagcagcaccaagaaccgggccctgctgcacatcgccaaactagaggaggcctcttcttggactgccatcgagcattctctcttgaaacttggagagatcctggccaatctcagcaacccgcagctccggagtcaggccgagcagtgtggcaccctcattaggagcatccccacgatgctgtctgtgcatgcggagcagatgcacaagaccggcttccccactgtccacgccgtgatcctgctcgagggcaccatgaacctgacaggcgagacgcagtccctggtggagcagctgacgatggtgaagcgcatgcagcatatccccaccccactttttgtcctggagatctggaaagcttgcttcgtggggctcattgagtctcccgagggtacggaggagctcaagtggacagctttcactttcctcaagattccacaggttttggtgaagttgaagaagtactctcatggagacaaggacttcactgaggatgtcaactgtgcttttgagttcctgctgaagctcacccccttgttggacaaagctgaccagcgctgcaactgtgactgtacaaacttcctgctccaagaatgtggcaagcaggggcttctgtctgaggccagcgtcaacaaccttatggctaagcgcaaagcggaccgagagcacgcaccccagcagaaatcgggagagaatgccaacatccagcccaacatccagctgatcctccgggcggagcccactgtcacaaacatcctcaagacgatggatgcagaccactctaagtcaccggagggactgctgggagtcctgggccacatgctgtccgggaagagtctggacttgctgctggctgccgccgccgccactggaaagctgaaatccttcgcccggaaattcatcaatttgaatgaattcacaacctatggcagcgaagaaagcaccaaaccggcctccgtccgggccctgctgtttgacatctccttcctcatgctgtgccatgtggcccagacctatggttcagaggtgattctgtccgagtcgcgcacaggagctgaggtgcccttcttcgagacctggatgcagacctgcatgcctgaggagggcaagatcctgaaccctgaccacccctgcttccgccccgactccaccaaagtggagtccctggtggccctgctcaacaactcctcggagatgaagctagtgcagatgaagtggcatgaggcctgtctcagcatctcagccgccatcttggaaatcctcaatgcctgggagaatggggtcctggccttcgagtccatccagaaaatcactgataacatcaaagggaaggtatgcagtctggcggtgtgtgctgtggcttggcttgtggcccacgtccggatgctggggctggatgagcgtgagaagtcgctgcagatgatccgccagctggcagggccactgtttagtgagaacaccctgcagttctacaatgagagggtggtgatcatgaactcgatcctggagcgcatgtgtgccgacgtgctgcagcagacagccacgcagatcaagtttccctccaccggggtggacacaatgccctactggaacctgctgccccccaagcggcccatcaaagaggtgctgacggacatttttgccaaggtgctggagaagggctgggtggacagccgctccatccacatctttgacaccctgctgcacatgggcggcgtctactggttctgcaacaacctgattaaggagctgctgaaggagacgcggaaggagcacacgctgcgggcagtggagctgctctactccatcttctgcctggacatgcagcaagtgaccctggtcctgctgggccacatcctacctggcctgctcactgactcctccaagtggcacagcctcatggaccccccgggcactgctcttgccaagctggccgtgtggtgtgccctcagttcctactcctcccacaagggacaggcgtccacccgccagaagaagagacaccgcgaagacattgaggattatatcagcctcttccccctggacgatgtgcagccttcgaagttgatgcgactgctgagctctaatgaggacgatgccaacatcctttcgagccccacagaccgatccatgagcagctccctctcagcctctcagctccacacggtcaacatgcgggaccctctgaaccgagtcctggccaacctgttcctgctcatctcctccatcctggggtctcgcaccgctggcccccacacccagttcgtgcagtggttcatggaggagtgtgtggactgcctggagcagggtggccgtggcagcgtcctgcagttcatgcccttcaccaccgtgtcggaactggtgaaggtgtcagccatgtccagccccaaggtggttctggccatcacggacctcagcctgcccctgggccgccaggtggctgctaaagccattgctgcactctgaggggcttggcatggccgcagtgggggctggggactggcgcagccccaggcgcctccaagggaagcagtgaggaaagatgaggcatcgtgcctcacatccgctccacatggtgcaagagcctctagcggcttccagttccccgctcctgactcctgacctccaggatgtctcccggtttcttctttcaaaatttcctctccatctgctggcacctgaggagagtgagcagcctggaccacaagcccagtggtcacccctgtgtgcgcccgccccagcccaggagtagtcttacctctgaggaactttctagatgcaaagtgtgtatgtgtgtgtgtgtgtgtgtgtgtgtgtgtttgtgtgtattttgtaatatgtgagggaaatctaccttcgttcatgtataaataaagctcctcgtggctccctttgtgaaaaaaaaaaaaaaaaaaaaa

SEQ ID NO: 1068 - DNA, 7416 bp, Homo sapiens
cggcggggattaactttgcatgaataatgtgagtgcgcttggaaaagagacctcctgctccgcgggctcggggcaagagcccgcaggctaccttccccgggcaggggcgctcaacccaaccggctccagggcactggtaatttggctagaggaccgcgcggaggcagcgggatctgcgatttccttctggttggctgtcctgcgtgggtgccaagttccacacatgatttaatgaataagaaggagatgtcagtgaaaaaagggatccagaatgattactaacctatgactcccaacagtatgacagaaaatggccttacagcctgggacaaaccgaagcactgtccagaccgagaacacgactggaagctagtaggaatgtctgaagcctgcctacataggaagagccattcagagaggcgcagcacgttgaaaaatgaacagtcgtcgccacatctcatccagaccacttggactagctcaatattccatctggaccatgatgatgtgaacgaccagagtgtctcaagtgcccagaccttccaaacggaggagaagaaatgtaaagggtacatccccagttacttagacaaggacgagctctgtgtagtgtgtggtgacaaagccaccgggtatcactaccgctgtatcacgtgtgaaggctgcaagggtttctttagaagaaccattcagaaaaatctccatccatcctattcctgtaaatatgaaggaaaatgtgtcatagacaaagtcacgcgaaatcagtgccaggaatgtcgctttaagaaatgcatctatgttggcatggcaacagatttggtgctggatgacagcaagaggctggccaagaggaagctgatagaggagaaccgggagaaaagacggcgggaagagctgcagaagtccatcgggcacaagccagagcccacagacgaggaatgggagctcatcaaaactgtcaccgaagcccatgtggcgaccaacgcccaaggcagccactggaagcaaaaacggaaattcctgccagaagacattggacaagcaccaatagtcaatgccccagaaggtggaaaggttgacttggaagccttcagccattttacaaaaatcatcacaccagcaattaccagagtggtggattttgccaaaaagttgcctatgttttgtgagctgccatgtgaagaccagatcatcctcctcaaaggctgctgcatggagatcatgtcccttcgcgctgctgtgcgctatgacccagaaagtgagactttaaccttgaatggggaaatggcagtgacacggggccagctgaaaaatgggggtcttggggtggtgtcagacgccatctttgacctgggcatgtctctgtcttctttcaacctggatgacactgaagtagccctccttcaggccgtcctgctgatgtcttcagatcgcccggggcttgcctgtgttgagagaatagaaaagtaccaagatagtttcctgctggcctttgaacactatatcaattaccgaaaacaccacgtgacacacttttggccaaaactcctgatgaaggtgacagatctgcggatgataggagcctgccatgccagccgcttcctgcacatgaaggtggaatgccccacagaactcttcccccctttgttcttggaagtgttcgaggattagactgactggattcattctcataattcctacagcactactgggtgtcatttcattccattgcctagctcttttttgtttgtttctttgtgttgggagggattatttgggagggaaaagggaagtagtccttggcatagacatggatgaaattgccccttgaatgcgggtacttgaaactattgcatttcgttctccggtcctgtgatgtgaatgctctgaaggttttatggttgtggaggtggggtgggggacaatcattaactcaccagcaccaagcatcaccagctcccacccgtccctggtccaagacttgagtcagcaaaatggcgccacaggacactaaagaagccttaaaaccaagataatacgaccacctccacccaatcctgatgttcgcagggctgaagttaacagagcacagaccacctttagttagatgtggctttcagccttttagggaaagactcgaacaaattttcatctattcaagagcatgctgtttgcagcactctttatggtctcctaggagcataacttggaatgtacaggaatatttgtgtcctaaaaaaatcagctgcccttccaatatcatttttataacgttatggtttaattcaagttatacaaaggtgtgactcaaggatgtgcaggtattgactgatggaggccaacaaggaaaatattttttttcagtgagcccagagaaattagaaatcttcaccaatgtcagtgactgcatggtttccaaaaattcacatagtattacctcacagtaggaaggcttctttcccatttaggctcagagaacacttttacagaaatcaaacctatttacagggtggcaccccttttctgtggcatctgatctgtcatctcccaagctcctgaagttctttatccaggttgtatctttgctgagctgacaacagatttctctatggatcaaatattctaatcaaggaaagatacggtgaaacttcagtcttcttctggagaaatgctgaggcgagattagtgcagctacattctgagttgaaggaaatgcagtgttctgagggcccctttgtgtcctgatggctggaggacgcttcctcctggttagatcctcaagctccttgcctcattgacaaatgtctcctagtcccctttttccctctgactctgaggaactaaatagcttgactatctctaaacagagactggccctgccactgaccctcctgtccctctcatagcataccctgacagatactcaatagaaaacacctgcagaccatgtgcacacttaactttcctgcccaacctgcctccccaacggcccatgctagaatagcttgtgcccagaaaacaaacagtgacacttcatctcttcagcgtcagaaaatgggcatagaatgtacccatgcaattgaatgtatctcattctccactggcatagtagatataaactattcctttgcctaccttttactgccttatcctggaaatattggggaaaataagccatatcagtgagatttacctaaaaacaaaggaaggaaagtcactatggaaaccaagtagatgctttttgtaagtttggtggagcataactggcccagaagtctgggtgcctgagttctagttcgtgctctgtcaactggtagatttgtaattctaggtcttggttttcttacctggtgaataagtcatgatctctaaaacccttcctgcccttaatattgtctgaatttcaaggggaaaaaaaaaatctggttcctttaattatttttttttaacacttaaattcctaactttattagacaagaagtatggcccacttaacagttaaggaacgtaaatttgttattggctcgaaataataatttgacacaatactagtcaaccatttagaggccttggaaaaagaagaggaacagcactgaaaattccaagtatgattggaaattatctgggagcggggaattaaatattcaatgcatgaaagcaattgtactggcttctgggaaaaaggaaacaagaacattgctatggaacttgttacccagagaaaggaagtgaaaagatttacaattataagcacgaaattcattggcagattacctgctttatctacagacagattgttttggggtttggttttgtctaggcagcctctggccaggctccttaattgcttgctctgctaatatttcagcttcctctcttgactccttgaggaaccaaccgctctttggaagacaaacacttagccacctctgtgctccagggtaaccctgagaagctctgctgtctggggcaagctttctttccaaagggaatgagaggaaggcaagcaggcagggtcctgcagcgtcaggccttctggggaaagtttcctcattttgtttgacagggtcctcagtacatcagacacccagatttgaatataagttcagagcctgatctcaagctaaatcagaatgctttggggactaaccatgatcgagaattggccaaatagtatggcatataaacagccatccagccagccgcaagtaaaggaacgtttgatccttggcaccttaaatgattgattgccttcaataggcaaactgctggtctggaaatctcgttgaaggctgaatacttcatgcggagtaggacaagccttagcccaccttcaggttgaaaggaaaggccataggactcaaaagataatgactctgaaactaaactccttccttctgaagctgacagaggtacttagtgcatctcaagactccatctcataaaactcatttgtgagggatttgctctagatttttctaaacattttttcatctattgtccagacttgcaaatccagtgtggacctgatggagatacccttcacacctgcgctcccaccccctcggcagggagacgtctcagtagaggagaacacacccattatgctgggatttgtatttataaatcacttcccttttagggatgagcggtgtggggcgtgtgtgcgtgtgagtgtatgcgcgtgcgtgtgtgaccctcaagtgtactttgctcaatttagacgtgcagtatttccagaaacaatgaaaaaagtaagatgttttcttctttatgattctgctcaaaacaccacgtgccgcctcagagctttttctagagcctcggtcctcaatgacgcgcttgacctgttgatgcctcagcccagcgaagcccctcacctgtgccccgggcgacagctcttcagtgtgcagtgcaggcctggggtggactgccaggccttcgctctgtgccagcaacgccgttcttgttgctcctccatgaacaggggtacaagccctggcccctcctcgacactaagccccccacagactcagcctccaaggaaccgctgagcacccttgaagcatgtcattgtcagtgatacctttttattctatggaactctaacctattcgtgtcatattgaccttttgctgcatgagtcataaattatgaaatcagtcttacagtttttgaaatgtagccagcatttgtaaggctaaacctttttcatgaactgaatttaagtgaataaccaagccacagttcctcctcaaatggagagtgatgatcgacatttgaatctctttgccctttccaacggctatggcatcaggttctaaaataagctcgtaatttttcctgttattttaataatatggaaatattagcatagtgtttcttttgatagtgatagactataatccatatttaaattttatagagaagaaattttattgtactgtgatgtagatatttattatccaggtaaggatttgcccggtgtgtattttttacaattgagacattttactttaatctttaaaaaaaatgcattaaaaacacactcaaaaaaaaaaaaaaaaaaaaaaaaaaaaaaccagactgggggaaaaaaggtttggccttatcacagaatttttactgtgctgtataaatgtttgcaaatgcgaaaagtgtgcatttatagtgtgtttccacattaattaatgccgccttcaagagcaatattgtgcaggtaaaacgctgtttgtggctttctgttgcacagttaaagctgacccaccctatgcacaagacaatcaaatataaatctgtcctcctcaggatgcagataatactcatgtaaattatggagcacaatgtaagacaaaaggagacactttacatatgtattgttgatacagaaattatcagggcatgaatgagctgatgtgacattatgccacttctttcttttggttctcccttattaacttggcatttttaatttgaccatagagccaaattagttctccatgctttcttcgtagaaaatccttttttttcccataatgttttcatgccctgagaatcagaaaaatactacagaatagaaaaagatttacagtcattggaagatttgtgttttgcaaacagtgttaagtgatattgctagatggtgatatttttttcagcctaaaactctgttgaaatctgtgatcaaaatgttttaaactatccaaaaaaaatttgtatatttgggaaaaatggatttttacatagcttttgtatgcagatataaaactgtaattatgaatatagtgggcgtagataaactcataagcttaaattctaaaaaagaaaaagcttataacagatatattttcctgtctctttctttaaatattattattttctacataggcaaagagttgcctgctcttctcacttcagctgctgccaaaagacggaaccacggatgtaaggacatttatttcataaataaacatctactagaataagcaaatttacttgagaagaaactatggagggagagaagaaactaagtaaaatgctgatggggggttacctctttggaaggggccacaaagatgaagggaggagagaggtgaagttttgcagctcaaggacaacattcatcttctcatctcaaattattcaggaatattactaatggaattatgttaacatcagctgccaacatatatctcaatctctgttgccctgaacacatgttaattgagattctttctatgacaagtaacaaaaagctaactcaaactggcttaagcagaaagctaattattgactttaatatctgggatctagggtattgcataccaaagcttcaggcatggctggatctgggtgcacttactcagtattctcaggaagctcctttttttgtcattcatgtagacttaacattcacatggcctttcaccttacggtggcctccaatagctccaggatgagctttacagctccaaatatagtgaaaggagaatttcttttctccaacaattctaatgaaaattctggcctaattctcactggcccaagttcagtcatgtgcccattcctgagccaatcactgtggtgaggaaaacagatgcataaccaaccttatcctcaggaatcctggaactgggtgaggggaaagagggacagtcagcttcatctaaactatggactgagagttgaggcaagatgattcctgaaagaaaattctaagtcttgctgctataagtggaagagaatggtgggcaagcaaaagcaaccagtgcccacaccaaaggtaaatctaaaacaacatcccatttcagtacagcaagcggttctccttcacacagaggaagctcatctccaagtttttatttggccaggacatgaaccaaataaacaccttccaaagaaaaaaaaaaaaaaaaa

SEQ ID NO: 1069 - DNA, 2968 bp, Homo sapiens
aggctgagcggctacctgaatggggagggggcagacggcgctgagcgcggcggcggcgggagcggcgtcgagtgtctccgtgcgcccgtctgtggccaagcagccagcagcctagcagccagtcagcttgccgccggcggccaagcagccaaccatgctcaacttcggtgcctctctccagcagactgcggaggaaagaatggaaatgatttctgaaaggccaaaagagagtatgtattcctggaacaaaactgcagagaaaagtgattttgaagctgtagaagcacttatgtcaatgagctgcagttggaagtctgattttaagaaatacgttgaaaacagacctgttacaccagtatctgatttgtcagaggaagagaatctgcttccgggaacacctgattttcatacaatcccagcattttgtttgactccaccttacagtccttctgactttgaaccctctcaagtgtcaaatctgatggcaccagcgccatctactgtacacttcaagtcactctcagatactgccaaacctcacattgccgcacctttcaaagaggaagaaaagagcccagtatctgcccccaaactccccaaagctcaggcaacaagtgtgattcgtcatacagctgatgcccagctatgtaaccaccagacctgcccaatgaaagcagccagcatcctcaactatcagaacaattcttttagaagaagaacccacctaaatgttgaggctgcaagaaagaacataccatgtgccgctgtgtcaccaaacagatccaaatgtgagagaaacacagtggcagatgttgatgagaaagcaagtgctgcactttatgacttttctgtgccttcctcagagacggtcatctgcaggtctcagccagcccctgtgtccccacaacagaagtcagtgttggtctctccacctgcagtatctgcagggggagtgccacctatgccggtcatctgccagatggttccccttcctgccaacaaccctgttgtgacaacagtcgttcccagcactcctcccagccagccaccagccgtttgcccccctgttgtgttcatgggcacacaagtccccaaaggcgctgtcatgtttgtggtaccccagcccgttgtgcagagttcaaagcctccggtggtgagcccgaatggcaccagactctctcccattgcccctgctcctgggttttccccttcagcagcaaaagtcactcctcagattgattcatcaaggataaggagtcacatctgtagccacccaggatgtggcaagacatactttaaaagttcccatctgaaggcccacacgaggacgcacacaggagaaaagcctttcagctgtagctggaaaggttgtgaaaggaggtttgcccgttctgatgaactgtccagacacaggcgaacccacacgggtgagaagaaatttgcgtgccccatgtgtgaccggcggttcatgaggagtgaccatttgaccaagcatgcccggcgccatctatcagccaagaagctaccaaactggcagatggaagtgagcaagctaaatgacattgctctacctccaacccctgctcccacacagtgacagaccggaaagtgaagagtcagaactaactttggtctcagcgggagccagtggtgatgtaaaaatgcttccactgcaagtctgtggccccacaacgtgggcttaaagcagaagccccacagcctggcacgaaggccccgcctgggttaggtgactaaaagggcttcggccacaggcaggtcacagaaaggcaggtttcatttcttatcacataagagagatgagaaagcttttattcctttgaatattttttgaaggtttcagatgaggtcaacacaggtagcacagattttgaatctgtgtgcatatttgttactttacttttgctgtttatacttgagaccaacttttcaatgtgattcttctaaagcactggtttcaagaatatggaggctggaaggaaataaacattacggtacagacatggagatgtaaaatgagtttgtattattacaaatattgtcatctttttctagagttatcttctttattattcctagtctttccagtcaacatcgtggatgtagtgattaaatatatctagaactatcatttttacactattgtgaatatttggaattgaacgactgtatattgctaagagggcccaaagaattggaatcctccttaatttaattgctttgaagcatagctacaatttgtttttgcatttttgttttgaaagtttaacaaatgactgtatctaggcatttcattatgctttgaactttagtttgcctgcagtttcttgtgtagatttgaaaattgtataccaatgtgttttctgtagactctaagatacactgcactttgtttagaaaaaaaactgaagatgaaatatatattgtaaagaagggatattaagaatcttagataacttcttgaaaaagatggcttatgtcatcagtaaagtacctttatgttatgaggatataatgtgtgctttattgaattagaaaattagtgaccattattcacaggtggacaaatgttgatgttgtcctgttaatttataggcgttttttggggatgtggaggtagttgggtagaaaaattattagaacattcacttttgttaacagtatttctcttttattctgttatatagtggatgatatacacagtggcaaaacaaaagtacattgcttaaaatatatagtgaaaaatgtcactatatcttcccatttaacattgtttttgtatattgggtgtagatttctgacatcaaaacttggacccttggaaaacaaaagttttaattaaaaaaaatccttgtgacttacaatttgcacaatatttcttttgttgtactttatatcttgtttacaataaagaattccctttggtatatggaaaaaaaaaaaaaaaaaa

SEQ ID NO: 1070 - DNA, 4051 bp, Homo sapiens
gagggccgcgccggggcagagccgcgcgggcgggcgaggcgcgtgccggccgcaggagctccgggttgccgccgccgccgccgcccgcagcccacgtgcggccgctgctgcgcccgagctcacgccccgcggccgctttgttgctcccggccggcctgcacgatgcacacgccggacttcgcaggcccagacgacgcgcgcgcagttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtttgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacctgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttttgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttacattgaaaaaaaaaaaaaaaaaaaaa

SEQ ID NO: 1071 - DNA, 3905 bp, Homo sapiens
gacagataccctccttccggccgcgccactcgggaggcggatcccgtgggcctgaggaggcttcccccgcccggtttgctttccctccctcgctggcgctgccgcgagtccaccgagcggcctctgaggagcagccgcaggaggaggaggaggtcgtcgggggcggcgggcggagaccgcgctctcgcttccccggcggcggcaagggcaggacaatggaggtggcggtggagaaggcggtggcggcggcggcagcggcctcggctgcggcctccggggggccctcggcggcgccgagcggggagaacgaggccgagagtcggcagggcccggactcggagcgcggcggcgaggcggcccggctcaacctgttggacacttgcgccgtgtgccaccagaacatccagagccgggcgcccaagctgctgccctgcctgcactctttctgccagcgctgcctgcccgcgccccagcgctacctcatgctgcccgcgcccatgctgggctcggccgagaccccgccacccgtccctgcccccggctcgccggtcagcggctcgtcgccgttcgccacccaagttggagtcattcgttgcccagtttgcagccaagaatgtgcagagagacacatcatagataacttttttgtgaaggacactactgaggttcccagcagtacagtagaaaagtcaaatcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccagaggcagttggtgtcaccagccagcgaccagtgttttgtccttttcataaaaaggagcagctgaagctgtactgtgagacatgtgacaaactgacatgtcgagactgtcagttgttagaacataaagagcatagataccaatttatagaagaagcttttcagaatcagaaagtgatcatagatacactaatcaccaaactgatggaaaaaacaaaatacataaaattcacaggaaatcagatccaaaacagaattattgaagtaaatcaaaatcaaaagcaggtggaacaggatattaaagttgctatatttacactgatggtagaaataaataaaaaaggaaaagctctactgcatcagttagagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactgattacataccggttacggcacctccttcgtgcaaggtgtgatgcatccccagtgaccaacaacaccatccaatttcactgtgatcctagtttctgggctcaaaatatcatcaacttaggttctttagtaatcgaggataaagagagccagccacaaatgcctaagcagaatcctgtcgtggaacagaattcacagccaccaagtggtttatcatcaaaccagttatccaagttcccaacacagatcagcctagctcaattacggctccagcatatgcagcaacagcaaccgcctccacgtttgataaactttcagaatcacagccccaaacccaatggaccagttcttcctcctcatcctcaacaactgagatatccaccaaaccagaacataccacgacaagcaataaagccaaaccccctacagatggctttcttggctcaacaagccataaaacagtggcagatcagcagtggacagggaaccccatcaactaccaacagcacatcctctactccttccagccccacgattactagtgcagcaggatatgatggaaaggcttttggttcacctatgatcgatttgagctcaccagtgggagggtcttataatcttccctctcttccggatattgactgttcaagtactattatgctggacaatattgtgaggaaagatactaatatagatcatggccagccaagaccaccctcaaacagaacggtccagtcaccaaattcatcagtgccatctccaggccttgcaggacctgttactatgactagtgtacaccccccaatacgttcacctagtgcctccagcgttggaagccgaggaagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaagtggagagtggatttgcactttctgccgagacttatctaaaccagaagttgaatatgattgtgatgctcccagtcacaactcagaaaaaaagaaaactgaaggccttgttaagttaacacctatagataaaaggaagtgtgagcgcctacttttatttctttactgccatgaaatgagcctggcttttcaagaccctgttcctctaactgtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaacaaaaa

SEQ ID NO: 1072 - DNA, 5154 bp, Homo sapiens
tcgcgcaggcggggaccggtccagctgagcctggtggcggaaaggctgcggccccgcgccagagggccggtggctcctccgggcttctgaggacccgcagggagcgggcctcatcatttctgtctcctgtttctccacttccttctctattggttggtccactgatgtatggacttgcacatgatgaactgtgaacttctagccacatgtagtgcccttgggtacttggagggagacacttaccataaggaaccagattgcttagagagcgtgaaggatctgatccgctatttgaggcatgaggatgagacacgagatgtgcggcagcagctgggggcagcccagatcctacagagcgaccttctgcccatcctcacccagcaccaccaggacaagcctctctttgatgctgttatcagactgatggtgaacttgacacaaccagccttgctctgttttggcaatctgcctaaggagcccagctttcggcaccattttttgcaggtgctaacttatttgcaggcctacaaagaggcctttgccagtgagaaggcttttggagtcctcagtgaaaccttgtatgagctgctgcagctgggctgggaggaacggcaggaggaagacaacttgctgattgaacggatcctactgctggtcagaaatattctccatgtcccagctgaccttgatcaggagaagaagattgatgatgacgccagtgcccatgaccagctcctctgggcgattcacctcagcggcctggatgacctgctcctctttctggccagctcgtctgctgaggagcaatggagcctacatgtgctagagattgtctcccttatgtttcgtgaccagaaccccgagcagctggcgggagtagggcagggacgcttagctcaggagcggagtgcagattttgcagaactggaggtgttgcgccagcgagagatggcagaaaagaagactcgagccctccagcgaggcaacaggcattctcgatttgggggctcctatattgtccaggggttgaaatccattggggagagggacctcatctttcacaaaggccttcacaacctacgaaactacagttcagatttgggaaagcagccgaaaaaggtgcctaaacgtcgccaggccgcccgagagctgtccattcagcgccgttctgccctcaatgtgaggctcttcctcagagacttctgctctgagttcctggagaactgttacaaccggctcatgggatcagtaaaggatcacctgcttcgggagaaagctcagcagcatgatgagacctattatatgtgggccttggctttcttcatggccttcaaccgagctgcctccttccggccaggcctggtttctgagaccctcagtgtccgtaccttccacttcattgagcagaacctcaccaactactatgagatgatgctgactgaccgcaaggaagctgcctcctgggcacgccggatgcacttggctctgaaggcctatcaggagctgctggcaacagtgaatgagatggacatatctccagatgaggctgtgagggagagcagccgcatcatcaagaacaatattttctatgtgatggagtaccgagaactattcctggcactttttcgaaagtttgatgagagatgccagccccgctctttccttcgtgacctggtggagaccacccacctcttcctcaaaatgttggagcgattctgtcggagccgtgggaacctggtggtgcagaacaaacaaaagaagagaaggaagaagaagaagaaggtcctagaccaggccattgtttctggtaatgtcccatctagcccagaagaagtggaggctgtgtggccagccctggctgagcagctacagtgctgtgcccagaattctgagctcagcatggactccgtggttccctttgatgcggcctcagaggtgccagtggaggagcagcgggcagaagctatggtacggatccaagactgtctcctggctggccaggccccacaggccctgactctcctgaggtctgctcgggaggtgtggcctgaaggagatgtgtttggctctcaagacatttctccagaggaagagatccagttgctgaaacaaatcctctctgctccacttccccggcagcagggcccagaggaacgtggggcagaggaagaagaagaggaggaggaggaggaagaggaggagttgcaagtggtccaggtgtcggagaaagaatttaattttctggactacctgaaacgctttgcatgttcaactgtcgttcgagcctatgtgctgctactaaggagctaccagcagaatagtgcccacactaaccattgcattgtgaagatgctgcaccggctggcccatgacctcaaaatggaagccctactttttcagctgtcagtcttctgcctcttcaatcgtctgcttagtgaccctgctgctggagcctacaaagagctagtgacttttgccaaatacatcctgggcaaattttttgcactggctgcagtcaaccaaaaagcctttgtggagctgttgttctggaagaacacagctgtggttcgagagatgactgagggctatggctccctggatgacaggtcttccagtcgcagagcacctacatggagccccgaagaagaggctcatcttcgggagctgtacctcgccaataaggacgtggaagggcaggatgtggtggaagccatcttggcccacctgaatactgttcctcgaacacgcaagcagatcatccaccatctggtacagatgggactggctgacagtgtcaaggacttccaaaggaaaggaacccatattgtactgtggacgggggatcaggagttggagctgcagcggctttttgaggaattccgggactcagatgatgtcctgggtcatatcatgaagaatatcacagccaaacgctcacgggcccgaatagtggataaactcttggctctggggctggtggctgagcggcgggagctgtacaagaaacggcagaaaaagttggcatcctccatcttgccaaatggagcggagtccctgaaagatttttgccaggaagatctggaagaagaggaaaacctgcctgaggaagacagcgaagaggaagaagaagggggctcagaagcagaacaagtccagggtagcttagtcctttcaaatgaaaaccttggtcaaagcctgcatcaggaaggcttttctatcccgctcctatggctccagaactgcctgatccgagcagctgatgatcgggaagaggatggctgctcccaggccgttccattggtgccactcacagaggaaaatgaggaagccatggaaaacgaacagtttcagcagctgttgcgcaagctaggggttcggccccctgcctctgggcaggaaaccttctggcgaattccagccaagctgagtcctacccagctccggagggcagcagcttctttgagtcaaccagaggaggaacagaagctgcagccagagctgcagcctaaagtccctggagagcaaggctctgatgaggagcactgtaaagagcaccgagcacaagccctgagggccctcttgctagcccacaagaagaaagcgggcctggcatccccagaggaggaagacgctgttggtaaagagccgctgaaggcagcacccaagaaacgacaattgctggacagcgacgaggaacaggaagaagatgagggcaggaacagagcaccagagttgggagctccaggaatccaaaagaagaaacgataccagattgaggatgatgaggatgactgaagagctaagaagcctaggggtagagatagacacgtttttagatggtgcattcaagtcagagttggaagggtcatacaggacccagaagctcctcttactggacagagcagtagaatcccaggctctttcacggatttaggctgagaaacttcagcagcagtattggacttctctgctgtcagtctttgtttctcccagtttttatcggtatgccccagcagctctctggagatttagttctcttcttctaggaaccatttcttttggttattggagctccttagcaaataagaggagtgagtgaaatagagaaagcaccccggaccccttttattggtctgttcctttggctttctcttggaggtgggtcgcagcaccagatggggagctttatgacatgacaggcgggagttttgtaccacttttagaagataccagatgcctctgtcctcattttgtttcctatgatcatcctctagataccagatagaggcccattcctgcatttgagatagggttggaatatagtactctagatgatgaatgtgtttgctttgtgtttggtattaaacatgtaagattagaagttctcatctcagtctgacttggcgatatgtctaagttccccagcccttcccctgctgtgctcttgaaagaagaacttaacaattttagggtaaaaagagaccaacagaccggcacagtggctcaaacctgttgtcctagcactttgggaggctgaggcgggcggatcacctgaggtcaggagtttgagaccggcctggacaatatggcgaaatcccatctccactaaaaatacaaaaattagccggccatggtggcatgcgcctgtaatcccagccactcgggtggctgaggcaggagaattgcctgaacccaggaggcagaggttgcagtgagctaaggtcacgccagtgcatatgcctgggcgacagagcaagactctgtctcaaaaaaaaagaaaaaaaaaaaagaccaacaaccttcccttttcttccgctttccctacagaagacacagaaaagcatttttgcctctagatccttttgtctagggtaaattcttagggtgacaagagtatgcggcaggaagaaggaggagccataaaggaagagaagccagcttgttggcatggggcatagaaaaggacaaaatctaggcatgaaaaggatggataaatactgcaaatattatgttcttacccattcttggaaacgtcagctttcttgcttcctgtgcttccagccgaggtagggcaaaggtgagattgagaaaatagccattcagctcaggaaggcttctaagtaaaggatggatttggaaaaaaaaaaaaaaaaa

SEQ ID NO: 1073 - DNA, 5956 bp, Homo sapiens
gtgaactctgaccttagctttccgtagcgcccgcgtctgccgcccccgcccccggagcgaaggaggcgggctttggccttttgccctagggagcgagtgcggagcgagtgggagcgagacggccctgagtggaagtgtctggctccccgtagaggcccttctgtacgccccgccgcccatgagctcgttctcacgcgaacagcgccgtcgttaggctggctctgtagcctcggcttaccccgggacaggcccacgcctcgccagggagggggcagcccgtcgaggcgcctccctagtcagcgtcggcgtcgcgctgcgaccctggaagcgggagccgccgcgagcgagaggaggagctccagtggcggcggcggcggcggcagcggcagcgggcagcagctccagcagcgccagcaggcgggatcgaggccgtcaacatggcgagcgcctcgtaccacatttccaatttgctggaaaaaatgacatccagcgacaaggactttaggtttatggctacaaatgatttgatgacggaactgcagaaagattccatcaagttggatgatgatagtgaaaggaaagtagtgaaaatgattttgaagttattggaagataaaaatggagaggtacagaatttagctgtcaaatgtcttggtcctttagtgagtaaagtgaaagaataccaagtagagacaattgtagataccctctgcactaacatgctttctgataaagaacaacttcgagacatttcaagtattggtcttaaaacagtaattggagaacttcctccagcttccagtggctctgcattagctgctaatgtatgtaaaaagattactggacgtcttacaagtgcaatagcaaaacaggaagatgtctctgttcagctagaagccttggatattatggctgatatgttgagcaggcaaggaggacttcttgttaatttccatccttcaattctgacctgtctacttccccagttgaccagccctagacttgcagtgaggaaaagaaccattatcgctcttggccatctggttatgagctgtggaaatatagtttttgtagatcttattgaacatctgttgtcagagttgtccaaaaatgattctatgtcaacaacaagaacctacatacaatgtattgctgctattagtaggcaagctggtcatagaataggtgaataccttgagaagataattcctttggtggtaaaattttgcaatgtagatgatgatgaattaagagagtactgtattcaagcctttgaatcatttgtaagaagatgtcctaaggaagtatatcctcatgtttctaccattataaatatttgtcttaaatatcttacctatgatccaaattataattacgatgatgaagatgaagatgaaaatgcaatggatgctgatggtggtgatgatgatgatcaagggagtgatgatgaatacagtgatgatgatgacatgagttggaaagtgagacgtgcagctgcgaagtgcttggatgctgtagttagcacaaggcatgaaatgcttccagaattctacaagaccgtctctcctgcactaatatccagatttaaagagcgtgaagagaatgtaaaggcagatgtttttcacgcatacctttctcttttgaagcaaactcgtcctgtacaaagttggctatgtgaccctgatgcaatggagcagggagaaacacctttaacaatgcttcagagtcaggttcccaacattgttaaagctcttcacaaacagatgaaagaaaaaagtgtgaagacccgacagtgttgttttaacatgttaactgagctggtaaatgtattacctggggccctaactcaacacattcctgtacttgtaccaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcacccttattgcaggggggagctcttagtgccatgctagactttttccaagctctggttgtcactggaacaaataatttaggatacatggatttgttgcgcatgctgactggtccagtttactctcagagcacagctcttactcataagcagtcttattattccattgccaaatgtgtagctgcccttactcgagcatgccctaaagagggaccagctgtagtaggtcagtttattcaagatgtcaagaactcaaggtctacagattccattcgtctcttagctctactttctcttggagaagttgggcatcatattgacttaagtggacagttggaactaaaatctgtaatactagaagctttctcatctcctagtgaagaagtcaaatcagctgcatcctatgcattaggcagcattagtgtgggcaaccttcctgaatatctgccgtttgtcctgcaagaaataactagtcaacccaaaaggcagtatcttttacttcattccttgaaggaaattattagctctgcatcagtggtgggccttaaaccatatgttgaaaacatctgggccttattactaaagcactgtgagtgtgcagaggaaggaaccagaaatgttgttgctgaatgtctaggaaaactcactctaattgatccagaaactctccttccacggcttaaggggtacttgatatcaggctcatcatatgcccgaagctcagtggttacggctgtgaaatttacaatttctgaccatccacaacctattgatccactgttaaagaactgcataggtgatttcctaaaaactttggaagacccagatttgaatgtgagaagagtagccttggtcacatttaattcagcagcacataacaagccatcattaataagggatctattggatactgttcttccacatctttacaatgaaacaaaagttagaaaggagcttataagagaggtagaaatgggtccatttaaacatacggttgatgatggtctggatattagaaaggcagcatttgagtgtatgtacacacttctagacagttgtcttgatagacttgatatctttgaatttctaaatcatgttgaagatggtttgaaggaccattatgatattaagatgctgacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactgctaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatcaaaaatcttgcaaaacaaaaaccatgtttctttttcttgtataactttttgttttcagcaacataaattgatttttagctggcagacaagaatatccatataagatttgttaaccatttcagagagtttggcaatttttaaaagataataaggtatcatttttaagtatgaaaattaacaatatccctgttgcgcacactaattttgcatgagtaagtttacaaatatgtatcgtctgtaaagcagcatgtgcagattattcataatatagaagttaaaataagtattagtgcaattttcagatatttatttttgcacagaaaacacattatctggagagaaagaaaggagaatttttgagacttgggttttcttaatgccagtgtgaatttgcagatgttttcagaaaatcaagtcacagtaacaatttgccacttttttctattataaatcttcttacttaaattttgaatatttagtttttctcagttacccatttgtgtgtgtgtgattccacttagaaattcttaaaaccagatttttctttcattccgtttggatgtctacattccttatcaaaggatataaatactgtgtatgcttttgaattttatttttaggaaaattctgaagccagctatcacaggtttgttagctaataatagtattttcttttagttgagttaggtttttccccatctcctgtagagcgaatttacatattgtattgggtaagtgttcactacttttcctgattaagggatctgtgctggggaacaaagcttttgcagtaccttatattgtagttaaaattttatttaacatatccttcagtgagctcatttcacactgtagcctcttccttaaaatttgtggtgctcctgtaacagtaagaactaattctgaaataaaagacatctcctaatgctgtgcaaacatagtttacatgtattgaaggaggcagttgttaaattgagtgaccaatttaagcaatcagatatttgaaaactgcaccctttagttttgaaactgtgaattagaaacacttttcctgctgtattactacctgctttaacatccaaatatacagtgattttaaatgataacatactgtggttattagattaacagcttgattttgaatgttcagatgataatgcagaagacatcacttctagtaaggattttgactagtgcattgatgttgaagttggtgccatttcaaaatgtggcaggtgataatcttttaccataatttgcataaaactgtaatagaagtttattttgagatgttagtatattatgtactatgcatttctgtggtatagatgttgtggatatatttaagtatttggttacatggttttacaataaattacaatactgcaggcaaaaaaaaaaaaaaaaaaaaaaaaaaagaaaaaaaaaaaaaaaaaaag

SEQ ID NO: 1074 - DNA, 2352 bp, Homo sapiens
gaaacttaaaggtgtttaccttgtcatcagcatgtaagctaattatctcgggcaagatgtaggcttctattgtcttgttgctttagcgcttacgccccgcctctggtggctgcctaaaacctggcgccgggctaaaacaaacgcgaggcagcccccgagcctccactcaagccaattaaggaggactcggtccactccgttacgtgtacatccaacaagatcggcgttaaggtaacaccagaatatttggcaaagggagaaaaaaaaagcagcgaggcttcgccttccccctctcccttttttttcctcctcttccttcctcctccagccgccgccgaatcatgtcgatgagtccaaagcacacgactccgttctcagtgtctgacatcttgagtcccctggaggaaagctacaagaaagtgggcatggagggcggcggcctcggggctccgctggcggcgtacaggcagggccaggcggcaccgccaacagcggccatgcagcagcacgccgtggggcaccacggcgccgtcaccgccgcctaccacatgacggcggcgggggtgccccagctctcgcactccgccgtggggggctactgcaacggcaacctgggcaacatgagcgagctgccgccgtaccaggacaccatgaggaacagcgcctctggccccggatggtacggcgccaacccagacccgcgcttccccgccatctcccgcttcatgggcccggcgagcggcatgaacatgagcggcatgggcggcctgggctcgctgggggacgtgagcaagaacatggccccgctgccaagcgcgccgcgcaggaagcgccgggtgctcttctcgcaggcgcaggtgtacgagctggagcgacgcttcaagcaacagaagtacctgtcggcgccggagcgcgagcacctggccagcatgatccacctgacgcccacgcaggtcaagatctggttccagaaccaccgctacaaaatgaagcgccaggccaaggacaaggcggcgcagcagcaactgcagcaggacagcggcggcggcgggggcggcgggggcaccgggtgcccgcagcagcaacaggctcagcagcagtcgccgcgacgcgtggcggtgccggtcctggtgaaagacggcaaaccgtgccaggcgggtgcccccgcgccgggcgccgccagcctacaaggccacgcgcagcagcaggcgcagcaccaggcgcaggccgcgcaggcggcggcagcggccatctccgtgggcagcggtggcgccggccttggcgcacacccgggccaccagccaggcagcgcaggccagtctccggacctggcgcaccacgccgccagccccgcggcgctgcagggccaggtatccagcctgtcccacctgaactcctcgggctcggactacggcaccatgtcctgctccaccttgctatacggtcggacctggtgagaggacgccgggccggccctagcccagcgctctgcctcaccgcttccctcctgcccgccacacagaccaccatccaccgctgctccacgcgcttcgacttttcttaacaacctggccgcgtttagaccaaggaacaaaaaaaccacaaaggccaaactgctggacgtctttctttttttccccccctaaaatttgtgggtttttttttttaaaaaaagaaaatgaaaaacaaccaagcgcatccaatctcaaggaatctttaagcagagaagggcataaaacagctttggggtgtctttttttggtgattcaaatgggttttccacgctagggcggggcacagattggagagggctctgtgctgacatggctctggactctaaagaccaaacttcactctgggcacactctgccagcaaagaggactcgcttgtaaataccaggatttttttttttttttgaagggaggacgggagctggggagaggaaagagtcttcaacataacccacttgtcactgacacaaaggaagtgccccctccccggcaccctctggccgcctaggctcagcggcgaccgccctccgcgaaaatagtttgtttaatgtgaacttgtagctgtaaaacgctgtcaaaagttggactaaatgcctagtttttagtaatctgtacattttgttgtaaaaagaaaaaccactcccagtccccagcccttcacattttttatgggcattgacaaatctgtgtatattatttggcagtttggtatttgcggcgtcagtctttttctgttgtaacttatgtagatatttggcttaaatatagttcctaagaagcttctaataaattatacaaattaaaaagattctttttctgattaaaaaaaaaaaaaaaaaa

SEQ ID NO: 1075 - DNA, 6297 bp, Homo sapiens
cctgcgccggccgcccgcccggccgcggggagggaggcccgcagcgcgggaagagcggcccggtcgcgggcgccgccaccgccgccgctgccaggactgaaatgcaactgcagaagcaacatgtgaccttttagagatgcttgtgggactgcataaagtgaagagggaaactggaaaaaaacaatgaagtaaggaaaaaattgaatagggaaaacctgctttctgcaaacaactgaaaaagctgcatttagaaactgtttctttggccctcatcgagaagctggaacttgtattgttaggccccttatgggacaagctctcaactgctgatcacccagtgattgtcaccatggccagcaagaggaaatccaccacaccatgcatgatcccagtgaagactgtggtgttgcaagatgccagcatggaggcccagcccgctgagaccttgcctgaaggaccccagcaggatctgcccccagaagcatctgctgccagcagtgaggcagcacagaaccccagcagtactgatggctctacactggccaatgggcatcggagcactttagatggctatttatattcctgtaaatactgcgatttcagatcccatgacatgacccaatttgtgggacatatgaactcagagcacacagactttaataaagacccaacctttgtatgcagtgggtgcagttttctggcaaaaacccctgaggggctttccttgcacaatgccacatgtcactccggggaagccagctttgtgtggaacgtggccaagccagacaatcatgtggttgtggagcagagcatccctgagagcaccagcactcctgacctagcgggtgagcccagtgctgaaggggctgatggacaggcagaaatcatcattaccaaaactccaatcatgaagataatgaaaggcaaagctgaagccaaaaaaattcatacactcaaggagaatgtccctagccagcctgtgggtgaggccttaccaaagctgtcgactggagaaatggaggtgagagagggggaccattccttcatcaatggggcagttccagtcagccaggcatctgccagctctgcaaaaaacccccatgccgccaacgggcccctgataggaacagtgccagttttgccagctggcatagcacagttcctctccctccagcagcagcccccagtgcatgcccaacaccatgtccaccagccactgcccacggccaaggcccttcccaaagtgatgatccccctgagcagcattccaacgtacaatgcagccatggactctaacagcttcctgaagaactccttccacaagttcccctaccccaccaaagccgagctctgctatttgactgtggtgaccaagtatccagaagaacagctcaagatctggttcacagcccaaaggctgaagcaggggatcagctggtcccctgaggagattgaggatgcccggaaaaagatgttcaatacagtcatccagtctgtgcctcagcccacaattacggttctaaataccccactcgtcgccagtgctggcaatgtccagcatctcatccaggccgctcttccaggtcacgttgtggggcagccagagggtacaggagggggacttctggtcactcagccattgatggccaatgggttgcaagcaacaagttcccctctccccctcacggtgacatccgtccccaagcagccaggtgtggcacccattaacactgtgtgttcaaatacaacgtcagctgtgaaggtggtcaatgcggcccagtcgctcctcacggcctgccccagcataacctcccaagccttccttgatgctagcatctacaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactactgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcatttttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaaccaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatggtctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttg

SEQ ID NO: 1076 - DNA, 2209 bp, Homo sapiens
agcagacaagatggcttccgggatttggcggcgcctttgtctctcgctgcagccggagctccaggtctcgctttcattgctctgtgtcctctgctcctagaggtccagcctctgtgggcctgtgacctgcagaaattgagagatccacagctaagactccaggaccccctggaagcctagaaatgggactgttgacatttagggatgtggccatagaattctctctggaagaatggcaatgcctggacactgcacagcggaatttatataaaaatgtgattttagagaactacagaaacctggtcttcctgggtattgctgtctctaagcaagacctgatcacctgtctggagcaagaaaaagagcctttgactgtgaagagacatgagatggtgaatgaacccccagtaatgtgttctcattttgcccaagagttttggccagagcagaacataaaagattcttttgaaaaagtgacactgagaagatatgaaaaatgtggaaatgataattttcagttaaaaggctgtaaaagtgtggatgaatgtaagttgcacaagggaggttataatggacttaaccaatgtttaccaactatgcagagcaaaatgtttcaatgtgataaatatgtgaaagtctttaataaattttcacattcagatagacataagataaaacatatggaaaataaacctttcaaatgtaaagaatgtggcagatcattttgcatgctttcacacctaactcgacatgaaagaaattataccaaggtgaatttctgcaaatgtgaagaatgtgaaaaagctgttaaccaatcttcaaagcttactaaacataaaagaatttatacttgtgagaaactctacaaatgtcaagaatgtgacagaacttttaaccaattctcaaaccttactgaatataaaaaagattatgctcgagagaaaccatacaaatgtgaagaatgtggcaaagcctttaaccagtcctcacaccttactacacataagataattcatacaggagagaaaccctacaaatgtgaagaatgtggcaaagcctttaaccagttctcaaatcttactacacataaaaaaattcatactggagagcaaccctacatatgtgaagaatgtggcaaggcttttacccaatcctcaacccttactacacataagagaattcatactggagaaaaaccctacaaatgtgaagaatgtggaaaagcttttaaccgatcctcaaaacttactgaacataaaaacattcatactggagagcaaccctacaaatgtgaggaatgcggcaaagcttttaaccgatcctcaaatcttacggaacataggaaaattcataccgaagagaaaccctacaaatgtaaagaatgtggcaaagcttttaaacactcctcagcccttactacacataagagaattcacactggagagaaaccctacaaatgtgaagaatgtggcaaagcttttaaccgatcctcaaaacttactgaacataagaaacttcatactggaaagaaaccctacaaatgtgaagaatgtggcaaagcttttatccaatcctcaaaacttactgaacataagaaaattcattctggagagataccctacaagtgtgaagaatgtggcaaagcttttaaacactcctcatcccttactacacataaaagaattcatactggggagaaaccctacaaatgtgaagaatgtggcaaagcttttagccgatcctcaaaacttactgaacataagataattcatactggagagaaaccctataaatgtgagagatgtgacaaagcttttaaccaatctgcaaaccttactaaacataaaaaaatacatactggagagaaactacagaactggaatgtgtgataatgattttgacaacacctcaaatttttctaaatataaaggaaatcatactggtgaaaaattctagaaatgtaaagaatgtgtcaaagactttaaatggttttcacacttcattgtatgtaagataattcatactggagaaaactacaagtgtgaagaatttggcaatactgttaattaaggctcaaaccttattgcacaggaaagcgtttatacttaagaaaaattgtacaaatataaagagtgtaaaatagccattaatatctgttgacatcttaatatcagaatgttggtacttaataaaagcattataaatgcaa

SEQ ID NO: 1077 - DNA, 2123 bp, Homo sapiens
tcccagagtcaacagcgagcgagcagccggagcggggaagcagaagccagagaggggaagaatacggcgccccctctctccctcccctcccccttctactttagcctttctgcgcacttcgcttccaagtctccgcgcagccaggagccgctgttgcctcccagcccctgctagctgccccccgagccgagcgcagcgagcgccgccgcccgggccccccggtggggccagggccagcatggagcacctgggtccgcaccacctccacccgggtcacgcagagcccattagcttcggcatcgaccagatcctcaacagcccggaccagggtggctgcatgggacccgcctcgcgcctccaggacggagaatacggccttggctgcttggtcggaggcgcctacacttacggcggcgggggctccgcggccgcgacgggggctggaggagcgggggcctatggtactggaggtcccggcggccccggaggcccggcaggcggcggcggcgcctgcagcatgggtcctctgaccggctcctacaacgtgaacatggccttggcaggcggccccggtcctggcggcggcggcggcagcagcggcggtgccggggcactcagcgctgcgggggtaatccgggtgccggcacacaggccgctcgccggagccgtggcccacccccagcccctggccaccggcttgcccaccgtgccctctgtgcctgccatgccgggcgtcaacaacctcactggcctcaccttcccctggatggagagtaaccgcagatacacaaaggacaggttcacaggtcacccctatcagaaccggacgccccccaagaagaagaagccgcgcacgtccttcacacgcctgcagatctgcgagctggagaagcgcttccaccgccagaagtacctggcctcggccgagcgcgccgccctggccaaggcgctcaaaatgaccgatgcgcaggtcaaaacctggttccagaaccggcggacaaagtggagacggcagactgcggaggaacgggaggccgagaggcagcaagcgaaccgcatcctcctgcagttgcagcaggaggccttccagaagagcctggcacagccgctgcccgctgaccctctgtgcgtgcacaactcgtcgctcttcgccctgcagaatctgcagccgtggtctgacgactcgaccaaaatcactagcgtcacgtcggtggcgtcggcctgcgagtgagcctgcccattctgccctgtgggaccccaggcccactcaggggtcactgaggcctgagacccaggactcctccccaccctcctggcctcagactgcacccaggaggggaacactgccctcgcacggccccgaagggcccccacatttgtgccgacactgttctcccttcggtggaagagctcaagggacaaggacacgcgcccccctcccagaggcgtcccgcacctgtctgaactgttaagaaatctgtttttgtttatttcattttattttaatttttaacgtgggattcagagaaaggcaagggaggtaagggaggaggagcttctggggtccccagggctgtcatctgaatttgccctgggaaaccccttctctgtgacccacttctcatcacacacatggaaacccataggcccacacacaggtggtgtcactgtccctcctggtgtcaccccagagccacacatgggcatctatgggagagtgtcaaccagacagagggtcacagtgtttacactttggaccttacgatcaggcacaggtcaggggtgacacagactcatcctgaacagcatggcactccctccagcacaaacacaaggtcatggccacactgtgacacactacaccacacacaacagccaacagctacaacagcctcacttggtctgccaggcccccaccacacatcccagcccaatccaggtacgcacagacaggttttcacataaatgcagcccatttctccagaacccatttgaggggtgggggggtgttaatttatgcacttataaggtgttttctgtgtaaccattttataaagtgcttgtgtaatttatgtgaaaaaaataaataaaagcctccggatccggaaaaaaaaaaaaaaaaa

SEQ ID NO: 1078 - DNA, 1415 bp, Homo sapiens
atccaaccaaggcctcagtgaggtcccacgtgtcccccgtggcgagatttcgccctcccgccgttgaggaggaagagtgtgagaacagacttcctaggcaccgggcgccgttccccagccgcttcttacgcagccgggaaaccacaacgagatttggtcttcgagagcatttaggcggggaccacaacgaatccgggagttggccagaaggatccatcgagaggcgaagagtgggggctgggggaggaggcacctgcggaggaagccggtgaggcggaggcagcccaaaggcggaggccgcccaaaggcggaggccagcaaggatggaggcgcgctgcgctctcgcccttctctgggacgcgccgcataggccacccctaccaaaaccggacccctccgaagcggaagaagccgcgcacgtccttctcccgctcacaggtgctggagttggagcggcgcttcctgcgccagaagtacctggcctctgcggagagggcggcgctggccaaggccttgcgcatgaccgacgcacaggtcaaaacgtggttccagaaccgacgcaccaagtggcggcgccagacggcggaggagcgcgaggccgagcggcaccgcgcgggccggctgctcctgcatctgcagcaggacgcgttgccacggccgctgcggccgccgctgcccccggaccctctctgcctgcacaactcgtcgctcttcgcgctgcagaacctgcagccctgggccgaggacaacaaagtggcttcagtgtccgggctcgcctcggtggtgtgagcgacgcccgtccgatcggcgtggagcgccgggcccggagcggtggagcgcgcggctgcctgcgtccatggtctagtggcagccgggcgcgtgaggagcggcaggccttgaggctgtcgtcgagggctcctccaccaccggccggctcccaagccagcgttgcgcagatgcacggccagctcagaggcggcctttcccgccatttttcacttcactgccgttacgccctcgctggaacctgaggcgccgagagggcgggacctgcaggacagtagccaatgaggtgcggggagggggccgggctggccaatgggagctgctttcctgagggactcgaaattctccggcgggtggtcgggagctggggctctgaggggctctagcggcgttgcgcgcggtgccggctgggtctgtaccaaaggtgtgaaggaaagaagacaccgaccacggcgaagcaatagagggggtgctggagcgcgagaggctggctgattgtgaccgaaaccagagggttgtccaccccgggcatctcatccctcaactgtaaaataatcgctaaggattccttcctgactttgaaaaaaaaaaaaaaaaaaaaaaaaaaaaaaaaaaaaaaaaaaaaaaaa

SEQ ID NO: 1079 - DNA, 1513 bp, Homo sapiens
gccgggcgctccatggccgcgccgtaacggggacccagccgcctccccgcccagcccagcccagcccttccgcccgcccaggatggaggcgcccgccagcgcgcagaccccgcacccgcacgagcccatcagcttcggcatcgaccagatccttaacagcccggaccaggacagcgcacccgccccgcggggccccgacggcgccagctacctgggagggccccccgggggccgtccgggcgccacatacccgtctctgcccgcctcctttgcgggcctcggcgcgcccttcgaggacgcgggatcttacagtgtgaacctgagcctagcgcccgcaggcgtgatccgggtgccggcgcacaggccgctgcccggggccgtgccaccgcctctgccaagcgcgctacccgccatgccctccgtgcccacggtctccagccttggcggtctcaatttcccctggatggagagcagccgccgcttcgtgaaagaccgcttcacagcggcggccgcactcacgcccttcaccgtgacccggcgcatcggccacccctaccagaaccggacgccgcccaagcgtaagaagccgcgcacgtccttttcccgggtgcagatctgcgagctggaaaagcgcttccatcgccagaagtacctggcctctgccgagagggcggcgctcgccaagtccctcaaaatgacggacgcgcaggtcaagacctggttccaaaaccggaggaccaagtggcggcggcagacggcggaggagcgggaggcggagcggcagcaggcgagccggctcatgctgcagctgcaacacgacgccttccaaaagagcctcaacgactccatccagcctgacccgctctgtctgcacaactcgtcactctttgctctgcagaatctgcagccctgggaggaggatagttccaaggttcccgctgtcacctccctggtgtgagcccaccagcgcgcaccgtcgccacggatcgccgcccccacccagccgggcgccccggaccccccaggagggctgcgggggaaccggcgccgagaggggaaggggccgcctagcccgagtaggccccagggcgcggccacagactggcgggccgcggaagggggtagggcccgagctccgcgcggccgcacaatccgagcccccgccccgcgccccgtcccgccccaggcccgggcctgacaagaaagcgccttacgtttctccgccccccgcccgcaccccccgggccgggcgcctgtattatactttgtacttttgcccaaacgtgtaaataataaaaaagttttggcttttttctttagaaaccggccacctgcttcccccgcgggggccgctggaggaagggcagccgacccggccgctgggggaagtgccaggggcccggggcaccctgcgtttaggctgggtccactcttcttctttttcgttccttttatttaagtctttttatttaataaaaaagttagctatttcaaaaaaaaaaaaaaaaaaaaa

SEQ ID NO: 1080 - DNA, 6895 bp, Homo sapiens
gtagatttggttgctgtgtacgtggaagaagcaagcgcatgcgcacatgggcccccttcgtctcagctgtgcgggaacggccgagggtaacatcccgggctcgcgggaggctgtcggggtaatggccacacgctgacagaaccagccgagtggaaaaggggagcgaagccgttcctctgcacccttccccaggcctgaggccttcccgcttggtgctgccgccgccactgccggctgaggaggggcgatgagttggttcaacgcctcccagctctccagcttcgctaagcaggccctgtcccaggcccagaagtctattgacagggttctggacatccaggaagaggagccgagcatctgggccgagaccattccgtatggagagccgggaataagttcccctgtcagtggaggatgggatacttcaacctgggggttgaaatcaaacactgaacctcagagtccaccaatagcctctcctaaagcaatcacaaagccagttcggaggactgtggtcgatgaatctgaaaatttcttcagtgcctttctctcgccaactgatgtccagaccattcagaagagtccagtggtatcaaaacctccagcaaaatcacaacgaccagaagaagaagtgaaaagcagcttacatgaatccttgcacattggccagtcaagaactcctgaaacaactgaatcacaagtaaaagactcttctttgtgtgtttcaggggaaactctggcagcaggtacttcatcacctaaaactgaaggcaagcacgaagaaactgttaataaagaatcggatatgaaggtgccaactgtaagtttgaaagtatctgaaagtgtaattgatgtgaaaacaactatggaaagtatatctaatacgtctacgcagtctctcacagcagaaacaaaggacatagctttggaacctaaggaacaaaaacatgaagacaggcagagcaatacaccttctcctcctgttagtaccttttcatcaggtacttctaccaccagtgatattgaagttttagatcatgaaagtgtaataagtgagagctcagcgagctcgagacaagagactacagattcaaaatcaagtcttcacttgatgcagacatcttttcagcttctctctgcatctgcttgtcctgaatataatcgtttagatgatttccaaaaactcactgagagttgctgttcatctgatgcttttgaaagaatagactcatttagtgtacagtcattagatagccggagtgtaagtgaaatcaattcagatgatgaattgtcaggcaagggatatgctttagtgcctattatagttaattcttcaactccaaagtctaaaacagttgaatctgctgaaggaaaatctgaagaagtaaatgaaacattagttatacccactgaggaagcagaaatggaagaaagtggacgaagtgcaactcctgttaactgtgaacagcctgatatcttggtttcttccacaccaataaatgaaggacagactgtgttagacaaggtggctgagcagtgtgaacctgctgaaagtcagccagaagcactttctgagaaggaagatgtttgcaagacagttgaatttctgaatgaaaagctggaaaaaagggaggctcagttattatctcttagtaaggaaaaagcacttctagaagaagcttttgataacctgaaagatgaaatgttcagagtgaaagaagaaagcagtagcatttcttccttgaaagatgagtttactcaaagaattgcagaagcagaaaagaaagttcaactagcctgcaaagagagagatgctgctaaaaaggaaatcaaaaacataaaagaagaacttgccactagattaaatagtagtgaaactgcagaccttttgaaagagaaagatgagcagatccgagggttaatggaagaaggagaaaaactttcaaaacagcagctgcacaattctaacatcatcaagaaattaagagctaaagacaaggagaatgaaaatatggttgcaaagctgaacaaaaaagttaaagagctagaagaggagttgcagcatttgaaacaggtccttgatggcaaagaagaggttgagaaacaacatagagaaaatattaaaaaactaaattccatggtagaacgccaagagaaagatcttggccgtcttcaggtagacatggatgaacttgaagaaaagaaccgaagtattcaggctgccctggatagtgcatacaaagaacttactgatcttcacaaagccaatgctgcaaaggatagtgaggcacaggaagctgctctgagccgtgaaatgaaagctaaagaagaactttctgcagcattagagaaggcccaagaagaagcccgtcagcagcaagaaacattagccattcaagtgggggaccttaggcttgcattgcagcgtacagaacaagcggctgccagaaaggaggattatttacgccatgagatcggtgaacttcagcagagactccaggaagcagagaatcgaaaccaggaactgagtcaaagtgtttcatcaacaacaagaccattgcttcgacaaatagaaaatttgcaagcaaccctgggatcccagacatcgtcgtgggagaaattagagaagaatctttctgataggcttggtgaatcccagaccttgctggcagcagcagttgagagagaacgtgcagctacagaagaactccttgctaacaaaattcagatgtcttccatggagtcacagaattctcttttaagacaggaaaacagtagatttcaagcccagctagaatcagagaaaaataggctgtgtaaactggaggatgagaacaataggtaccaggttgaattggaaaacctaaaagatgaatatgtaagaacacttgaagagacgaggaaagaaaagacattgttgaatagtcagttagaaatggaaagaatgaaagttgaacaagaaaggaagaaagccatttttactcaagaaacaataaaagaaaaggaacgcaagccattttctgtttctagcactcccaccatgtcacgctcaagttcaataagtggtgttgatatggcaggactacagacatcttttctgtctcaggatgagtctcatgatcactcatttggaccaatgcctatatcagcaaatggaagcaatctttatgatgctgtaaggatgggagcaggatcaagcataattgaaaacctacagtctcagctaaagctaagggaaggggaaatcactcatttacagctagaaattggcaatctagaaaaaactcgatcaataatggctgaagaactagttaaattaacaaatcaaaatgatgaacttgaagagaaggtgaaggagatacccaaacttagaactcagctaagagatttggatcaaaggtacaacactattctgcagatgtatggagaaaaagcagaagaggcagaagaacttcgattagatctcgaagatgtaaaaaatatgtacaaaactcaaatagatgaacttttaagacaaagtctcagttaacttgtgaaaattgaattcccatcaaactgaatgtaagcatttaatatctaaacatttaatgtggacttccaataaattcttttatagaattagaaagtgggatttactgtagagtgtaaaaatttttttaaaattgttttacactatgtagtaatatttacagttaaattattttgtgcaatatttgaactttatttttgaaactattctttaaagatttattttttaaagcattcattttttttccttgaatagcacagagatttattactttatcctcatataaatatggctagagaagaagaatggtgttcatatatgtattgtagatatacaactagttgtatctataatttgtaagtgtttatatatatattaagaacatttgaagagtaatgttaacatactgaaactttgaaatctttcacatttaaaatttcaacatatcttaattactgctcatgaaaatgtacattaagtgttaaagtaaaaaattattaaatctgtggctattaaattttaaactaatttttttcctttaaaagtaagagtcacactgacactgtctgaaatttaaagagtgaatgatttaaacttaaaaaaaattttgatctgaaaatttatttcacccagctttcacaattaagtctgtataaaatgtggtaccttttggtacctatccagagaaacctgtacatattcaatgttatctagatgtgattggataatggagaaaatttatttataatgattttgcaatggcatcaataacatttaaatgattttgaagaagtattattttactaccctataaaatgaatcgaaaataataaagttcttaacataatttactctttaaaaattacctgttcatattttgtaaacccatatttttagcacattaaaaatgaatgtttgatattacagaatattcataacaaaatggaagaattataggaattaacttgaatttggcatttttaattttgtgatttatcattttattttttcttgaaatttcaaacacaaggaaagcatagaatagcttttaaaagtagctatgccttcttccaaatgttattttattcaaaaaggtaaccaggttgtgttttaaacctgtgaaatattgtgatgcattttattactgaaagttatttaactgcctttacttgcacataaaaactctcatttacggccaggtgctgtggctcatgcctgtaatcccagcactttgggaggccaaggcgggcatatcacctgatgtcaggagttcaagaccagcatggccagcagtttggtgaaaccccatctctactaaaaatacaaaaattagcctggcgtggtggtgtgcgcctgtaatcctagctactcgggaggctgaggcaggagcattgcttgaacctgggaggtggaggttacaatgagccaagattgtgccactgcactccagcatgggtgacagagaaagactccgtctcaaaaaaaaaaaaacaaactcttatttaatttttagttaaaattaaaacactagtacttcagaatatagatacaagtacaccatcttgaagaatttggagtttttcagggcaattcaaatgacctcattttttgttctttttgtattccagacagtgtttctgtcattggatctctgattggtagtgttaataaatattctttcagtgtgagccagattcataaaattaattttcttcattttagtagtaaaaagtagtctaatagctttttgtcagcttgatttttttgtgtgtgtaatattcaagggcagaatgacaggacagataagcaataagaaatgtatagaattagaaaatatagtagttccctcttacccatgggacatacgttccaagacccccagtgaacgtctgaaaccatggatagtatagacacctctatacactgttttttcctatacatatatacctatgataaagttctatttataaatcagggacagcaagagataaacaataactgcaaatagaacaattataacagtgcactgtaataaaagtgatgtaaatgtgatatgtctgtctctttctctcaaaatatcttattgtactgtactcacctgtaatcagactgtggttgaccgtgagtaaccgaaaccacagaaagcaaaatcgtggataaggggagactactctatatgaaacttaagttacaaaattctctgaagcatttgaaactagacgttttggaattataaaatagtccctttaaaatatccactagtagaaaaaaacttcatttgcagagaaaagattgcaataaaactcattcctaaacttttcaattttataaaattaaacattctttttttatccgtattaacaatttctagttacatagtttctagttacatattaccatatattactctttatctacaaataaatagctgatactcaaactgatcatattttgattgttaaacacttggatctctcaatacttctgtaagttaaagtgaacttaaacagtttcttgaaaaactccagtaggtggcagaatacctattgaatattcgttgctatactttgctgtttgtcattaaaacatctctacccatattcttgcaaaataatatttatattttaatggataggaaaatgatttgcaattagatgtttccattcttgaaagaaaaaagctgcaaataacattttcaagaatataaaaaaatgagtaaacaaagggaaggttgtttggtcatttatagacaattaagcacagactgtagatgtccttccaattcttgggaggctaaactgagtctaccatttcttacatttcttttacctattttttgagaattgccagttgtacagtgtttagcatgtggaatgtaccaaatatatctatgttgtgacttaagatattctaaatgtggataacttctgacctaggaaacatgaagtttgtagtgaagtaagtgaaaagaatgttcaggaaattttttttctccatctcttcagttggcatttattgagagttttatttgaatgcttattaaaagtatatgatttataatatttagaaaatagaagaaaaaagaaaactgtagatgttttatcttgttttaatactgtatgtttagtacgtatacatttatgttctagtgtatcaaaatttttcattttcattaaagtgaatccaattttccatattctaggtccattttaaaccatgaaaactttaatcacatattttgtaaagggctgaaagtatgatttaaactacagattgatatattttaattctaaatgaaaggtaatgtaaataagcatggatctgattgaataaagattttaaaatagtaaaaaaaaaaaaaaaaaa

SEQ ID NO: 1081 - DNA, 6985 bp, Homo sapiens
attgtccgatggttcccggcgtacctcggcttccctcggtagtttccggcaatggtcgagagtttctaacgtgcccccttgttgtctctcggccgccgtcctctcaaccaccgccccccttttcggctccctctcccccttcccgttcccccagtcagcctggccctgctggtgcctccggcgctacgggctgggcaagatggcggccttcgggatcttgagctacgaacaccggcccctgaagcggccgcggctggggcctcccgatgtttaccctcaggaccccaaacagaaggaggatgaactgacggccttgaatgtaaaacaaggtttcaataaccagcctgctgtctctggggatgagcatggcagtgccaagaacgtcagcttcaatcctgccaagatcagttccaacttcagcagcattattgcagagaaattacgttgtaatacccttcctgacactggtcgcaggaagccccaagtgaaccagaaggataacttctggctggtgactgcacgatcccagagtgccattaacacttggttcactgacttggctggcaccaagccactcacgcaactagccaaaaaggtccccattttcagtaagaaggaagaggtgtttgggtacttagccaaatacacagtgcctgtgatgcgggctgcctggctcattaagatgacctgtgcctactatgcagcaatctctgagaccaaggttaagaagagacatgttgaccctttcatggaatggactcagatcatcaccaagtacttatgggagcagttacagaagatggctgaatactaccggccagggcctgcaggaagtgggggctgtggttccacgatagggcccttgccccatgatgtagaggtggcaatccggcagtgggattacaccgagaagctggccatgttcatgtttcaggatggaatgctggacagacatgagttcctgacctgggtgcttgagtgttttgagaagatccgccctggagaggatgaattgcttaaactgctgctgcctctgcttctccgatactctggggaatttgttcagtctgcatacctgtcccgccggcttgcctacttctgtacacggagactggccctgcagctggatggtgtgagcagtcactcatctcatgttatatctgctcagtcaacaagcacgctacccaccacccctgctcctcagcccccaactagcagcacaccctcgactccctttagtgacctgcttatgtgccctcagcaccggcccctggtttttggcctcagctgtatcctacagaccatcctcctgtgctgtcctagtgccttggtttggcactactcactgactgatagcagaattaagaccggctcaccacttgaccacttgcctattgccccgtccaacctgcccatgccagagggtaacagtgccttcactcagcaggtccgtgcaaagttgcgggagatcgagcagcagatcaaggagcggggacaggcagttgaagttcgctggtctttcgataaatgccaggaagctactgcaggcttcaccattggacgggtacttcatactttggaagtgctggacagccatagttttgaacgctctgacttcagcaactctcttgactccctttgtaaccgaatctttggattgggacctagcaaggatgggcatgagatctcctcagatgatgatgctgtggtgtcattgctatgtgaatgggctgtcagctgcaagcgttctggtcggcatcgtgctatggtggtagccaagctcctggagaagagacaggcggagattgaggctgagcgttgtggagaatcagaagccgcagatgagaagggttccatcgcctctggctccctttctgctcccagtgctcccattttccaggatgtcctcctgcagtttctggatacacaggctcccatgctgacggaccctcgaagtgagagtgagcgggtggaattctttaacttagtactgctgttctgtgaactgattcgacatgatgttttctcccacaacatgtatacttgcactctcatctcccgaggggaccttgcctttggagcccctggtccccggcctccctctccctttgatgatcctgccgatgacccagagcacaaggaggctgaaggcagcagcagcagcaagctggaagatccagggctctcagaatctatggacattgaccctagttccagtgttctctttgaggacatggagaagcctgatttctcattgttctcccctactatgccctgtgaggggaagggcagtccatcccctgagaagccagatgtcgagaaggaggtgaagcccccacccaaggagaagattgaagggacccttggggttctttacgaccagccacgacacgtgcagtacgccacccattttcccatcccccaggaggagtcatgcagccatgagtgcaaccagcggttggtcgtactgtttggggtgggaaagcagcgagatgatgcccgccatgccatcaagaaaatcaccaaggatatcttgaaggttctgaaccgcaaagggacagcagaaactgaccagcttgctcctattgtgcctctgaatcctggagacctgacattcttaggtggggaggatgggcagaagcggcgacgcaaccggcctgaagccttccccactgctgaagatatctttgctaagttccagcacctttcacattatgaccaacaccaggtcacggctcaggtctcccggaatgttctggagcagatcacgagctttgcccttggcatgtcataccacttgcctctggtgcagcatgtgcagttcatcttcgacctcatggaatattcactcagcatcagtggcctcatcgactttgccattcagctgctgaatgaactgagtgtagttgaggctgagctgcttctcaaatcctcggatctggtgggcagctacactactagcctgtgcctgtgcatcgtggctgtcctgcggcactatcatgcctgcctcatcctcaaccaggaccagatggcacaggtctttgaggggctgtgtggcgtcgtgaagcatgggatgaaccggtccgatggctcctctgcagagcgctgtatccttgcttatctctatgatctgtacacctcctgtagccatttaaagaacaaatttggggagctcttcagcgacttttgctcaaaggtgaagaacaccatctactgcaacgtggagccatcggaatcaaatatgcgctgggcacctgagttcatgatcgacactctagagaaccctgcagctcacaccttcacctacacggggctaggcaagagtcttagtgagaaccctgctaaccgctacagctttgtctgcaatgcccttatgcacgtctgtgtggggcaccatgatcccgatagggtgaatgacatcgcaatcctgtgtgcagagctgaccggctattgcaagtcactgagtgcagaatggctaggagtgcttaaggccttgtgctgctcctctaacaatggcacttgtggtttcaacgatctcctctgcaatgttgatgtcagtgacctatcttttcatgactcgctggctacttttgttgccatcctcatcgctcggcagtgtttgctcctggaagatctgattcgctgtgctgccatcccttcactccttaatgctgcttgtagtgaacaggactctgagccaggggcccggcttacctgccgcatcctccttcaccttttcaagacaccgcagctcaatccttgccagtctgatggaaacaagcctacagtaggaatccgctcctcctgcgaccgccacctgctggctgcctcccagaaccgcatcgtggatggagccgtgtttgctgttctcaaggctgtgtttgtacttggggatgcggaactgaaaggttcaggcttcactgtgacaggaggaacagaagaacttccagaggaggagggaggaggtggcagtggtggtcggaggcagggtggccgcaacatctctgtggagacagccagtctggatgtctatgccaagtacgtgctgcgcagcatctgccaacaggaatgggtaggagaacgttgccttaagtctctgtgtgaggacagcaatgacctgcaagacccagtgttgagtagtgcccaggcgcagcgcctcatgcagctcatttgctatccacatcgactgctggacaatgaggatggggaaaacccccagcggcagcgcataaagcgcattctccagaacttggaccagtggaccatgcgccagtcttccttggagctgcagctcatgatcaagcagacccctaacaatgagatgaactccctcttggagaacatcgccaaggccacaatcgaggttttccaacagtcagcagagacagggtcatcttctggaagtactgcaagcaacatgcccagcagcagcaagaccaagcctgtgctcagctctctagagcgctctggtgtatggctggtggcccccctcattgctaaactgcccacctcagtccagggacatgtgttaaaggctgctggggaagaattggagaagggtcagcacctgggttcctcttcacgcaaagaacgtgatcgacaaaagcagaagagcatgtccctattgagccagcagcccttcttatcgctggtgctaacatgtctgaaagggcaggatgaacaacgcgagggactccttacctccctctacagccaggtgcaccagattgtgaataattggcgagatgaccagtacttagatgattgcaaaccaaagcagcttatgcatgaggcactcaaactgcggctcaacctggtggggggcatgtttgacacggtgcagcgcagcacccagcagaccacggagtgggccatgctcctcctggagatcatcatcagcggcactgtcgacatgcagtccaacaatgagctcttcactactgtgttggacatgctgagcgtgctcatcaatgggacattggctgcagacatgtctagcatctcgcaaggtagcatggaggaaaacaagcgtgcatacatgaacctggcgaagaagttgcagaaggagttgggggagcgccagtcagacagtctggaaaaggttcgccagctgctgccactgcccaagcagacccgagatgtcatcacgtgtgagccacagggctcccttatcgataccaagggcaacaagattgctggcttcgattccatcttcaagaaggagggtctacaggtttccaccaaacagaagatctcgccctgggatctttttgaggggttgaagccgtcagcaccactctcttggggctggtttggaacagtccgagtggaccggcgagtggctcgaggagaggagcagcagcggttgctgctctaccacacacacctgaggccccggccccgcgcctattacctggagccactgccactgcccccagaagatgaggagccgcctgctcctaccctgctagagcctgagaaaaaggctccagagccccccaaaactgacaaaccgggggctgctccacccagtactgaggaacgcaagaagaagtccaccaagggcaagaaacgcagccagccagctaccaagacagaggactatggaatgggcccgggtcggagcggcccttatggtgtgacagtgcctccggacctcctgcaccacccaaaccctggttctataacacaccttaactacaggcaaggctccataggcctgtacacccagaaccagccactacctgcaggtggccctcgtgtggacccataccgtcctgtgcgcttaccaatgcagaagctgcccacccgaccaacttaccctggagtgctgcccacaaccatgactggcgtcatgggtttagaaccctcctcttataagacctctgtgtaccggcagcagcaacctgcggtgccccaaggacagcgccttcgccaacagctccagcagagtcagggcatgttgggacagtcatctgtccatcagatgactcccagctcttcctacggtttgcagacttcccagggctatactccttatgtttctcatgtgggattgcagcaacacacaggccctgcaggtaccatggtgccccccagctactccagccagccttaccagagcacccacccttctaccaatcctactcttgtagatcctacccgccacctgcaacagcggcccagtggctatgtgcaccagcaggcccccacctatggacatggactgacctccactcaaaggttttcacaccagacactgcagcagacacccatgataagtaccatgactccaatgagtgcccagggcgtccaggcaggcgtccgttcaacagccatcctacctgagcagcagcagcagcagcaacagcagcaacagcaacagcagcagcagcagcaacagcaacagcagcagcagcagcagcagtaccacatccggcagcagcagcagcagcagatcctgcggcagcagcagcaacagcaacagcagcagcagcagcagcagcaacagcaacagcagcagcagcaacagcaacaacagcaacaccagcagcaacagcagcaacaggcggctcctccccaaccccagccccagtcccagccccagttccagcgccaggggcttcagcagacccagcagcagcaacagacagcagctttggtccggcaacttcaacaacagctctctaatacccagccacagcccagtaccaacatatttggacgctactgagccacctggaggaactgcttgtgcactggatgtggccccaccctttcctcttaattcccaatcccattcctgggctagcaccagtagtggttggggccctcccctcaggctccatttttaataagtttttagtatttttgttaatgtgaggcattgagctgttgggttttgtatattatttatatagagaccccagagctgttgcacccaatacacagagcttctttgcaaagggaaaaaaaaaaaaaaaaa

SEQ ID NO: 1082 - DNA, 1859 bp, Homo sapiens
gaattccaaattcctctgcagaggctcacaccccatggtgactgtcgctggagataaggtctttaaggaggcaatcatggtaatatggcagcttaagggtgggaccctcatccaacaagactggtgtcctcctgagaacggaaaaacactgaagaccacacacacggaaaagaccaggtgaggcacagaatgggaagaagccaaacctgccagtgccttgatcatggactctcaacctccagaactgtgagaaaatacgtttgggcctcccagtctgtggtattttgtcgtggcagcccgagctgactaacgtaggcgccaagcccctccagagccacgtggcacccgtggctgatcagcctgccatgctggcagatctaccctgtagggccaaaaatgcttctacctgcaactgcccatcaataacatctgcatggctgtttgcagagggcaaccaaagaagaaagttcagtcccactgcaccaacccagctgatggaacagagtcccacatggcactctcctaaactgggcagcgacgccacttacttccagaatacagggaagattctgaagcctgccggggagctgagtggacccgcatgcactcactcatccactccacaggcatttgtcccaggggctccaggtatgatgggaagccagggtgcacagggccagaggcgacaaacacattcctgccgggtcccagagaacggaggctggccaggaatacgggcggcatgaactacgctcaggctgcaggtgccaagcacttacacttgtttcctttggagtaaagctagaggaaacagaggctccaaattcaaaaggctttcctgaaagcacacagctagaaagaagctgcaccagacttcacttgaggactcttcttagacatgacatatactgcctctcaacaagcagctgtactgtggaggagaaagtagaaaagtgccacaagagatttaaaaaaaataataataatgctcctgggcctgagacagggaaggagtacagcatttctgttttatttctgggggctggggagcagagcagaacattcaggaaagacattcattctgcaagcatttactggggatatactattcgccaggcatgcatgtaaaagaggagccacgtgcccagagggatgggaagacagcacgttccaaccatgaagtcggggagcagaaggaagcacaggtgagggagagtccatgggaactggcgggccagcagcagcagcagcagcagcagcagcagcagcagcagaggagcccatgcggcaggaacaggagcccatacctgagcactgaggcacccagccacctgtcacgatactcggaggactgggctacagaggccgcacaccccagcaaccaacttctccccgctcctagcaggcccttaagtcgctgttgctgagctcccctcacccccttaaatatctctttcccaccaagatgcaaaaggcaacaccatcctctagcatttgcccagctctgtgcgtgtttaatttccttactatttgcaagaagtcattcaaaatgttgacagcatcttaacagtttgcacatgatatatctgcacatcttacaggttagcatccgtgtcaaaagtcaccaatgaacacatcacaatctctccatttccattctctttcaaaggctgcagaatgtctggttcaacactaagcagacttttttccgcaaaattacaaggaaacactgaacaagggcagatgcacaaaatgatacccatgacgcctgacaaacaactccgtgttgacagaacagctcgaggcccttccccattccagtggatcagcgctgttattgccagctcagtatggaattc

SEQ ID NO: 1083 - DNA, 1240 bp, Homo sapiens
accgtgcactcgccagacatataccgcgtggtggtggagggtgagcggggcaaccggccccacatctactgtctggagcagttgctgcaggaggcgatcatcgatgtgaggccagcctccactcgcttcttgccacaagggaccaggattgcagcctactggagccagcagtaccgctgtctctacccaggcactgtggtccgagggttactggacctggaggacgatggggacttgatcaccgtggagtttgacgacggagacacgggcaggatccccctctcacatatccgcctcctgccccctgactataagatacagtgtgctgagccgcccccggcccttctggtgccaagtgccaagcgccgcagccggaagaccagcaaagacactggggagggcaaagatggtggcacggctgggtcggaggagccaggagccaaggcccgtgggcgtgggcggaaacccagcgccaaggccaagggtgacagagccgctaccctggaggaggggaacccaacagacgaggtccccagtacccccttagccctggagccgagcagcaccccaggttccaagaagagccccccagagcctgtggacaagcgagccaaggcccccaaggcgcgcccggcaccgccgcagcccagtcccgcaccacccgccttcaccagctgcccagcacccgagtcatttgcagagctgccagctcctgccacctccctggccccagcacccctcatcaccatgcctgccacacgccccaagcccaagaaggcgcgggcagccgaggagtcgggtgccaagggccctcggaggccgggggaggaggccgagctgcttgtcaaactggaccacgagggtgtcacgtcacccaaaagcaagaaggctaaagaggccctgctgctccgggaggatccgggggcggggggctggcaggagcccaagagcctcctgagcctgggcagctatccccccgcggccggcagcagcgagcccaaggcaccctggcccaaggccaccgacggggacctcgcccaggagcccgggccggggctcacgttcgaggactctgggaaccccaagagcccagacaaggtccaggctgagcaggacggggccgaagagtccgagagcagcagcagcagcagtagtggcagcagtagcagcagcagcagcagcagcagcagcggctcggagacagaaggggaggaggaaggcgacaagaacggggacgggg

SEQ ID NO: 1084 - DNA, 533 bp, Homo sapiens
  modified_base (31)..(31): a, c, t, g, unknown or other
  modified_base (95)..(95): a, c, t, g, unknown or other
  modified_base (256)..(256): a, c, t, g, unknown or other
  modified_base (346)..(346): a, c, t, g, unknown or other
  modified_base (374)..(374): a, c, t, g, unknown or other
  modified_base (392)..(392): a, c, t, g, unknown or other
  modified_base (435)..(435): a, c, t, g, unknown or other
  modified_base (455)..(455): a, c, t, g, unknown or other
  modified_base (513)..(513): a, c, t, g, unknown or other
  modified_base (515)..(515): a, c, t, g, unknown or other
  modified_base (520)..(520): a, c, t, g, unknown or other
agtagatatacattgcataggcagcaacagnaatattctggtggggctggatccctggctggcccttcagggggcttcttccctggcaaccttgntcttcgaagcctcggacctgattcaaggtttttacaggaaaggcagctgcagctgcagcagcaacgtatgcagctggcccagaaactgcagcagcagcagcagcagcaacagcagcagcagcaccttctaggacaggtggcaatccagcagcaacagcagnagggtcctggagtacagacaaaccaagttctgggtcccaagccccagggtcttatgcctcccagcagccaccaaggtctcctggtccagnaggtgtcccctcaacccaccccaggggncccagggtatgcttgggncctgccccaggttggcttgttgttgcagcagcagcaccctggngctttggggccccccagggncctcacaggacaggtgttttatgacccagtcccgggtggtcaagttcccccctaggtngnacagnagggtcaagggcc

SEQ ID NO: 1085 - DNA, 2013 bp, Homo sapiens
  modified_base (301)..(301): a, c, t, g, unknown or other
  modified_base (1707)..(1707): a, c, t, g, unknown or other
  modified_base (1722)..(1722): a, c, t, g, unknown or other
  modified_base (1756)..(1756): a, c, t, g, unknown or other
  modified_base (1880)..(1880): a, c, t, g, unknown or other
  modified_base (1882)..(1882): a, c, t, g, unknown or other
  modified_base (1885)..(1885): a, c, t, g, unknown or other
  modified_base (1887)..(1887): a, c, t, g, unknown or other
gaattccaatcagaacaagctgttctcagacattaatctgaatgatcaggagtggcaagaattaatagatgaattggacaacacggttcctgaggatgacatacaggacctgttcaacgaagactttgaagagaagaaggagccagaattctcgcagacagcaactgagcacccctctctcccaggagagtgcgagcgtgaagagcgacccctctcactctcccttcggacatgtctccatgggatctccccaggcgaggtcttcttcttctggtcctcccttttcttctgtctccacggncactagtttaccttctggtgacagcactcccgcaggtccaaaccctgcaagctcaccagcaaacttgtgcttgtccagtccccttcaaaacttccaaaccaagcccacactccaggccaagctccacctcggcctggaaatggttatctcctgaatccggcagcagtgacagtggccggttcagcgtcagggcctgtggctgtgcccagctctgacatgtctccagcagaacagctcaaacagatggctgcacagcagcaacaaagggccaaactcatgcagcagaaacagcaacagcaacagcagcagcagcagcagcagcagcaacagcactcaaatcagacttcaaattggtctcccttaggacctccctctagtccatatggagcagcttttactgcagaaaaaccaaatagcccaatgatgtacccccaagcctttaacaaccaaaaccctatagtgcctccaatggcaaacaacctgcagaagacaacaatgaataactacctccctcagaatcacatgaatatgatcaatcagcagccaaataacttgggtacaaactccttaaacaaacagcacaatattctgacttatggcaacactaaacccctgacccacttcaatgcagacctgagtcagaggatgacaccaccagtggccaaccccaacaaaaaccccttgatgccgtatatccagcagcagcaacagcagcagcaacagcaacagcagcagcagcagcagcagcagccgccacctccacagctccaggcccccagggcacacctgagcgaagaccagaaacgcctgcttctcatgaagcagaaaggagtgatgaatcagcccatggcttacgctgcacttccatcccacggtcaggtaagtgtgaaagtgacacactcttcgagcagttcttgtggtgcatttcaagactgtcgatgtgtgatgttctacaaagcttccactgtagtggggtctaattgcctgcagaaaacctctttacaacatcctcaggtagtggccaggtttggagtgttctttttccatttctcctaagaaatggaaaagggtggcatgataaactttcgtgtatttcagtgtctaggaatcaaacttcttttattcccaactgcagataagaattacataaaattctcactctgagggagggaggctgcagaggtcactccaccaaacacggcactacctctgtagcttctctcccagcttgcatgatcccaggctctgggtggtgggaagcaggggacattcagggctgtctacaacagttttataaggccctgagcagccttcgagttttttaaattttattttagtgaatacatgcattaaaataaaacaacaacaacaacaacaacaaaaacacaaagaggctagagatttcnccgtttctacccccnaaataacgcttgctatcaagactttggagggggntgggggaaaagaatttaaaagccaaataatttttttttcataaaaagtaaaagctaccataaaacatttttttttctgtcacactgattaaatttcttctgaaaagccgcacatatagacaaancnaancnaaaattcctgaactggacaaacagcaaatactcaacagggttgttaacctaggtaacagttcagtagtttaaagaatcttttagacatctggaagcctttctattcattcctcagtacagtgttcc

SEQ ID NO: 1086 - DNA, 2586 bp, Homo sapiens
gattggggttttcccctcccatgtgctcaagactggcgctaaaagttttgagcttctcaaaagtctagagccaccgtccagggagcaggtagctgctgggctccggggacactttgcgttcgggctgggagcgtgctttccacgacggtgacacgcttccctggattggcagccagactgccttccgggtcactgccatggaggagccgcagtcagatcctagcgtcgagccccctctgagtcaggaaacattttcagacctatggaaactacttcctgaaaacaacgttctgtcccccttgccgtcccaagcaatggatgatttgatgctgtccccggacgatattgaacaatggttcactgaagacccaggtccagatgaagctcccagaatgccagaggctgctccccccgtggcccctgcaccagcagctcctacaccggcggcccctgcaccagccccctcctggcccctgtcatcttctgtcccttcccagaaaacctaccagggcagctacggtttccgtctgggcttcttgcattctgggacagccaagtctgtgacttgcacgtactcccctgccctcaacaagatgttttgccaactggccaagacctgccctgtgcagctgtgggttgattccacacccccgcccggcacccgcgtccgcgccatggccatctacaagcagtcacagcacatgacggaggttgtgaggcgctgcccccaccatgagcgctgctcagatagcgatggtctggcccctcctcagcatcttatccgagtggaaggaaatttgcgtgtggagtatttggatgacagaaacacttttcgacatagtgtggtggtgccctatgagccgcctgaggttggctctgactgtaccaccatccactacaactacatgtgtaacagttcctgcatgggcggcatgaaccggaggcccatcctcaccatcatcacactggaagactccagtggtaatctactgggacggaacagctttgaggtgcgtgtttgtgcctgtcctgggagagaccggcgcacagaggaagagaatctccgcaagaaaggggagcctcaccacgagctgcccccagggagcactaagcgagcactgcccaacaacaccagctcctctccccagccaaagaagaaaccactggatggagaatatttcacccttcagatccgtgggcgtgagcgcttcgagatgttccgagagctgaatgaggccttggaactcaaggatgcccaggctgggaaggagccaggggggagcagggctcactccagccacctgaagtccaaaaagggtcagtctacctcccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttctccctttttatatcccatttttatatcgatctcttattttacaataaaactttgctgccacctgtgtgtctgaggggtg

SEQ ID NO: 1087 - DNA, 4802 bp, Homo sapiens
gctggggcccgacccgggattagttggtttcggagcggaggagggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacctcagctcggccggggccgcagtctggccacccgcttccatgcggttcgggtccaagatgatgccgatgtttcttaccgtgtatctcagtaacaatgagcagcacttcacagaagttccagttactccagaaacaatatgcagagacgtggtggatctgtgcaaagaacccggcgagagtgattgccatttggctgaagtgtggtgtggctctgtagagatagagtttcatcatgttggccaggatggtctcgatctcctgaccttgtgatccgcctgcctcggcctcccaaagtgctggattacaggtgtgagccaccacgatcagcctctagtgtttaaaaaagaacgtccagttgcggataatgagcgaatgtttgatgttcttcaacgatttggaagtcagaggaacgaagttcgcttcttccttcgtcatgaacgcccccctggcagggacattgtgagtggaccaagatctcaggatccaagtttaaaaagaaatggtgtaaaagttcctggtgaatatcgaagaaaggagaacggtgttaatagtcctaggatggatctgactcttgctgaacttcaggaaatggcatctcgccagcagcaacagattgaagcccagcaacaattgctggcaactaaggaacagcgcttaaagtttttgaaacaacaagatcagcgacaacagcaacaagttgctgagcaggagaaacttaaaaggctaaaagaaatagctgagaatcaggaagctaagctaaaaaaagtgagagcacttaaaggccacgtggaacagaagagactaagcaatgggaaacttgtggaggaaattgaacagatgaataatttgttccagcaaaaacagagggagctcgtcctggctgtgtcaaaagtagaagaactgaccaggcagctagagatgctcaagaacggcaggatcgacagccaccatgacaatcagtctgcagtggctgagcttgatcgcctctataaggagctgcagctaagaaacaaattgaatcaagagcagaatgccaagctacaacaacagagggagtgtttgaataagcgtaattcagaagtggcagtcatggataagcgtgttaatgagctgagggaccggctgtggaagaagaaggcagctctacagcaaaaagaaaatctaccagtttcatctgatggaaatcttccccagcaagccgcgtcagccccaagccgtgtggctgcagtaggtccctatatccagtcgtctactatgcctcggatgccctcaaggcctgaattgctggtgaagccagccctgccggatggttccttggtcattcaggcttcagaggggccgatgaaaatacagacactgcccaacatgagatctggggctgcttcacaaactaaaggctctaaaatccatccagttggccctgattggagtccttcaaatgcagatcttttcccaagccaaggctctgcttctgtacctcaaagcactgggaatgctctggatcaagttgatgatggagaggttccgctgagggagaaagagaagaaagtgcgtccgttctcaatgtttgatgcagtagaccagtccaatgccccaccttcctttggtactctgaggaagaaccagagcagtgaagatatcttgcgggatgctcaggttgcaaataaaaatgtggctaaagtaccacctcctgttcctacaaaaccaaaacagattaatttgccttattttggacaaactaatcagccaccttcagacattaagccagacggaagttctcagcagttgtcaacagttgttccgtccatgggaactaaaccaaaaccagcagggcagcagccgagagtgctgctatctcccagcataccttcggttggccaagaccagaccctttctccaggttctaagcaagaaagtccacctgctgctgccgtccggccctttactccccagccttccaaagacaccttacttccacccttcagaaaaccccagaccgtggcagcaagttcaatatattccatgtatacgcaacagcaggcgccaggaaaaaacttccagcaggctgtgcagagcgcgttgaccaagactcataccagagggccacacttttcaagtgtatatggtaagcctgtaattgctgctgcccagaatcaacagcagcacccagagaacatttattccaatagccagggcaagcctggcagtccagaacctgaaacagagcctgtttcttcagttcaggagaaccatgaaaacgaaagaattcctcggccactcagcccaactaaattactgcctttcttatctaatccttaccgaaaccagagtgatgctgacctagaagccttacgaaagaaactgtctaacgcaccaaggcctctaaagaaacgtagttctattacagagccagagggtcctaatgggccaaatattcagaagcttttatatcagaggaccaccatagcggccatggagaccatctctgtcccatcatacccatccaagtcagcttctgtgactgccagctcagaaagcccagtagaaatccagaatccatatttacatgtggagcccgaaaaggaggtggtctctctggttcctgaatcattgtccccagaggatgtggggaatgccagtacagagaacagtgacatgccagctccttctccaggccttgattatgagcctgagggagtcccagacaacagcccaaatctccagaataacccagaagaaccaaatccagaggctccacatgtgcttgatgtgtacctggaggagtaccctccatacccacccccaccatacccatctggggagcctgaagggcccggagaagactcggtgagcatgcgcccgcctgaaatcaccgggcaggtctctctgcctcctggtaaaaggacaaacttgcgtaaaactggctcagagcgtatcgctcatggaatgagggtgaaattcaacccccttgctttactgctagattcgtctttggagggagaatttgaccttgtacagagaattatttatgaggttgatgacccaagcctccccaatgatgaaggcatcacggctcttcacaatgctgtgtgtgcaggccacacagaaatcgttaagttcctggtacagtttggtgtaaatgtaaatgctgctgatagtgatggatggactccattacattgtgctgcctcatgtaacaacgtccaagtgtgtaagtttttggtggagtcaggagccgctgtgtttgccatgacctacagtgacatgcagactgctgcagataagtgcgaggaaatggaggaaggctacactcagtgctcccaatttctttatggagttcaggagaagatgggcataatgaataaaggagtcatttatgcgctttgggattatgaacctcagaatgatgatgagctgcccatgaaagaaggagactgcatgacaatcatccacagggaagacgaagatgaaatcgaatggtggtgggcgcgccttaatgataaggagggatatgttccacgtaacttgctgggactgtacccaagaattaaaccaagacaaaggagcttggcctgaaacttccacacagaattttagtcaatgaagaattaatctctgttaagaagaagtaatacgattatttttggcaaaaatttcacaagacttattttaatgacaatgtagcttgaaagcgatgaagaatgtctctagaagagaatgaaggattgaagaattcaccattagaggacatttagcgtgatgaaataaagcatctacgtcagcaggccatactgtgttggggcaaaggtgtcccgtgtagcactcagataagtatacagcgacaatcctgttttctacaagaatcctgtctagtaaataggatcatttattgggcagttgggaaatcagctctctgtcctgttgagtgttttcagcagctgctcctaaaccagtcctcctgccagaaaggaccagtgccgtcacatcgctgtctctgattgtccccggcaccagcaggcccttggggggctcacctgaaggctcgaaggcactgcacacttgtatattgtcagtgaagaactgttagttggttgtcagtgaacaataactttattatatgagtttttgtagcatcttaagaattatacatatgtttgaaatattgaaactaagctacggtaccagtaattagatgtagaatcttgtttgtaggctgaattttaatctgtatttattgtcttttgtatctcagaaattagaaacttgctacagacttacccgtaatatttgtcaagatcatagctgactttaaaaacagttgtaataaactttttgatgctagctgtttactggtttttgtttttgatgtcataaatagaccttgtttaatagtcacaagccgttgggatatcatacccagctgaaaaagaacaaactgcttaacataagtatatgtatcgtaataagagttttttaccagctaagtgattcaatgtaagtggtttttaaaataaaatactgtagagatcatggtgaaaaaaaaaaaaaa

SEQ ID NO: 1088 - DNA, 4927 bp, Homo sapiens
cccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccactagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaattgaaaaaaaaaaaaaaaaaa

SEQ ID NO: 1089 - DNA, 2845 bp, Homo sapiens
aggggacgcagcgaaaccggggcccgcgccaggccagccgggacggacgccgatgcccggggctgcgacggctgcagagcgagctgccctcggaggccggcgtggggaagatggcccagtccaccgccacctcccctgatgggggcaccacgtttgagcacctctggagctctctggaaccagacagcacctacttcgaccttccccagtcaagccgggggaataatgaggtggtgggcggaacggattccagcatggacgtcttccacctggagggcatgactacatctgtcatggcccagttcaatctgctgagcagcaccatggaccagatgagcagccgcgcggcctcggccagcccctacaccccagagcacgccgccagcgtgcccacccactcgccctacgcacaacccagctccaccttcgacaccatgtcgccggcgcctgtcatcccctccaacaccgactaccccggaccccaccactttgaggtcactttccagcagtccagcacggccaagtcagccacctggacgtactccccgctcttgaagaaactctactgccagatcgccaagacatgccccatccagatcaaggtgtccaccccgccacccccaggcaccgccatccgggccatgcctgtttacaagaaagcggagcacgtgaccgacgtcgtgaaacgctgccccaaccacgagctcgggagggacttcaacgaaggacagtctgctccagccagccacctcatccgcgtggaaggcaataatctctcgcagtatgtggatgaccctgtcaccggcaggcagagcgtcgtggtgccctatgagccaccacaggtggggacggaattcaccaccatcctgtacaacttcatgtgtaacagcagctgtgtagggggcatgaaccggcggcccatcctcatcatcatcaccctggagatgcgggatgggcaggtgctgggccgccggtcctttgagggccgcatctgcgcctgtcctggccgcgaccgaaaagctgatgaggaccactaccgggagcagcaggccctgaacgagagctccgccaagaacggggccgccagcaagcgtgccttcaagcagagcccccctgccgtccccgcccttggtgccggtgtgaagaagcggcggcatggagacgaggacacgtactaccttcaggtgcgaggccgggagaactttgagatcctgatgaagctgaaagagagcctggagctgatggagttggtgccgcagccactggtggactcctatcggcagcagcagcagctcctacagaggccgagtcacctacagcccccgtcctacgggccggtcctctcgcccatgaacaaggtgcacgggggcatgaacaagctgccctccgtcaaccagctggtgggccagcctcccccgcacagttcggcagctacacccaacctggggcccgtgggccccgggatgctcaacaaccatggccacgcagtgccagccaacggcgagatgagcagcagccacagcgcccagtccatggtctcggggtcccactgcactccgccacccccctaccacgccgaccccagcctcgtcagttttttaacaggattggggtgtccaaactgcatcgagtatttcacctcccaagggttacagagcatttaccacctgcagaacctgaccattgaggacctgggggccctgaagatccccgagcagtaccgcatgaccatctggcggggcctgcaggacctgaagcagggccacgactacagcaccgcgcagcagctgctccgctctagcaacgcggccaccatctccatcggcggctcaggggaactgcagcgccagcgggtcatggaggccgtgcacttccgcgtgcgccacaccatcaccatccccaaccgcggcggcccaggcggcggccctgacgagtgggcggacttcggcttcgacctgcccgactgcaaggcccgcaagcagcccatcaaggaggagttcacggaggccgagatccactgagggcctcgcctggctgcagcctgcgccaccgcccagagacccaagctgcctcccctctccttcctgtgtgtccaaaactgcctcaggaggcaggaccttcgggctgtgcccggggaaaggcaaggtccggcccatccccaggcacctcacaggccccaggaaaggcccagccaccgaagccgcctgtggacagcctgagtcacctgcagaaccttctggagctgccctagtgctgggcttgtggggcgggggctggcccactctcagccctgccactgccccggcgtgctccatggcaggcgtgggtggggaccgcagcgtcggctccgacttccaggcttcatcctagagactgtcatctcccaaccaggcgaggtccttccaaaggaaaggatcctctttgctgatggactgccaaaaagtattttgcgacatcttttggttctggatagtagtgagcagccaagtgactgtgtctgaaacaccagtgtattttcagggaatgtccctaactgcgtcttgcccgcgccgggggctggggactctctctgctggacttgggactggcctctgcccccagcacgctgtattctgcaggaccgcctccttcctgcccctaacaacaaccacagtgttgctgaaattggagaaaactggggagggcgcaaccccccccaggcgcggggaagcatgtggtaccgcctcagccagtgcccctcagcctggccacagtcgcctctcctcggggacccctcagcagaaagggacagcctgtccttagaggactggaaattgtcaatatttgataaaatgatacccttttc

SEQ ID NO: 1090 - DNA, 4447 bp, Homo sapiens
ggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggatctcgctcttctcgctcaagatctgcatcaagatctcgttctcgttcattttcgaagtctcggtcccgaagccgatctctctctcgttcaaggaagcgcaggctgagttctaggtctcgttccagatcatattctccagctcataacagagaaagaaaccacccaagagtatatcagaatcgggatttccgaggtcacaacagaggctatagaaggccctattatttccgtgggcgtaacagaggcttttatccatggggccaatataaccgaggaggctatggaaactaccgctcaaattggcagaattaccggcaagcatacagtcctcgtcgaggccgttcaagatcccggtccccaaagagaaggtccccttcaccaaggtccaggagccattctagaaactctgataagtcgtcttctgaccggtcaaggcgctcctcatcctcccgttcttcctccaaccatagccgagttgaatcttctaagcgcaagtctgcaaaggagaaaaagtcctcttctaaggatagccggccatctcaggctgccggggataaccagggagatgaggccaaggagcagacattctctggaggcacctctcaagatacaaaagcatctgagagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataaggaacagaaacaaacaaataccgataaagaaaaaataaaagagaaagggagcttctctgacacaggcttgggtgatggaaaaatgaaatctgattcttttgctcccaaaactgattctgagaagccttttcggggcagtcagtctcccaaaaggtataagctccgagatgactttgagaagaagatggctgacttccacaaggaggagatggatgatcaagataaggacaaagctaagggaagaaaggaatctgagtttgatgatgaacccaaatttatgtctaaagtcataggtgcaaacaaaaaccaggaggaggagaagtcaggcaaatgggagggcctggtatatgcacctccagggaaggaaaagcagagaaaaacagaggagctggaggaggagtctttcccagagagatccaaaaaggaagatcggggcaagagaagcgaaggtgggcacaggggctttgtgcctgagaagaatttccgagtgactgcttataaagcagtccaggagaaaagctcatcacctcccccaagaaagacctctgagagccgagacaagctgggagcgaaaggagattttcccacaggaaagtcttccttttccattactcgagaggcacaggtcaatgtccggatggactcttttgatgaggacctcgcacgacccagtggcttattggctcaggaacgcaagctttgccgagatctagtccatagcaacaaaaaggaacaggagtttcgttccattttccagcacatacaatcagctcagtctcagcgtagcccctcagaactgtttgcccaacatatagtgaccattgttcaccatgttaaagagcatcactttgggtcctcaggaatgacattacatgaacgctttactaaatacctaaagagaggaactgagcaggaggcagccaaaaacaagaaaagcccagagatacacaggagaatagacatttcccccagtacattcagaaaacatggtttggctcatgatgaaatgaaaagtccccgggaacctggctacaaggctgagggaaaatacaaagatgatcctgttgatctccgccttgatattgaacgtcgtaaaaaacataaggagagagatcttaaacgaggtaaatcgagagaatcagtggattcccgagactccagtcactcaagggaaaggtcagctgaaaaaacagagaaaactcataaaggatcaaagaaacagaagaagcatcggagagcaagagacaggtccagatcctcctcctcttcctcccagtcatctcactcctacaaagcagaagagtacactgaagagacagaggaaagagaggagagcaccacgggctttgacaaatcaagactggggaccaaagactttgtgggtccaagtgaaagaggaggtggcagagctcgaggaacctttcagtttcgagccagaggaagaggctggggcagaggcaactactctgggaacaataacaacaacagcaacaacgattttcaaaaaagaaaccgggaagaggagtgggacccagagtacacacccaaaagcaagaagtattacttgcatgatgaccgtgaaggcgaaggcagtgacaagtgggtgagccggggccggggccgaggagcctttcctcggggtcggggccggttcatgttccggaaatcaagtaccagccccaagtgggcccatgacaagttcagtggggaggaaggggagattgaagacgacgagagtgggacagagaaccgagaagagaaggacaatatacagcccacaaccgagtaggggccacccttgacgggattcctgcccaggggagagaggcgctgggaagatggctggtgaggagcttaacagaggaacctcaagaagattctgaaaatcctacccccaccccccaccagccgcacagattgtactaccgcgagaggcatccctggcgctgtctcccactggacagaggaggctggccatggggcccaggggtcaggcccagcttttgagcagaatacaacgcattgggctttagctgtttttctcatttgttggtgtgtggggtgggggcaggggtagggcgggagagcgatgcttggatttttgtttcctattagaaaccaacagttttgttctaatttcatttcatttggagctaagatgactaatttgatgattttcgatctcttttcccctgtcctgattttaaaagccccctcctttttttttttttttttctttttttaggcatatgtagtaatattagaaacatttaatttgggaaactttgattcttgaaagagaaaacaaaagcatgtgaataaactttgaagtgttcacctcagtttgggaccaaactgcttggatctttgtaaaaaccggttttgtatgtcaaggaggagtttaaggcctttccgaccaccttgtgttccccttttctgcgcagccatgtatcacgtggagttgctccttaccacacctcacgtgcccctgagccctatttcctgatttcttctgggctggacttccccgttctccaccagcagctccagtatcccaaactttctagtcctgctgatcctcccagcaacggggtggaaactggagggcagtgtctggtctgttttctaagaaacttatgaattctattatctttacaaatatgagaaaattttttcaatattttttattaatctttttataaaatgaaaagaaactcctatgatcgattaaggaaggtggttatggctgggtggttcaggggtttttttgggtttctttttttttttctttgtctttttaaccttaagctgtttaagttgaagcattctcagatgtttggggggaaacatcctcttaaaatgggtccttgtgcttgccttctggggaggcggtcctgagcaggtgaatcataaggcatttatgcatatgttatatgcggactgcacccacctctcccccccagcctttgcctcttgcgttgttgtgctgctttccccttactttgctacatttctatagttaagttggttttacttgaatgattcatgtttagggggaaaatgaaaatctcccttaaaatttgtttcaactcctcctgcaaataaaataaatgaagtggcagatgtaaaaaaaaaaaaaaaaaa

SEQ ID NO: 1091 - DNA, 2952 bp, Homo sapiens
cagaagtctttgggaggcggccccacgcctcaggcgactggttgttaccgaggaagatggcggcgccagacccgaggcgctagggaagatcgcaccgcggacgcccgctgagcttggcgcacgggccgaccaggagctggtgactgccctcatgtgtgatttgcggcggccagcggcaggtgggatgatggacttggcctacgtctgtgagtgggagaaatggtccaagagcacccactgcccatcggtgcccctggcctgcgcctggtcctgccgaaatctcatcgccttcaccatggacctgcgcagcgatgaccaggacctgacccgcatgatccacatcctggacacggagcacccctgggacctgcactcgatcccctcagagcaccacgaggccatcacctgcctggagtgggaccagtcaggctcccggctcctgtcagcagatgccgacgggcagatcaagtgctggagcatggcggaccacctggctaatagctgggagagctcagtgggcagcctagtggagggggaccccattgtggccctgtcctggctgcacaatggtgtgaaactggccctgcacgtggagaagtcgggcgcctccagcttcggggagaagttctcccgagtcaagttctcaccgtcgctcacgctgttcggcggcaagcccatggagggctggatcgcggtgacggtcagcggcctggtcaccgtgtccctgctgaagcccagcgggcaggtgctgacgtccaccgagagcctgtgccggctgcgcggccgcgtggccctggccgacatcgccttcaccggcggcggcaacatcgtggtggccacggcggacggcagcagcgcgtcgcccgtgcagttctacaaggtgtgcgtgagcgtggtgagcgagaagtgccgtatcgacacggagatcctgccctccctgttcatgcgctgcaccaccgacctcaaccgcaaggacaagtttcccgccatcacccacctcaagttcctggcccgggacatgtcggagcaggtgcttttgtgcgcgtccagccagaccagcagcatcgtggagtgctggtccctgcgcaaggagggactccccgtgaacaacatcttccagcagatctcccccgtggttggcgacaaacagcccacaattctcaaatggcggatcctatcggccaccaacgatctggaccgtgtgtcggccgtggcgctgcccaagctgcccatctcgctcaccaacaccgacctcaaggtggccagcgacacacagttctaccctggcctcgggctggccctggccttccacgacggcagcgtccacatcgtgcaccggctctcactgcagaccatggccgtcttctacagctccgcggccccgaggcctgtggatgagccggccatgaagcgcccccgcaccgcgggccccgccgtccacttaaaggctatgcagctatcgtggacgtcactggccctggtggggattgacagccacgggaagctgagcgtgctccgcctctcaccttccatgggccacccgctggaggtggggctggcgctgcggcacctgctcttcctgctggagtactgcatggtgaccggctacgactggtgggacatcctgctgcacgtgcagcccagtatggtacagagcctggtggagaagctgcacgaggagtacacgcgccagaccgctgccctgcagcaggtcctctccacccggatcctggccatgaaggcctcgctctgcaagctgtcgccctgcacggtgacccgcgtgtgcgactaccacaccaagctcttcctcatcgccatcagctccaccctgaagtcgctgctgcgcccccactttctcaacacgcctgacaagagccccggcgaccggctgaccgagatctgcaccaagatcaccgacgtcgacattgacaaggtcatgatcaacctcaagacggaggaatttgtgctggacatgaacacactgcaggcgctgcagcagctcttgcagtgggtgggcgacttcgtgctgtacctgctggccagcctacccaaccagggttccctgctgaggccgggccacagctttctgcgggacggcacctcgctgggcatgcttcgggaattgatggtggtcatccgcatctggggccttctgaagcccagctgcctgcccgtgtatacggccacctcggatacccaggacagcatgtccctgctcttccgcctgctcaccaagctctggatctgctgtcgcgatgagggcccagcgagcgagccggacgaggcgctggtggatgaatgctgcctgctgcccagccagctgcttatccccagcctggactggctgccagccagcgacggcctggttagccgcctgcagcccaagcagccccttcgtctgcagtttggccgggcgcccacgctgcctggcagtgctgccaccctgcagctcgacggcctcgccagggccccaggccagcccaagatcgaccacctgcggaggctgcaccttggcgcttgccccacggaggaatgcaaggcctgcaccaggtgcggctgtgtcaccatgctcaagtcgcccaacagaaccacggcggtgaagcagtgggagcagcgctggatcaagaactgcctggctgttgaaggccgtgggccggacgcctgcgtgaccagcagagcttctgaggaagcccctgcctttgtccagctgggcccgcagtccacacaccactctcccaggacccccagatccctggaccatctgcatccagaggaccgtccgtgacggccgggggtccaggcggaccttgtggtgacccggctcgggcgtctcctcggtttccttgcctcacccgcggagagcgctgaacctggacaagcagcggctgggaaggacaggtccaataaacgccctctgcgcccagaaaaaaaaaaaaaaaaaaaaaaaaaaaa

SEQ ID NO: 1092 - DNA, 3962 bp, Homo sapiens
ctctgctcgccccccatctcaccccccaagcggatactggtcttctcgtcggattgcccatgcacttgttgcagaaacagccaaggccctggctgtggagaatgctgaaggaagaagacgcagaagcaggacgaccctgaaagattcagcctcttcatcctcaaacaggtcgcttctcgggagttcttggtgttggaatattttacagcaaagcagtcgaccaggcctcctcttcccacctgtccagcagcatgaaagcagcatgattggccgaccgcaggagaagcccccagaaccaggcccccaactcagccatctgcggaggtcaaggtgtgagcgacgtctcctcaccacagtgctgtgtggtctatacctcagccagggagaggatgtgaaaccccccgccctgcacatgagtggtacaggccaacaggaacacctggctccagccacgttcacagacatgtcagccgtggagtagtgctgacacttttctctcagcttctcagggtttcagtccttttgggtttggtttatttaccttttttatggttttgtggctggacgttcacaaccaaggcagacagcatgggtgaccagcaactgtacaagaccaaccatgtggcccatggtagtgagaaccttttctaccaacagccaccacttggcgtccacagcgggctgagcccactgatggctaccaatacacctactcccaggccagcgagatccggacccagaagcttaccagcggtgtcttacacaagctggactctttcacccaggtgtttgccaaccaaaacctgcgaattcaggtcaacaatatggcccaggtgctgcacactcagtcagcagtgatggatggagcccctgacagtgctctccgccagctgctgtctcagaagcccatggagcccccagcaccggctatcccttcccgctaccagcaggtgccccagcagcctcaccctggtttcactggtgggctgtccaaaccagctcttcaggtcgggcagcaccctacccaagggcacctgtattatgactaccagcagcctctggctcaggtgccagtgcagggaggacagccactgcaggccccacagatgctgtcacagcacatgcaacagatgcagcagcaccagtattacccaccgcagcaacagcagcaagccgggcaacagcgtatctccatgcaagaaatacagacgcagccgcaacaaattcgcccatcacagccacagccgccgccacagcagcagcagccgcagcagctacagctgcagcagcggcagggttcaatgcagatacctcagtattatcagccccaacccatgatgcagcacttgcaagagcagcagcagcaacagatgcacctgcagcctccttcttatcacagggaccctcaccagtataccccagagcaggcacacactgtccagctgattcccctgggctccatgtcccagtactactaccaggagccccagcagccctacagccaccccctttaccagcagagccacctgtcccagcaccagcagcgtgaggacagtcagctgaagacctactctagtgacagacaggcccaggccatgctgagctcccatggggacctggggcctcctgacacaggaatgggagacccagcgagctcagatctgacccgggtcagcagcaccctcccccatcgccccctcctatcccccagtgggatccacctcaacaacatggggcctcagcatcagcagctgtctcccagtgccatgtggccccagatgcacctacctgatgggagagcccagccagggtcccctgagtcaagtggccaacccaaaggagcgtttggggagcagtttgatgccaagaacaagctgacatgctccatctgcctgaaggagttcaagaacctgcctgccctgaatggccacatgcggtcccacgggggaatgagggcctcccccaacctcaaacaggaaatccccaggaagcatcagccgagtgtgcccaaagccgaggagcccctcaagaccgtgcaggagaagaaaaagttccggcaccggtcggaacctctcttcatcccgccgccgccctcctacaacccgaaccccgctgcctcctactcgggcgccaccctgtaccagagccagctgcgctccccgcgcgtcctcggggaccacctgctcctggaccccacccacgagctgcccccttacacgcccccacccatgctgagcccggtgcgccagggctcggggctcttcagcaatgtcctcatctccggccacggccctggcgcccacccgcagctgcccctgacgcccctgacgcccacaccacgggtgctgctgtgtcgctccaacagcatcgatggcagcaacgtgacggtcaccccagggcctggagagcagactgtagatgttgaaccacgcatcaacattggcttgagattccaagcagaaatccctgaactccaagatatctctgccctggcccaggacacacacaaggccacactggtatggaagccctggccagaactagaaaaccatgacctccagcaaagagtggagaatcttctgaatttgtgctgttccagtgcattgccaggtggagggaccaattctgaatttgctttgcactctctgtttgaggccaaaggtgatgtgatggttgctctggaaatgctgctactgcggaagcctgtcaggttaaaatgtcatcctttagcaaattaccactatgccggttcggacaagtggacctccctagaaagaaaactgtttaacaaagcactagccacttacagcaaagactttatttttgtacagaagatggtgaagtccaagacggtggctcagtgcgtggagtactactacacgtggaaaaagatcatgcggctggggcggaaacaccggacacgcctggcagaaatcatcgacgattgtgtgacaagtgaagaagaagaagagttagaggaggaggaggaggaggacccggaagaagataggaaatccacaaaagaagaagagagtgaggtgccgaagtccccggagccaccacccgtccccgtcctggctcccacggaggggccgcccctgcaggccctgggccagccctcaggctccttcatctgtgaaatgcccaactgtggggctgactgtagatgtcatgtcactccctttcttccccaggtgttcagctcccgacaggcactgaatggccatgcccgcatccacgggggcaccaaccaggtgaccaaggcccgaggtgccatcccctctgggaagcagaagcctggtggcacccagagtgggtactgttcggtaaagagctcaccctctcacagcaccaccagcggcgagacagaccccaccaccatcttcccctgcaaggagtgtggcaaagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttggggggaataaataattggcacaactaaaaaaaaaaaa

SEQ ID NO: 1093 - DNA, 3572 bp, Homo sapiens
gagtgtgtgacccagcccttcccccgtggccaagcagagagagtggccttgaggaagccatagcagcaggaccagcatggcctctgctgcctctgtgaccagcctggcagatgaagtcaactgccccatctgtcagggtaccctgagggagccggtcactatcgactgcggccacaacttctgccgggcctgccttacccgctactgtgagataccaggcccagacctggaggagtcccctacttgcccactctgcaaagaacccttccgtcctgggagcttccggcccaactggcagctggctaacgtggtggagaacattgagcgcctccagctggtgtccacactgggtttgggagaggaggatgtctgccaagagcacggagagaagatctacttcttctgtgaggatgatgagatgcagttgtgcgtggtgtgccgggaggctggggagcacgctacccacaccatgcgcttcctggaggatgcagcggctccctatagggaacaaatccataagtgtcttaaatgtctaagaaaagagagagaggagattcaagaaatccagtcaagagaaaataaaaggatgcaagtcctcctgactcaggtgtccaccaagagacaacaggtgatttctgagttcgcacacctgaggaagtttctagaggaacagcagagcatcctcttagcacaattggagagccaggatggggacatcttgaggcaacgggatgaatttgatttgctggttgctggggagatctgccggtttagtgctcttattgaagaactggaggagaagaatgagaggccagcaagggagctcctgacggacatcagaagcactctaataagatgtgaaaccagaaagtgccggaaaccggtggctgtgtcgccagagctgggccagaggattcgggactttccccagcaggccctcccgctgcagagggagatgaagatgtttctggaaaaactatgctttgagttggactatgagccagctcacatttctctagaccctcagacttcccaccccaagctcctcttgtccgaggaccaccagcgagctcagttctcctacaaatggcagaactcaccagacaacccccaacgttttgaccgggccacctgtgttctggcccacactggcatcacaggggggagacacacgtgggtggtgagtatagacctggcccatgggggcagctgcaccgtgggcgtggtgagcgaggatgtgcagcggaagggggagcttcggctgcggccagaggagggggtgtgggctgtgaggctggcttggggcttcgtctcggctctgggctccttccccacacggctgaccctgaaggagcagccccggcaggtgagggtgtctcttgactatgaggtgggctgggtgaccttcaccaacgctgtcacccgagagcccatctacaccttcactgcctccttcactaggaaggtcattcccttctttgggctctggggccgagggtccagtttctccctgagctcctgagaaggagcagttacctactctcctctaagtacaggactcatatcaacccaagtaccatgtggacttgatccctggctgaatcacctggatgacttggaatagaaatgactgctttagaagatgggatggggccgggtggtaagggatagaagagaggactctcaatctactgatcaagtcctttccccaatgcccagtggatggccagggtacctggggactcaggctgctgccagttctgctcaccaccatccgtgcttggcacagaagtagctgcatagaaagggcactggatttgaagtcagaagacctgggttcttgaaccagcctgtcaaccagttgtatgactttaaacaaggcatctcacctcttttcatcttgttttcttccaataatgttagagttcatgtaatcacattctctagaaccatttagtttgtgttaactatgaaccaagcagtgtggtggccactggtgacttgaaaatatagagaaaaaaaaaacctgctctatatctgaaagagctcttgggaagacagagaaacataaagaggaaattacagcacagtgtggtgggtgttacgggaagtccaaccccagcattatgggagttcaggggaaggggcatagcccagcctggaaggagagggtgagtgggggatggctttctgaaaagggtggtctaaaggatgcctatggtcaatagggaaaagaggggaagaagcatcttaagaagaggaaacagcagagaactggctggatgacctgtgactctggagcactgggttgtctccattgtcattatgggcagatgtgtgccatccccagccgacgccactcactgcctccttcctcctggtgttgccacttctgggtgagattaaggtgcagggcctgggggcaggaggacataaggtatagccataaatcataacccagggaccacactcaaccctagggaaattgtcttcctgatcagttgattaccatctgaggtcaagaaatgagatagtgggagcaaatgggtcacaaatagctcagctgtgggctcagaaactgctaggtaaaagaattccagaaggaggccagggcataagttggatgacctatgaactttagtctaaagaattgagactaccgtaattgagactactgtagtgacatctgagaaatgggatggaagagtgaccatgttttattttcttgttcttgtcactattgtattttattttgcataatcatgcccttcactgacagtctccttaacatcatctgtttactctgctcagtgtaaactacaatgctctgtcatctccctactgggtctcctgggaggaggggagccatccagggtgcaaactcaaaggcagagggcacagcgtgcttaggcccaagcttagaattcaattgagaagttctgttgttcatccttacctcagcaggtagaaaagaggtggagatcagaagccagggattagagattgaattgctttccctgggagtgtgcagtatctcattaaaatgttgtatattcaaaaaaatacagacacacacaagtgcctatataatgataaaacatatccaaagcacccaaacctgtgattccagaaaagtagatcctatttttgtttatttttattggctttagctgtgtcttttgaaaggactattatcctctaaaatgtatgtgtatgaagatcctggcttgcagctcgggagctttacacaccttgtgtcactttatcttggtaacgagccaagatcatgcaaccagttcatccatgtctgacccaagagctcttaactgctatgctgcactgcctcattcagagatagatgcctgcatgggtcctggcgattattttaatgctggctacacccccacaggtgacttggattcagaaatacaatttatatttcttctttttaaattgttttattttatttttcttttaatagttatatgtcagtgagaacaatttatatgtcttacactgagaaataaaactgctcataagtgaaaaaaaaaaaaaaaaaaaaaaaaaaaaaa

SEQ ID NO: 1094 - DNA, 4454 bp, Homo sapiens
gtggagatgaatggcgggcgcggcgaccgggagccggacccctgggaggtcggagcttgtcgagggatgcggctggcgctgcccggagcatggcgaccgcgtggctgagctcttctgtcgccgctgccgccgctgcgtgtgcgcgctttgcccggtgctgggcgcgcaccgtggccaccctgtgggcctggcgctggaggcagcggtgcacgtgcagaaactcagccaagaatgtttaaagcagctggcaatcaagaagcagcagcacattgacaacataacccagatagaagatgccaccgagaagctcaaggctaatgcagagtcaagtaaaacctggctgaaggggaaattcactgaactcagattactacttgacgaagaggaagcgctggccaagaaattcattgataaaaacacgcagcttaccctccaggtgtacagggaacaagctgactcttgcagagagcaacttgacatcatgaatgatctctccaacagggtctggagtatcagccaggagcccgatcctgtccagaggcttcaggcatacacggccaccgagcaggagatgcagcagcagatgagcctcggggagctgtgccatcccgtgcccctctcttttgagcccgtcaagagcttctttaagggcctcgtggaagccgtggagagtacattacagacgccattggacattcgccttaaggaaagcataaactgccagctctcagacccttccagcaccaagccaggtaccttgttgaaaaccagcccctcaccagagcgatcgctattgctgaaatacgcgcgcacgcccacgctggatcctgacacgatgcacgcgcgcctgcgcctgtccgccgatcgcctgacggtgcgctgcggcctgctgggcagcctggggcccgtgcccgtgctgcggttcgacgcgctctggcaagtgctggctcgtgactgcttcgccaccggccgccactactgggaggttgacgtgcaggaggcgggcgccggctggtgggtgggcgcggcctacgcctcccttcggcgccgcggggcctcggccgccgcccgcctgggctgcaaccgccagtcctggtgcctcaagcgctacgaccttgagtactgggccttccacgacggccagcgcagccgcctgcggccccgcgacgacctcgaccggctcggcgtcttcctggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaggtacgccgcagctgcccagtctcgcctaatctacctagatcagcgtggctggtccccttactgcctgcttcttagggccctctccctgccccagctttccccgaccaatcacgcctacagtgctttgaaggtttcctctcctaggctagtttcaaacaggccctaaacaagtctgctgctgccctctcatcagacctccgcaccctcaccccaccatcacttaaactactttaatccagttccttcaaagtgatacccccacaggtaagccctcagcatcctgaatacatcatccgcagcctgggaaccttctccctcgtacagcacaggaacctgacacatagtaggcacacagtaaacgtttgtgaatgaatgggagtcatccagtcctgactcttctgtctcttgaggtcccttgaatcttccgcttcctccccaccgatttcagcgtgtccacatcacagctccctccagaagctgcaagagcttcttagcagttcctggtctgaaccctctcccagtcctcatcttccaccctaaaactagagtgatcttcctaaaacttcacttaacccctcagctatgaaaaggcttccaggagtttccatgaaataacaaaaaaaaatacaagcgcctcaccttagcattcaaggcttgtctagtctgcccaaaattacttatcctcacctagctcctaccactcttcttagagactctccagtcagaaatgtgtcgcatagttccacctccacacctctctgctgccagcacattcatgcagaaaagtcttttcacctgtctcagtcttccgcaggcttacctgcgccaggaagtctaaccaaggaacaagaatctcactatcagagccacaaatctgggacctgtctttccaactaaattggaggctttggaagggcagctttgtcctatactctctccaccctgaaaagttcccagaaagccccttccctcccaagcagtgaattaataaccagcaggtgcctatcactgagtaacagaagagctgagttaggcgggcctcacaggtcacccagccagatctcatctggggagtctgaggtcctgaaagaaagcagagctgcgtaaagttaccccggggtgatataggggggccagacgtgtgccccgttcacccacccccaggcaagcatctgacctgtcccctggcccagcccttaggcccagctttcaacctgcttactcatttctcaggggattttgggaaggaatcagcaggtgacagttgctaagcaaccaaagggcgtggtgtttcccaactgtcttgggacaaaaagggtaagagcacccttagatccagatgttgccaaggaaacccagagtgcccagctgtctggaatgaagtgacagaggtagaaaacagtaggccctcacaggaggccaccttcgctagcagggagtgggaggcttctttccagggatttgtgtctccgttctgaaggttctgcgtcctgttttgtcaattccctagacggttttgaagttatattctgttaaagcatcttcataggtgcttggtgggaggccaaggtcgccgaatcctcgtggtttaaatagactttcagtgcattagtttgaaccatataaaactgacaattttcaatagtttttgagttaaaaatggcacttttgatatgagacaatgtagcagaataccaggcagacagaaccttgcaaacaccttaacttctaaccaaagactttaaaactctggctggacagagttttaagcactatgctgcaggaatcctgagaaaaaggggaaattaattctattaggaatggcccaaactgaattgtgacaggcagagggtgttcctgacagagggaagatgaatacacttgaccccaacatttctgcccatccctgatgaccaagacctcttcccagacccacagctgcaggggccaagtaataacagctcttaatagtttataatgcactgttttaatgctttacgactaaactcatctgatcctttcatcagccctagagggtagaaagttttcccaattctacacatggcaaaatggagacccagagtcacttgcccaaggtcgcacagctagtggtggagctggagtctgggcccaggctgtgagttccaggtctgtgctcatggccaccaggccatactgctcagggtgaatgcagctggtctctggccagtgcctggtgctctggcccctctcgtggagctactgcccatgatgctttcctagtgcctggttactctgcgagacttgagtctacctttggactgccttccttgggggtctgagatgaggccttatggcccagaggggaacttgattcaaaaatttgggattcatgtagcagagacagagctagactgtaaaggtcacaaactagctgtgtcaaggcccgtgatagccagaaagcggcagtttcagtccatatcaattgtgtgaccagggctagtcactttttacttctcagtgccatctataaaatggggataatagcactacctaccaagtgctgtgaggctcaaatgagccaaaggttataaacttgccttaaaactatagtcctatacaaaaattagctgggcgtggtggtgcatgcctgtaatcccagctactagggaggctgaggcaagagagttgcttgaacccaggaggcggagattgcagtgagctgagattgcaccactgcactccagcctggggacagagcaagactcttgtctcaaaaaaaacaaaaaaaacatatatactgctgtatcatgccaggatttatcagcattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctttcagacttgaatctgtagacatttctttattgatatggcaaattgcttgcagatatttttaaatgacagcaattttctaatatttggtttaataaaatgtgaataatgtccctttt

SEQ ID NO: 1095 - DNA, 2241 bp, Homo sapiens
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggacccactccgctgataggtggtggccagggttctagggaacacaagaggcggagccaggtggcttccctgtgctggcattcttgcctctctctctctttctctctctctgtctcttagccttgcagccgtttccctctgcgattcatgtaagtgtgactcgatttcagggaaagggaactcgcgtgggctgaggagaccggagtggacgggctggggaaggcaccgtgatgcccgcaaccccgtccctgaaggtggtccatgagctgcctgcctgtaccctctgtgcggggccgctggaggatgcggtgaccattccctgtggacacaccttctgccggctctgcctccccgcgctctcccagatgggggcccaatcctcgggcaagatcctgctctgcccgctctgccaagaggaggagcaggcagagactcccatggcccctgtgcccctgggcccgctgggagaaacttactgcgaggagcacggcgagaagatctacttcttctgcgagaacgatgccgagttcctctgtgtgttctgcagggagggtcccacgcaccaggcgcacaccgtggggttcctggacgaggccattcagccctaccgggatcgtctcaggagtcgactggaagctctgagcacggagagagatgagattgaggatgtaaagtgtcaagaagaccagaagcttcaagtgctgctgactcagatcgaaagcaagaagcatcaggtggaaacagcttttgagaggctgcagcaggagctggagcagcagcgatgtctcctgctggccaggctgagggagctggagcagcagatttggaaggagagggatgaatatatcacaaaggtctctgaggaagtcacccggcttggagcccaggtcaaggagctggaggagaagtgtcagcagccagcaagtgagcttctacaagatgtcagagtcaaccagagcaggtgtgagatgaagacttttgtgagtcctgaggccatttctcctgaccttgtcaagaagatccgtgatttccacaggaaaatactcaccctcccagagatgatgaggatgttctcagaaaacttggcgcatcatctggaaatagattcaggggtcatcactctggaccctcagaccgccagccggagcctggttctctcggaagacaggaagtcagtgaggtacacccggcagaagaagagcctgccagacagccccctgcgcttcgacggcctcccggcggttctgggcttcccgggcttctcctccgggcgccaccgctggcaggttgacctgcagctgggcgacggcggcggctgcacggtgggggtggccggggagggggtgaggaggaagggagagatgggactcagcgccgaggacggcgtctgggccgtgatcatctcgcaccagcagtgctgggccagcacctccccgggcaccgacctgccgctgagcgagatcccgcgcggcgtgagagtcgccctggactacgaggcggggcaggtgaccctccacaacgcccagacccaggagcccatcttcaccttcactgcctctttctccggcaaagtcttccctttctttgccgtctggaaaaaaggttcctgccttacgctgaaaggctgaagtggggcgcgcgaagggcggcgaagcggagacggcggctctccgggatccagctccgcccctggccagtgtgcggcccgggggctccctgtgcccgcgtgaggcgagagaacaggggacttgagtctcgaacagcggttgtttttactttatttatcttaggccctcagctccctgacgtcctgagcctccctgtgacgctctggccttctctgtacctcagagtgcagaaccacagacggcttcggctgtgcctagggcaacagccaacctaggagccagcgggctttcggggaaaaaaaagaaaaagacatctaaaataaaatgtttaaactgtttcaaaataaaaaaaaaaaaaaaaaaa

SEQ ID NO: 1096 - DNA, 2920 bp, Homo sapiens
gatttatggaaagcacctggtgcgtgttctgccctctgaggaccctgccctttcccaaaaggggtatcttaagaaggaaaatatggctgctctttgccggacagcagagtcccagtaggatttccattttccaaacctggtatcatctcctagttggaagaagtggtaagcccacgaacacaaatgcaggagggagaggtgccaagaagcagcggtacacagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtaaaaaaaaaaaaaaaaaaaa

SEQ ID NO: 1097 - DNA, 2085 bp, Homo sapiens
accacatcctccccaccgcccagtcagcacccgctgcgcctgtccccggctcgtccagagccttccaccccctgccgccttccttccccaagccacccccaacctctcctaagaggcgccgccccagtcccggccgccgaacactccctcgcccagcattcccctcccccgccgccccccagcccccgctgacgccacaaagtccctaggcctcccgaccccaggtccccacgccccgggccgggccgcagcctcctgggcttcgtgggggcagacccagcctttcccggcagcgagcgctcggccaggtgcactaggcgctgtgcgggccccccttccccgcgagtccctcaagcgggaacctgcctcgtgtctcccaggagccatggaggctgtggaactcgccagaaaactgcaggaggaagctacgtgctccatctgtctggattacttcacagaccctgtgatgaccacctgtggccacaacttctgccgagcctgcatccagctgagctgggaaaaggcgaggggcaagaaggggaggcggaagcggaagggctccttcccctgccccgagtgcagagagatgtccccgcagaggaacctgctgcccaaccggctgctgaccaaggtggccgagatggcgcagcagcatcctggtctgcagaagcaagacctgtgccaggagcaccacgagcccctcaagcttttctgccagaaggaccagagccccatctgtgtggtgtgcagggagtcccgggagcaccggctgcacagggtgctgcccgccgaggaggcagtgcaggggtacaagttgaagctggaggaggacatggagtaccttcgggagcagatcaccaggacagggaatctgcaggccagggaggagcagagcttagccgagtggcagggcaaggtgaaggagcggagagaacgcattgtgctggagtttgagaagatgaacctctacctggtggaagaagagcagaggctcctccaggctctggagacggaagaagaggagactgccagcaggctccgggagagcgtggcctgcctggaccggcagggtcactctctggagctgctgctgctgcagctggaggagcggagcacacaggggcccctccagatgctgcaggacatgaaggaacccctgagcaggaagaacaacgtgagtgtgcagtgcccagaggttgcccccccaaccagacccaggactgtgtgcagagttcccggacagattgaagtgctaagaggctttctagaggatgtggtgcctgatgccacctccgcgtacccctacctcctcctgtatgagagccgccagaggcgctacctcggctcttcgccggagggcagtgggttctgcagcaaggaccgatttgtggcttacccctgtgctgtgggccagacggccttctcctctgggaggcactactgggaggtgggcatgaacatcaccggggacgcgttgtgggccctgggtgtgtgcagggacaacgtgagccggaaagacagggtccccaagtgccccgaaaacggcttctgggtggtgcagctgtccaaggggaccaagtacttatccaccttctctgccctaaccccggtcatgctgatggagcctcccagccacatgggcatcttcctggacttcgaagccggggaagtgtccttctacagtgtaagcgatgggtcccacctgcacacctactcccaggccaccttcccaggccccctgcagcctttcttctgcctgggggctccgaagtctggtcagatggtcatctccacagtgaccatgtgggtgaaaggatagacacagaccgggggactcgggcactgctcctggctctgcagaaggtgtgggccttctgcttactgcaggccacctgccagggttctctggcatcacgctggcagccattagacacacaggggggtttctcaaattctaaatataattgtgattagaactgtcaaacattaagagggtatactgacagatgcttcctagaggaaacttttgaaagcccctgcgttctgagtggaccgatttctaaatccatacctacacaccaggaa

SEQ ID NO: 1098 - DNA, 3015 bp, Homo sapiens
cagggtttattgttatgtaagttcttgttcagcttcctttgttttctttcacttctgagaatttaactttcgtttctcactcagctcctgtggggaaactcatttgtggagaccagccctctggcttggtgagtgaatctggtttacaccggctcctgccctgccttcactcttctcccctgattcaagactcctctgctttggactgaagcactgcaggagtttgtgaccaagaacttcaagagtcaagacagaaggaagccaagggagcagtgcaatggatttctcagtaaaggtagacatagagaaggaggtgacctgccccatctgcctggagctcctgacagaacctctgagcctagattgtggccacagcttctgccaagcctgcatcactgcaaagatcaaggagtcagtgatcatctcaagaggggaaagcagctgtcctgtgtgtcagaccagattccagcctgggaacctccgacctaatcggcatctggccaacatagttgagagagtcaaagaggtcaagatgagcccacaggaggggcagaagagagatgtctgtgagcaccatggaaaaaaactccagatcttctgtaaggaggatggaaaagtcatttgctgggtttgtgaactgtctcaggaacaccaaggtcaccaaacattccgcataaacgaggtggtcaaggaatgtcaggaaaagctgcaggtagccctgcagaggctgataaaggaggatcaagaggctgagaagctggaagatgacatcagacaagagagaaccgcctggaagaattatatccagatcgagagacagaagattctgaaagggttcaatgaaatgagagtcatcttggacaatgaggagcagagagagctgcaaaagctggaggaaggtgaggtgaatgtgctggataacctggcagcagctacagaccagctggtccagcagaggcaggatgccagcacgctcatctcagatctccagcggaggttgaggggatcgtcagtagagatgctgcaggatgtgattgacgtcatgaaaaggagtgaaagctggacattgaagaagccaaaatctgtttccaagaaactaaagagtgtattccgagtaccagatctgagtgggatgctgcaagttcttaaagagctgacagatgtccagtactactgggtggacgtgatgctgaatccaggcagtgccacttcgaatgttgctatttctgtggatcagagacaagtgaaaactgtacgcacctgcacatttaagaattcaaatccatgtgatttttctgcttttggtgtcttcggctgccaatatttctcttcggggaaatattactgggaagtagatgtgtctggaaagattgcctggatcctgggcgtacacagtaaaataagtagtctgaataaaaggaagagctctgggtttgcttttgatccaagtgtaaattattcaaaagtttactccagatatagacctcaatatggctactgggttataggattacagaatacatgtgaatataatgcttttgaggactcctcctcttctgatcccaaggttttgactctctttatggctgtgcctccctgtcgtattggggttttcctagactatgaggcaggcattgtctcatttttcaatgtcacaaaccacggagcactcatctacaagttctctggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttctttccccttcttttacttagaatgtctttgtattcatttgctagggcttccatagcaaagcatcatagattgctgatttaaactgtaattgtattgccgtactgtgggctggaaatcccaaatctagattccagcagagttggttctttctgaggtctgcaaggaagggctctgttccatgcctctctccttggcttgtagaaggcatcttgtccctatgactcttcacattgtctttatgtacatctctgtgcccaagttttccctttttattaagacaccagtcatactggctcagggcccaccgctaatgccttaatgaaatcattttaacattatattctctacaaagaccttatttccaaataagataatatttggaggtattgggaataaaaactccaacatataaatttgaggaaggcacgatttcactcataacaatcttaccctttcttgcaagagatgcttgtacattattttcctaataccttggtttcactagtagtaaacattattattttttttatatttgcaaaggaaacatatctaatccttcctatagaaagaacagtattgctgtaattccttttcttttcttcctcatttcctctgccccttaaaagattgaagaaagagaaacttgtcaactcatatccacgttatctagcaaagtacataagaatctatcactaagtaatgtatccttcagaatgtgttggtttaccagtgacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattttaaatataaaaataaatattgttctgattattactgaaaagatgtcagccatttcaatgtcttgggaaacaattttttgtttttgttctgttttctttttgcttcaataaaacaatagctggctctaaaaaaaaaaaaaaaaaaaaaaaaaaa

SEQ ID NO: 1099 - DNA, 3499 bp, Homo sapiens
cgggacccggaacagaccgccgtgagagaggaggggtgccggccgggattcgcggcccggagctcgggaccggagtcaggaatggagagaagggtaatggttttacctcttattgtggaaacctgttgagatcacagagaatatactgacggcataaaagggcagaaccatagcagggtgcggttgcttcattccagcctcgcagtcacctctgtgccctgctggttgtcttcccagcgctgctgtagttgccttccatggatctataggagagcaagtcctccaggagctggtggtgtctgtcgattgactgagtgctggagctggcagccctgtgcaggctgccacctttgcccctttactgtgcttgctcctgactctatgtcgcgtctccaaggagaagaagtcctcaccagtgaacggagacctctctgaactaaggataccatggccacgtcagccccactacggagcctggaagaggaggtgacctgctccatctgtcttgattacctgcgggaccctgtgaccattgactgtggccacgtcttctgccgcagctgcaccacagacgtccgccccatctcagggagccgccccgtctgcccactctgcaagaagccttttaagaaggagaacatccgacccgtgtggcaactggccagcctggtggagaacattgagcggctgaaggtggacaagggcaggcagccgggagaggtgacccgggagcagcaggatgcaaagttgtgcgagcgacaccgagagaagctgcactactactgtgaggacgacgggaagctgctgtgcgtgatgtgccgggagtcccgggagcacaggccccacacggccgtcctcatggagaaggccgcccagccccacagggaaaaaatcctgaaccacctgagtaccctaaggagggacagagacaaaattcagggcttccaggcaaagggagaagctgatatcctggccgcgctgaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggacacgagagacttcctaaacaggtatccacggaagaagttctgggttgggaaacccattgctcgagtggttaaaaaaaagaccggagaattctcagataaactcctctctctgcaacgaggcctgagggaattccaggggaagctgctgagagacttggaatataagacagtgagcgtcaccctggacccacagtcggccagtgggtacctgcagctgtcagaggactggaagtgcgtgacctacaccagcctgtacaagagtgcctacctgcacccccagcagtttgactgtgagcctggggtgctaggcagcaagggcttcacctggggcaaggtctactgggaagtggaagtggagagggagggctggtctgaggatgaagaagagggggatgaggaggaagagggagaagaggaggaggaggaagaggaggccggctatggggatggatatgacgactgggaaacggacgaagatgaggaatcgttgggcgatgaagaggaagaagaggaggaggaagaggaggaagttctggaaagctgcatggtgggggtggctagagactctgtgaagaggaagggagacctctccctgcggccagaggatggcgtgtgggcgctgcgcctctcctcctccggcatctgggccaacaccagccccgaggctgagcttttcccagcactgcggccccggagagtgggcatcgccctggattatgaagggggcaccgtgactttcaccaacgcagagtcacaggaactcatctacaccttcactgccaccttcacccggcgcctggtccccttcctgtggctcaagtggccaggaacacgcctcctgctaagaccctgagccctgacatctgcccccagccccaaccctcagatgcttcacttctttggaattccaggactctcaatggggggacgggatgcctggcctaagcacctggagcaggggaccccatatccactggtagccacctccccattgctgtggccccctgaaatctcactcagtgctgttgctccatctactgccctaatggggctcttttcccacctcctgctggtttcccgagggaacttctgaccctggagtccatgagggctcctttcctttttgaccacgaccttggccccagctctgcactctctggaataagggcccgatgcagcattttcttgcccagtgtggcaagacctcagaaaaaccagtcaattacgcctaagatcattttgctgtccttaaaccccccaggttccttcttgcacaaatccactctgctgcccaccttccctggcattttaaacagacctaccccaccccaactcagagttaagcatacatggcaatgctgaaaataaacaaaatccactgaggcttcccaggccatttaaagcctggagtaccagcgcatatcatctcatggggtccagagtggagtccaggcttctctgaaaccagggctgagcatatttccatagccaaggaggtgggactccctggagctatctgtggtcttagggaaggatccagacatacacggctttggggtacaagctgtgatcactgatcaataaattatctctagattggtccttgtgaggggagttttaagaatccagaacatcttgctcttgatcagcacatccaaaaacaccaagacaaacatccagtggagcagaacctctcctgcctcgggagttctgaccgggttccccagcagggtgttaagcctctgtctctggccctaccagcatccaggttccactttcctaggagagagtggagatgggaagacagggaaaggaaggcagcaggaggccacaagcccaccaggtcttcatgtcaagagagggagtaacatgtcttctcattgcccacggacccaacctctgtccaggtgcccctcatcatcacagtttaacacaagctcccctgctccagccaaattgatctcccagtcttgtccttacccattccaagtgctctgccagcccctgttcatccaagttttaagtcctccaccctgttctaagagactgttccaacggctctgggcctcagtggtcacttgaccaccattgtctcagagctgcccactttgtgtgtgtcacatgctgcctgagtcacatgtacatcttatttctgcctctagttttgtaagctcctggagggcggataacatcttatactactcttgtattctcatggcacctagtgcagtgctgggcacagagtaggtgctcaataaagacttgttgaatgaaaaaaaaaaaaa

SEQ ID NO: 1100 - DNA, 2989 bp, Homo sapiens
ggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccctcctccccccctgggcgcccccggcggcgtgtgaatggcggcctccgcggcggcagcctcggcagcagcggcctcggccgcctctggcagcccgggcccgggcgagggctccgctggcggcgaaaagcgctccaccgccccttcggccgcagcctcggcctctgcctcagccgcggcgtcgtcgcccgcggggggcggcgccgaggcgctggagctgctggagcactgcggcgtgtgcagagagcgcctgcgacccgagagggagccccgcctgctgccctgtttgcactcggcctgtagtgcctgcttagggcccgcggcccccgccgccgccaacagctcgggggacggcggggcggcgggcgacggcaccgtggtggactgtcccgtgtgcaagcaacagtgcttctccaaagacatcgtggagaattatttcatgcgtgatagtggcagcaaggctgccaccgacgcccaggatgcgaaccagtgctgcactagctgtgaggataatgccccagccaccagctactgtgtggagtgctcggagcctctgtgtgagacctgtgtagaggcgcaccagcgggtgaagtacaccaaggaccatactgtgcgctctactgggccagccaagtctcgggatggtgaacgtactgtctattgcaacgtacacaagcatgaaccccttgtgctgttttgtgagagctgtgatactctcacctgccgagactgccagctcaatgcccacaaggaccaccagtaccagttcttagaggatgcagtgaggaaccagcgcaagctcctggcctcactggtgaagcgccttggggacaaacatgcaacattgcagaagagcaccaaggaggttcgcagctcaatccgccaggtgtctgacgtacagaagcgtgtgcaagtggatgtcaagatggccatcctgcagatcatgaaggagctgaataagcggggccgtgtgctggtcaatgatgcccagaaggtgactgaggggcagcaggagcgcctggagcggcagcactggaccatgaccaagatccagaagcaccaggagcacattctgcgctttgcctcttgggctctggagagtgacaacaacacagcccttttgctttctaagaagttgatctacttccagctgcaccgggccctcaagatgattgtggatcccgtggagccacatggcgagatgaagtttcagtgggacctcaatgcctggaccaagagtgccgaggcctttggcaagattgtggcagagcgtcctggcactaactcaacaggccctgcacccatggcccctccaagagccccagggcccctgagcaagcagggctctggcagcagccagcccatggaggtgcaggaaggctatggctttgggtcaggagatgatccctactcaagtgcagagccccatgtgtcaggtgtgaaacggtcccgctcaggtgagggcgaggtgagcggccttatgcgcaaggtgccacgagtgagccttgaacgcctggacctggacctcacagctgacagccagccacccgtcttcaaggtcttcccaggcagtaccactgaggactacaaccttattgttattgaacgtggcgctgccgctgcagctaccggccagccagggactgcgcctgcaggaacccctggtgccccacccctggctggcatggccattgtcaaggaggaggagacggaggctgccattggagcccctcctactgccactgagggccctgagaccaaacctgtgcttatggctcttgcggagggtcctggtgctgagggtccccgcctggcctcacctagtggcagcaccagctcagggctggaggtggtggctcctgagggtacctcagccccaggtggtggcccgggaaccctggatgacagtgccaccatttgccgtgtctgccagaagccaggcgatctggttatgtgcaaccagtgtgagttttgtttccacctggactgtcacctgccggccctgcaggatgtaccaggggaggagtggagctgctcactctgccatgtgctccctgacctgaaggaggaggatggcagcctcagcctggatggtgcagacagcactggcgtggtggccaagctctcaccagccaaccagcggaaatgtgagcgtgtactgctggccctattctgtcacgaaccctgccgccccctgcatcagctggctaccgactccaccttctccctggaccagcccggtggcaccctggatctgaccctgatccgtgcccgcctccaggagaagttgtcacctccctacagctccccacaggagtttgcccaggatgtgggccgcatgttcaagcaattcaacaagttaactgaggacaaggcagacgtgcagtccatcatcggcctgcagcgcttcttcgagacgcgcatgaacgaggccttcggtgacaccaagttctctgctgtgctggtggagcccccgccgatgagcctgcctggtgctggcctgagttcccaggagctgtctggtggccctggtgatggcccctgaggctggagcccccatggccagcccagcctggctctgttctctgtcctgtcaccccatccccactcccctggtggcctgactcccactccctggtggccccatcccccagttcctcacgatatggtttttacttctgtggatttaataaaaacttcaccagttaaaaaaaaaaaaaaaaaaaaaaaaaaaaaa

SEQ ID NO: 1101 - DNA, 3037 bp, Homo sapiens
ctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcattgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtcaaaaaaaaaaaaaaaaaaa

SEQ ID NO: 1102 - DNA, 3059 bp, Homo sapiens
ggtccgcagccccgccccggcccctccctccggcctgtgcggctagtccggcggcggcgccggcgcggggacaggcggaggcgcgggcagggccgggcggacgggcgctggcagcagtagcagcgccgcgggcccttcagagtggccgcagtccgagctttgccctcgcatcctgttccaacgcggaaaggacccctctggttctcctgtagcctgagccctgcctggaggaccccaggcccctccctggttctgacctcctcccttctgcaattggcttcagatcctgggctgcaaacctgcagggacagatggttgcaggttggaggggcaggctgcaccccagggagaggctggtgtgagtggcgggagccatctgtgggcgccatggcaaagagggaggacagccctggcccagaggtccagccaatggacaagcagttcctggtatgcagcatctgcctggatcggtaccagtgccccaaggttcttccttgcctgcacaccttctgtgagagatgtctccaaaactatatccctgcccagagcctgacgctatcctgtccagtatgccggcagacgtccatcctcccagagcagggcgtctcggcactgcagaacaacttcttcatcagcagcctcatggaggcaatgcagcaggcacctgatggggcccacgacccggaggacccccaccccctcagtgtagtggctggccgccctctctcctgccccaaccatgaaggcaagacgatggagttttactgtgaggcctgtgagacggccatgtgtggtgagtgccgcgccggggagcatcgtgagcatggcacagtgctgctgagggatgtggtggagcagcacaaggcggccctgcagcgccagctcgaggctgtgcgtggccgattgccacagctgtccgcagcaattgccttagtcgggggcatcagccagcagctgcaggagcgcaaggcagaggccctggcccagatcagtgcagcgttcgaggacctggagcaagcactgcagcagcgcaagcaggctctggtcagcgacctggagaccatttgtggggccaaacagaaggtgttgcaaagccagctggacacactgcgccagggtcaggaacacatcggcagtagctgcagctttgcagagcaggcactgcgcctgggctcggccccggaggtgttgctggtgcgcaagcacatgcgagagcggctggctgcattggcggcacaggccttcccggagcggccacatgagaatgcacagctggaactggtccttgaggtggacggtctgcggcgatcggtgctcaatctgggcgcactgctcaccacgagcgccactgcacacgaaacggtggccacgggagagggcctgcgccaggcgctagtgggccagcctgcctcgctcactgtcactaccaaagacaaggacgggcggttggtgcgcacaggcagcgctgagctgcgtgcagagatcaccggcccggacggcacgcgccttccggtgccagtggtggaccacaagaatggcacatatgagctagtgtacacagcgcgcacggaaggcgagctgctcctctcggtgctgctctacggacagccagtgcgcggcagccccttccgcgtgcgtgccctgcgtccgggggacctgccaccttccccggacgatgtgaagcgccgtgtcaagtcccctggcggccccggcagccatgtgcgccagaaggcagtgcgtaggcccagctccatgtacagcacaggcggcaaacgaaaggacaacccaattgaggatgagctcgtcttccgtgttggcagtcgtggaagggagaaaggtgaattcaccaatttacaaggtgtgtccgcagccagcagcggccgcatcgtggtagcagacagcaacaaccagtgtattcaggttttctccaatgagggccagttcaagttccgttttggggtccgaggacgctcacctgggcagctgcagcgccccacaggtgtggcagtggacaccaatggagacataattgtggcagactatgacaaccgttgggtcagcatcttctcccctgagggcaagttcaagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcagggccccattttgtggctgtgaacaacaagaatgaaattgtagtaacggacttccataaccattcagtgaaggtgtacagtgccgatggagagttcctcttcaagtttggctcccatggcgagggcaatgggcagttcaatgcccccacaggagtagctgtggactccaatggaaacatcattgtggctgactggggcaacagccgcatccaggtattcgacagctctggctccttcctgtcctatatcaacacatctgcagaaccactgtatggtccacagggcctggcactgacctcggatggccatgtggtggtggctgatgctggcaaccactgctttaaagcctatcgctacctccagtagctgtacagaggccctgcctggcttgtggagggacagacattggggtgattggacaagagggtctggctgggaggtgggccagacctggcagcactgaatgtgggctgtgggcatgggtgcacccggtgccctccctctcctacccccacccccacggttgcactttatttattcggttcttgctttggtgactgggtgagcctggactgtggtcccaaggatgtgtgcagagcttcaccctacccttcttacacacctccccacccctgtcagtctgctccccatcccccagcctggggccagaacagcctaccccaggacaggagtccctctagttgtctccctaccaccctatacacactgacagagacagcaataccccaccccccatattaaataaatgtcttcaccaagaaaaaaaaaaaaaaaaaaaaaaa

SEQ ID NO: 1103 - DNA, 2049 bp, Homo sapiens
atccatttgttctcaagaggtagcaagaaacagtatccacagtggactccggggctcctacagacttggcacagcttcctacagtcttgaaacagccctgttgttctgtcatggccagtgggcagtttgtgaacaaactgcaagaggaagtgatctgccccatctgcctggacattctgcagaaacctgtcaccatcgactgtgggcacaatttctgcctcaaatgcatcactcagattggggaaacatcatgtggatttttcaaatgtcccctctgcaaaacttccgtaaggaagaacgcaatcaggttcaactcgctgttgcggaatctggtggagaaaatccaagctctacaagcctctgaggtgcagtccaaaaggaaagaggctacatgcccgaggcaccaggagatgttccactatttctgcgaggatgatgggaagttcctctgttttgtgtgtcgtgaatccaaggaccacaaatcccataatgtcagcttgatcgaagaagctgcccagaattatcaggggcagattcaagagcagatccaagtcttgcagcaaaaggagaaggagacagtacaagtgaaggcacaaggtgtacacagggtcgatgtcttcacggaccaggtagaacatgagaagcaaaggatcctcacagaatttgaactcctgcatcaagtcctagaggaggagaagaatttcctgctatcacggatttactggctgggtcatgagggaacggaagcggggaaacactatgttgcctccactgagccacagttgaacgatctcaagaagctcgttgattccctgaagaccaagcagaacatgccacccaggcagctgctggaggatatcaaagtcgtcttgtgcagaagtgaagagtttcagtttctcaacccaacccctgttcctctggaactggagaaaaaactcagtgaagcaaaatcaagacatgactccatcacagggagcctaaaaaaattcaaagaccaactccaggctgataggaaaaaagatgaaaacagattcttcaaaagcatgaataaaaatgacatgaagagctggggcttgttacagaaaaataatcataaaatgaacaaaacctcagagcccgggtcatcttctgcaggcggcagaactacatcggggccaccaaatcaccactcttcagccccatcccactccctgtttcgggcctcgtctgctgggaaagtcacttttccagtatgtctcctggcctcttatgatgagatttctggtcaaggagcgagctctcaggatacgaagacatttgacgttgcgctgtccgaggagctccatgcggcactgagtgagtggctgacagcgatccgggcttggttttgtgaggttccttcaagctaagccagctcagagaacacggggagcggtggtgctacacggacttcggagcatagagtggcgctgagtgagtggctgagaccgaccacggttcttgacttagtggaattgggtcgaaggagtggagaatgggagggctcgggctactgagagtggagatgggggcgggggtggtggtgaagagagttggagaaggaatggacgaattcttgagcaaaaggaggggaagagacaatctccagccacccgccccacgcttgacttcttatcactttggctgtggtgccgcctagtggaaaaaggaagtccctgcagcagtccccgcactctttaagcagctgtttaccgaaggcaccagttcagccaggagtgaaatccggagaggagcaacgccagcctgggtcacagtccatcaaaccccatgagcccgaccactctcgctcttccttacattcccacgtcccccttctctcccaacccctcatatcagcaagggaaattaattaatgagatttgataaatcagtagatagaatgaggtccccattctgaaatatttagcagactggaaccaccacgcaagcctctgtagggggtggatggagacacttctaactttaataaactgcgactgaacgtggaaaaaaaaaaaaaaaaaaaaaaaa

SEQ ID NO: 1104 - DNA, 8339 bp, Homo sapiens
ctgcggctggggctgggggcggcggcggcggcgacgcgggcggcgggcggcgcggggcggtccggcgggttcaaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaagttggtgtaatacggtgcccagtatgccgccaagaatgcagacagatagaccttgtggataattattttgtgaaagacacatctgaagctcctagcagttctgatgaaaaatcagaacaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcagagtctgttggagcatctggtcaacgccctgttttctgccctgtacacaaacaagaacagttgaaacttttctgtgaaacatgtgatagattgacatgtagagactgtcagctattggaacacaaagaacataggtatcagtttttggaagaagcttttcaaaatcagaagggtgcaattgagaatctactggcgaaacttcttgagaagaagaattatgttcattttgcagctactcaggtgcagaataggataaaagaagtaaatgagactaacaaacgagtagaacaggaaattaaagtggccattttcacccttatcaatgaaattaataagaaaggaaaatctctcttacaacagctagagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactgattactttccagttgcgtcatattttgaaagcacggtgtgatcctgtccctgctgctaatggagcaatacgtttccattgtgatcccaccttctgggcaaagaatgtagtcaatttaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaacactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacagttggaagatgctggctcaagtagtttagataatctactaagtagatacatctcaggcagtcacctacccccacagcctacaagcaccatgaatccttctccaggtccctctgccctttctccgggatcatcaggtttatccaattctcacacacctgtgagacccccaagtacttctagtactggcagtcgaggcagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatgttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaagtggggactggatatgcacattttgtagagatattggaaagccagaagttgaatatgattgtgataatttgcaacatagtaagaaggggaaaactgcgcaggggttaagccccgtggaccaaaggaaatgtgaacgtcttctgctttacctctattgccatgaattaagtattgaattccaggagcctgttcctgcttcgataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaaatgatgaaagttgttcaagtttatgcagacacacaagagattaatttgaaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaaacgaaaaaaaaaaaaaaaacacaaaaaacccagaaaacttttaagtgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattgctcttcaaatggatccttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagattggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaattacctcagcaggtatcctgccatgtaattattagtgattagtgttaataagataatagattcaggtcttccaactatgcccttggattgtggcctactgtatgttattaaatggtctcttactatccaaaatgggagtagatgctgtggccccgtctcccttggcttttacgtcccatatccacccccattcatgtacaacatgtgaaatataaaaatctcatttcttgtcaaaatcagcactgcttatttgcatactcagcatcggatcagtgagtagttttataaaaaatccacgcacccaactcccttagttaaaacagattcttaattcataccatgaattcttaatttctgtaccatctatgttaatgatctgctgaaggtgactcaagattttcaaggtgtaatacagtttgatcatgtaccggacctggatatttaattttttttccctcacagttaatctcctccttgataaagcaataacactgctttgagtctgttgcctaatagcatgtcagaatcctctcctggatggtgattttataggaaagtttgtatgcatatcacccagtctatcttttaaaaattaagaaatttaaatgtatgctggaagtaatgacactatattgtggcattttattttaaaaattggggaaagttgcatatttttttaaaagtaagtgtttgagtaaaaaaattgaaggtacttttttaaggaaaaaaatttatatgccacagtttacatagacatttcagattcaacacgtactcttgaatataatggtttcttttacttggtcaaaatgcatgtatagcatttctttcatcttagttccttgtgtttgcctatgtggtcctttatatattttttattgtatcgaagaaacaaaactatcttcaaaaataagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaa

SEQ ID NO: 1105 - DNA, 2302 bp, Homo sapiens
accctggcttttcttcacctcttcaaccaggagccgagatttctgttgctctgaagccatccaggggtctttaaccagaagagagaggagagcctcaggagttaggaccagaagaagccagggaagcagtgcaatggcttcaaaaatcttgcttaacgtacaagaggaggtgacctgtcccatctgcctggagctgttgacagaacccttgagtctagactgtggccacagcctctgccgagcctgcatcactgtgagcaacaaggaggcagtgaccagcatgggaggaaaaagcagctgtcctgtgtgtggtatcagttactcatttgaacatctacaggctaatcagcatctggccaacatagtggagagactcaaggaggtcaagttgagcccagacaatgggaagaagagagatctctgtgatcatcatggagagaaactcctactcttctgtaaggaggataggaaagtcatttgctggctttgtgagcggtctcaggagcaccgtggtcaccacacagtcctcacggaggaagtattcaaggaatgtcaggagaaactccaggcagtcctcaagaggctgaagaaggaagaggaggaagctgagaagctggaagctgacatcagagaagagaaaacttcctggaagtatcaggtacaaactgagagacaaaggatacaaacagaatttgatcagcttagaagcatcctaaataatgaggagcagagagagctgcaaagattggaagaagaagaaaagaagacgctggataagtttgcagaggctgaggatgagctagttcagcagaagcagttggtgagagagctcatctcagatgtggagtgtcggagtcagtggtcaacaatggagctgctgcaggacatgagtggaatcatgaaatggagtgagatctggaggctgaaaaagccaaaaatggtttccaagaaactgaagactgtattccatgctccagatctgagtaggatgctgcaaatgtttagagaactgacagctgtccggtgctactgggtggatgtcacactgaattcagtcaacctaaatttgaatcttgtcctttcagaagatcagagacaagtgatatctgtgccaatttggccttttcagtgttataattatggtgtcttgggatcccaatatttctcctctgggaaacattactgggaagtggacgtgtccaagaaaactgcctggatcctgggggtatactgtagaacatattcccgccatatgaagtatgttgttagaagatgtgcaaatcgtcaaaatctttacaccaaatacagacctctatttggctactgggttatagggttacagaataaatgtaagtatggtgtctttgaagagtctttgtcctctgatcccgaggttttgactctctccatggctgtgcctccctgccgtgttggggttttcctcgactatgaagcaggcattgtctcatttttcaatgtcacaagccatggctccctcatttacaagttctctaaatgttgcttttctcagcctgtttatccatatttcaatccttggaactgtccagctcccatgactctatgcccaccaagctcttgaattttctcatttcttcacctacaaccctttgtcttgacttatctcctgcaactgactcatctgcaacattcacaccattgcttccttgtggtttcccttctttagaacttttactcatccttgagatgtatggtgtatttggcttgagttatgagagatgcttatttattcatttactctttttcatattttcagagaaagttacctaatccctcctaaagacacagcagtatgggtataacatccttgccttcccatttatccatgtttcactttatcactgatatgaagaggcccaaagcctgttagccaccatccatgctacctaggtagtccataggaaccacccccatgaccaccaccaacatcaactaaaggttcttggagggtatgtcagtgtgttgctcaggataccccaggtacatcaaggaatcaaggagaggaaaatatgagcaatatgtgtattcagagtgaagattttatgtccagagtatttgagctcaaaccttgcctgttgttttctaatcatgatgaatactttctcagtttctttttcctgaaatataaattgggatttaagactgtacctaactattaagatcactgtgtaaaactaagtgtctctaaatgtaatgcatcgatttagtgtctggaacataataaatatttgctctcatgattgctaaaaaaaaaaaaaaaaaa

SEQ ID NO: 1106 - DNA, 4227 bp, Homo sapiens
ctcgggtcgcgggcgttggcagccgggcgggtgggaggggccggagcaaaagttccgggcgcccgagccggctgctcgtgccatggagcggagtcccgacgtgtcccccgggccttcccgctccttcaaggaggagttgctctgcgccgtctgctacgaccccttccgcgacgcagtcactctgcgctgcggccacaacttctgccgcgggtgcgtgagccgctgctgggaggtgcaggtgtcgcccacctgcccagtgtgcaaagaccgcgcgtcacccgccgacctgcgcaccaaccacaccctcaacaacctggtggagaagctgctgcgcgaggaggccgagggcgcgcgctggaccagctaccgcttctcgcgtgtctgccgcctgcaccgcggacagctcagcctcttctgcctcgaggacaaggagctgctgtgctgctcctgccaggccgacccccgacaccaggggcaccgcgtgcagccggtgaaggacactgcccacgactttcgggccaagtgcaggaacatggagcatgcactgcgggagaaggccaaggccttctgggccatgcggcgctcctatgaggccatcgccaagcacaatcaggtggaggctgcatggctggaaggccggatccggcaggagtttgataagcttcgcgagttcttgagagtggaggagcaggccattctggatgccatggccgaggagacaaggcagaagcaacttctggccgacgagaagatgaagcagctcacagaggagacggaggtgctggcacatgagatcgagcggctgcagatggagatgaaggaggacgacgtttcttttctcatgaaacacaagagccgaaaacgccgactcttctgcaccatggagccagagccagtccagcccggcatgcttatcgatgtctgcaagtacctgggctccctgcagtaccgcgtctggaagaagatgcttgcatctgtggaatctgtacccttcagctttgaccccaacaccgcagctggctggctctccgtgtctgacgacctcaccagcgtcaccaaccatggctaccgcgtgcaggtggagaacccggaacgcttctcctcggcgccctgcctgctgggctcccgtgtcttctcacagggctcgcacgcctgggaggtggcccttggggggctgcagagctggagggtgggcgtggtacgtgtgcgccaggactcgggcgctgagggccactcacacagctgctaccacgacacacgctcgggcttctggtatgtctgccgcacgcagggcgtggagggggaccactgcgtgacctcggacccagccacgtcgcccctggtcctggccatcccacgccgcctgcgtgtggagctggagtgtgaggagggcgagctgtctttctatgacgcggagcgccactgccacctgtacaccttccacgcccgctttggggaggttcgcccctacttctacctggggggtgcacggggcgccgggcctccagagcctttgcgcatctgccccttgcacatcagtgtcaaggaagaactggatggctgagctggcccggggctgccccggtcttgtgccacagcactgttttctttctgccctcttcctaatgcccacactgcttgggcactattgcgcccctgcctccttgccaggctcttcctcctgtcctgcctggtccttttccatgactccaggctgtgcctctctccatgtttggtcccttctgtgcccatggtcaggagctattcgggtggcacctcgctggccaggctctcccgagtcgtggcacctccacaatgtgaattttctgaatccctattccaggatttctgggaataatgtttacttctagaatgggcctgttgtaaaccatctcatcgaggtgtggtaaagccattggatgaggaggggactgccatggaaaggagagtttgttacttacggttctgagaggaggggccacataggaaagccccacggtgggtcagaaggcggaaggagggaggggaacgtgtgggcaagagacttcctctggtttcctcaggaggaaatgggcaaggcagagtaagcaggggagacaggtttaagggtagctggcttgagtaatttcagtggctctcaggataggggctgccctttttgtctgatacctggccccgggatagtcaggacaggtgaatgttggcctggggtgtgacagccctgggagagccatgtgaaggaggcagctggcgccatcgctccggattagttggtttccataggaaaggcatgctttcagccagatgcttgccatctctagggattgggggattggctagcctgggaggatcagtctgtccaggtcagcgaggccccagataccagagcatcaagagtacaggaaatacagttaatgcagggcctctgtgtggctggatcctccgtctccatcagatcagctctgattgatctattcttgcacgatttcctctgaacacagggttccagagtacttaaacacaacattttttaaatcgtgatttcggcctatttccttgccaggcctgtttccccaccaggaaatgagataggaggactggatgaggatgtcctgttatagttgctgtggaggaagttcctctggttaattctcatcagcgtctgcagaaaagaaggaaagagggcacccttttcagttgggaagaaaggagaggggtggcgccatggacgtggccctaaacgctgtgggagagggaagaggaggctgggcctcgctgccctcttgtctctgctgacttcagcctggtcatgcttgctctgccacttgcgatttcatccctaatttcttcctccaccatgcctgcagacttttccctgggcttgttttttctcgcacatctctgaagagtttttaatcttcagctcatcatgtcccaggaagtggcatcataaaaggaaatatttttttttcctaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaattatttcattctttatattaaacttttaaaaatgttttttattttcaccttagatatgggaagagttttttttttttttttttttttaacaggataacttgagcaggctaggcctcttaaaaaaaaatttgagctaaaactcatttttcttttggcattttcttttcaatgttcttataagcaaagttcatccatgttgtagcatgtgttcaactttattttttcatcgggtaatattccattgtatggaatggtagtactacattttatttatcatgcatcgattggtggacatttggatcgtttctacttcttgactattatacataatgctgctaggaacttttgtgtatgagtttttgtgtggacatatgttttcatttctctttggtatatgcctgggagcagatttgctggatcatatgaaactctatttaacccttgagggactcccaaactgttttccaatgtggtgacacaattttatatcccatcaacagggcatgagggttctgatgactccacatccctcagtgctttttattatctatcttttaacttagccatcctagtaggggtaatgtggcatctcattgtgattttggtttgcatttccctgatggcgaatgatattgagcatcttttcatgagcttattggccatttgcatatcttcttaggacagctatctttagatcacttgctcattttttaattgggttatttgtctttttattattgagttgtaagagtccttttatagcctggcacaagtccctttaactggtatatgattataaaatttttctccgtgagctgtttcatttccttgatgatgtcctttgaaatactaaagcttttaattttg

SEQ ID NO: 1107 - DNA, 3286 bp, Homo sapiens
tagcagcgaatatactttacaccaaatctcagaagattcagaacttagatgagtggggcccaggacaggaaccctggagccttggaaggaggggagccccatctccccagaagagcagtgaccccagcagagaggggcctggtgtatcactggaggaaatagcctgccaaggaatacacgtcttcagaagaaattctgtgtggcttcaagagactgatcaaattgtgagaggaaaacagcctacccggtcctcttttcttcaatacaaaatgagataataggggttggaaggaaaaccttcaagacctatggaagtcagttgcagccagctcatcacatagaggtgcaggtgaggtgtattttcatcacggtggaaaattctggctgcttcatctccatctctagagccaatattggagcttttcaataaaagctatggcctcaaccaccagcaccaagaagatgatggaggaagccacctgctccatctgcctgagcctgatgacgaacccagtaagcatcaactgtggacacagctactgccacttgtgtataacagacttctttaaaaacccaagccaaaagcaactgaggcaggagacattctgctgtccccagtgtcgggctccatttcatatggatagcctccgacccaacaagcagctgggaagcctcattgaagccctcaaagagacggatcaagaaatgtcatgtgaggaacacggagagcagttccacctgttctgcgaagacgaggggcagctcatctgctggcgctgtgagcgggcaccacagcacaaagggcacaccacagctcttgttgaagacgtatgccagggctacaaggaaaagctccagaaagctgtgacaaaactgaagcaacttgaagacagatgtacggagcagaagctgtccacagcaatgcgaataactaaatggaaagagaaggtacagattcagagacaaaaaatccggtctgactttaagaatctccagtgtttcctacatgaggaagagaagtcttatctctggaggctggagaaagaagaacaacagactctgagtagactgagggactatgaggctggtctggggctgaagagcaatgaactcaagagccacatcctggaactggaggaaaaatgtcagggctcagcccagaaattgctgcagaatgtgaatgacactttgagcaggagttgggctgtgaagctggaaacatcagaggctgtctccttggaacttcatactatgtgcaatgtttccaagctttacttcgatgtgaagaaaatgttaaggagtcatcaagttagtgtgactctggatccagatacagctcatcacgaactaattctctctgaggatcggagacaagtgactcgtggatacacccaggagaatcaggacacatcttccaggagatttactgccttcccctgtgtcttgggttgtgaaggcttcacctcaggaagacgttactttgaagtggatgttggcgaaggaaccggatgggatttaggagtttgtatggaaaatgtgcagaggggcactggcatgaagcaagagcctcagtctggattctggaccctcaggctgtgcaaaaagaaaggctatgtagcacttacttctcccccaacttcccttcatctgcatgagcagcccctgcttgtgggaatttttctggactatgaggccggagttgtatccttttataacgggaatactggctgccacatctttactttcccgaaggcttccttctctgatactctccggccctatttccaggtttatcaatattctcctttgtttctgcctcccccaggtgactaaggaaaagagcagaagctccttggtttaaccagcacagagaaaataatataaatcccataagggcagacgtttggtctgttttcttcgctgtcatttccttagtagttagactagtgctgagattttagtggatatataattgatttatgttgaatatatggacttagcaactaaaaataccacagatggttaacctggactggggcaaagcaagataatagtgatgatcgtatgttgctgtctccatccgtctttaatgggtcagggctttgatttccaagggtcttcaggtgatgagtaggggtacccacaagtcagaaggtctgcgttctcctagtttgtttgctgccatttgaactcatgtagggaatgaaagaaagctgcaattatccgccaactgcatttaaaacaaaacaaaacagaaaaatcaaaataacattgactcttccaaccactgacatgttgtttaataatctaagcggcagtcctggaggctaccagacttactgagttctacctgagaaacagccaagcaaagtgtgagagaagggttaagactggcttacaatgagatgcttcaaatgaaaagggaattatgagtaaaattgaactttgatgggggattcagttctggaaaagaatttggtattttccagtctgctaggaccaattaccttgaaatattttaaaatctcagtaaatagttattgctgaaatggctgttggcagttcttattatgattcagagaagagcaaatagaccttaacttcattttgaaaaagaccaaattaccatacccgagtgagtaatgacaggactacaactaaaacataaacaacattaatgatgaccataaaaagtcacaaaattgctaaatgttataatttagagttgacataaaaattgatggccaggcatggtggctcacgcctgtaatcccagaactatgtgaggctgaggcaggtggatcacttgaggtcaggagttcaacaccagcctggccaacatggtgaaaccctgtctctactaaaaatacaaaaattagccgggcatggtggtaggggcctgtaacccagctactcgtgaggccaaggcaggagaattgcttgagcctgcagcagctgcagtaagccaagatcatgctgtgcctcaaggaaaaaaaaaattaatgtttactgatatttgttgaagtcctacaacatcacctctgagaataggagaaatgaagcaacagttgtgtctagatgtcagaggcatggctgggcctccatctctgcctaagggagatataaaagagttcaaactattgcccatgttccccagggtcagaagttctaattatgatgatagaggctgggttgtaagtagtaagtgaagggtagcagaatatgccatctttggcataagaagtattttgagttgaagacaattgagaaaaaaaaaaaaaaaaaa

SEQ ID NO: 1108 - DNA, 3354 bp, Homo sapiens
cccagcttccactgacacgagcctcggcgcggcttccgcttccggcgagtattgtgtgtcgcgccgcggggcgggggcgaggggaggaggaaggagggaggcagcgctccggcggctccgcgccccgcactcccggacccgaagccgggaagattcctttcttgtctgttagaaacgtatgtcaaacgaggatacagtgtctggaactattggttctaagatataagtggaatgagcctggatcaggagaagtatgctgagctagagttgaaggaagcttctctttctaacaagagaaagcagagttaaattatggcagagacaagtctgttagaggctggggcctctgcagcctctacagctgcggctttggagaacttacaggtggaggcgagctgctctgtgtgcctggagtatctgaaggaacctgtcatcattgagtgtgggcacaacttctgcaaagcttgcatcacccgctggtgggaggacctagagagggacttcccttgtcctgtctgtcgaaagacatcccgctaccgcagtctccgacctaatcggcaactaggcagtatggtggaaattgccaagcagctccaggccgtcaagcggaagatccgggatgagagcctctgcccccaacaccatgaggccctcagccttttctgttatgaggaccaggaggctgtatgcttgatatgtgcaatttcccacacccaccgggcccacaccgttgtgccactggacgatgctacacaggagtacaaggaaaaactgcagaagtgtctggagcccctggaacagaagctgcaggagatcactcgctgcaagtcctctgaggagaagaagcctggtgagctcaagagactagtggaaagtcgccgacagcagatcttgagggagtttgaagagcttcataggcggctggatgaagagcagcaggtgttgctttcacgactggaagaagaggaacaggacattctgcagcgactccgagaaaatgctgctcaccttggggacaagcgccgggacctggcccacttggctgccgaggtggagggcaagtgcttacagtcaggcttcgagatgcttaaggatgtcaaaagtaccctggaaaagaatattcctagaaagttcggaggctcactctcaacgatctgtccacgggatcataaggctctccttggattagtaaaagaaatcaacagatgtgaaaaggtgaagaccatggaggtgacttcagtatccatagagctggaaaagaacttcagcaattttccccgacagtactttgccctaaggaaaatccttaaacagctaattgcggatgtgaccctggaccctgagacagctcatcctaacctagtcctgtcagaggatcgtaagagcgtcaagttcgtggagacaagactccgggatctccctgacacaccaaggcgtttcaccttctacccttgcgtcctggctactgagggtttcacctcaggtcgacactactgggaggtggaggtgggcgacaagacccactgggcagtgggtgtatgccgggactccgtgagccgaaagggcgagttgactccactccctgagactggctactggcgggtgcggctatggaatggggacaaatatgcagccaccaccacaccttttacccctttgcacatcaaggtgaaacccaagcgggtaggcatattcctagactatgaggccggcacactgtctttctacaatgtcacagaccgctctcatatctacaccttcactgatacttttactgagaaactttggcccctcttctacccaggcatccgggctggacggaagaatgctgcaccacttaccatcaggcccccaacagattgggagtgacaggttgggatgtgggaatgactggggtgaggcagggtcaagtgctacgggcctccttcccgtgtcctgctggaacgtcttcgtgtccacctgggtccagtcctgaatcatcttggagaaacaccttggtttctaggatggttttgtgtggagggggaggtaggactgggctggatgagagagcacagctgtgacttcctcctaactgtcagggtggggagctggttcccagaggattgtctaccctgaagtccatcaggttttctgttgcacaaggacgggtcaggaaggaaggagaggcttttccagaaacaaaaaatctgtgagggtctgacttgctcaaaccagaggaggaaacagaaacccctgcacatctttttagggggttctttgacccaggatagtcttgcttcttgaggtagatcacaggggtctgtgtacctctgaattcatgagagatgaatgacagatgctctcatgggtctagatattgaggagtttttctgagggcagagattggacatcaacaaggctagaagggtcagggaagtgggctaaaggaacagattcctagagattaatgaagaggagggaggtttctttggtcttctattccaagggtaaggttgcgattatgggtaagattggccagaggtaggaatgtggggagaaggagaggctgaaaagaaagcagaggagaacccaggtccctgcctcagccttcagcagagttggcttattgcctgcctctataccaataagtcagtcaccttgctcctctccagaggcaaagtggaagagatcctgcaagacacatctatcctttcacagtgttcccaagggaacttggaaaggagagtcaggtattagaggaaagagaagggtatttgtatacaaagccctggccttaaagaatgttacttagtagctactcccaaattgtcagccttcttacctggccaaggtgtccaagccagaaaggaaaaaaggttatggagtctttctcaccctaaggacagggtggaagagggtggtatatagggaagggccagataggcaacttcatttggcttgtgtgcatctggcctggaactggtgttaagccaggcttttgcttgtttgttgccatccctcaccctttgccatttcccttttcagagaatgtaaatgattttcatgttaggccaaaataaacaacttatagggtacatatgttgtcataaaaggtaaaagtgatgcatgccaaaccaaactaaaccaatttggattatctgctattcgggtaatcttcacagaaatgactgagagaagaatctgcagtttactgagggcatttcagttcctcctaccacctcaacaggactttgtccagactctcctcctcttacctttgtgccttgactgtggttctttgtggcaagatactttggttggttaaaataatatggaacaaaggatccactgaagtgaaaaaaaaaaaaaaaa

SEQ ID NO: 1109 - DNA, 3401 bp, Homo sapiens
tgcgttgtacccttttacgtgaggcggtgacggcggttcggaagtcgtctggcctccccgcggccgctcgcagcttgctggcctctcccgcgcctcacgtcggactccgtctccgcggcagggaagcagcatggaagctgaggacatccaggaggagttgacctgccccatctgcctggactatttccaggacccggtgtccatcgagtgcggccacaacttctgccgcggctgcctgcaccgcaactgggcgccgggcggcggcccgttcccctgccccgaatgtcggcacccatcggcgcccgccgcgctgcgacccaactgggccctggccaggctgactgagaagacgcagcgccggcgcctgggccccgtgcccccgggcctgtgcggccgccactgggagccgctgcggctcttctgcgaggacgaccagcggccagtgtgcctggtgtgcagggagtcccaggagcaccagactcacgccatggcacccatcgacgaggccttcgagagctaccggacaggtaactttgacatccacgtggatgaatggaagagaagactaattaggctgctcttgtaccattctaagcaggaggagaaacttcttaagtctcagcgtaatctcgtggccaagatgaagaaagtcatgcatttacaggatgtagaagtgaagaacgccacacagtggaaggataagataaagagtcagcgaatgagaatcagcacggagttttcaaagctgcacaacttcctggttgaagaagaggacctgtttcttcagagattgaacaaagaagaagaagagacgaagaagaagctgaatgagaacacgttaaaactcaatcaaactatcgcttcattgaagaagctcatcttagaggtgggggagaagagccaggctcccaccctggagctgcttcagaatccaaaagaagtgttgaccaggagtgagatccaggatgtgaactattcccttgaagctgtgaaggtgaagacagtgtgccagataccattgatgaaggaaatgctaaagcgattccaagtggctgtaaacctagctgaagacacagctcatcccaaactcgtcttctcccaggaagggagatacgtgaaaaatacagcatcagccagttcttggccagtgttttcttcagcatggaactactttgctggatggaggaatcctcagaagactgcttttgtagagagatttcagcacttaccctgtgttctgggaaaaaacgttttcacctcagggaaacattactgggaagttgagagtagagatagtctggaggttgctgttggggtgtgtcgggaggacgtcatgggaattactgatcgttcaaaaatgtccccagatgtgggcatctgggcgatttattggagtgctgctggctattggcccttgataggcttccctggaactcccacccagcaagagccagctctccaccgagtgggggtttacctggatcgtgggactgggaatgtctccttctacagcgctgtggacggagtgcacctgcacaccttttcttgttcttctgtctcacgcctccggccatttttttggttgagtccattagcatctttagtcattccaccagtgactgataggaaatgaggcttttcttcccctgaccaaaactccttccctgtagtccagctgagggacacacatccctgggccctcttctgcccttcatgtctctatcctggatggtccatcttctgggtctccctaacggtaccgtttggtatctgccctttgtgtgcttcacaagaggcagtcccatgggaggtgggtctggccaatggagatgggacaggaaattttccaagacgcttttgggaaatctttttgtagcttttaaagagatgtgcggggaagacatatggatgttagcagccatattggaactgagaacacaggaatggtggaaaggtagaagaaacagagtttttgttgccgttgtgaaattgttgaaatttccttcatgccaagcttcttgttatatgagataattacgcccttattgtataagacaattttagttgtatttggttacttgcagcctgaagtaccgtaactgcactaaagggacgtagtgtgaacatcccgcagtataggcttaagtcacttttgtgaaatttgacaaaggcatagaatctttttctatccagtcaggcattgcctattctttccagtaactactgattcccccacttttctgtcttagaaaattgtgggaatcccccctcactctgcctatgttgcactctctctcttcccaaccataactctgccctcagctattaactgtgctgtgtatttatcaagttggtatgttgtatgtacagtgttattcatgtcatcatgagaatgttgaacgcttgttaaataccttttgctagcctcttcatatgctgttgcatatgactctcatcacaactcagtgagatggaaagacaaatcctatttgtacaaatgagaaaactgaactctttagagtaactagctcagtattggccagctggtaaatggcagtgttgggattaaaatccagttcttatctactctccctttattcagaagcatttattggatgttgatctttgtttcaggttttgattttgttacttttttatactgtgtatattttcctcagtctacccttctgctctagattgtctggactcaggagattgtggcagttactggatagttatttttaagataatgattgcttttctctgtttatataagtcatgtgtacttattgtagaaagtttgtaagatgcaaaaagtataaaaattaaagttatgcactactaacatttcaatatattttctcccagattttcaataaagactttcaggcagtgatttaacgaggattttattttaacttatattttagtttaaggggaacacgtgcaggtttgttctatagatcaattacatgtcacaggggtttggtgtacatattatttcattacccaggtaataagcatagtacccaatagatacttttttgataccccaccctcctccaccctctaccctcaagtagtccctggtgtctgttgttcccttttttgtgtccatgggtactcaatgtttagctctcccttatacgtgagaacatgtgatgtttggttttctgttcatgtgttggtttgcttagggtaatggcctccagctccatccatgttgctgcaaagacatgatctcattctttttttatggctgcatagtattccatggtgtatatgtactatgttttctttatccagtctactgttgatgggcatttaggttgattccatgtctttgctattgtgaatagtgctgcaatgaatatatacatgcaaaaaaaaaaaaaaaaaaa

SEQ ID NO: 1110 - DNA, 1939 bp, Homo sapiens
gtgtatgaaaaataatttcaagtttaacaaacacaaggaaaccgcagggtccatgtcaaagctgatgagctatttctgaaactcgtgcagaattgtggtttgtgtggtctatgtcacggcacccttgagggagagtgggcaattgcctgaacttggaggctgtgtcctgtccccaggctgctccagggctgcctccttccgactgggccttcttatctgggactgttgagggcaacaggccttccgaagaccagtgaagaaggaggccctgcaaacaggaggctgacagggtaggaacgaggccatgatccctttgcagaaggacaaccaggaggagggtgtctgccccatctgccaggagagcctgaaggaggccgtgagcaccaactgcggacatctcttctgtcgagtgtgcctgacacagcatgtggagaaggcctcagcctctggggtcttctgctgccccctctgccggaagccctgttctgaggaggtgctagggacaggctatatctgccccaaccaccagaagagggtgtgcaggttctgtgaggagagcagacttcttctatgtgtggaatgcctggtgtcccctgaacacatgtctcatcatgaactgaccattgaaaatgccctcagccactacaaggaacgactcaatcgccggagcaggaagctcagaaaggacattgcagaacttcagcggctcaaggctcagcaggagaagaaactgcaggctctgcagcagtggctgggccagctggagcacatgccagcagaagcggccagaatccttgacatctccagggcagtaacacagctcagaagcctggtcattgatctggaaaggacggccaaggaattagacaccaacacactgaagaatgctggtgacttactgaacaggagtgctccacagaaattagaggttatttatccccagttggagaaaggagtcagtgaattgcttcttcagccccctcagaagctctgacctgttcatccctgggacacctcacttcaggctcacctcagcctcctctctctccttcctccaacctgtccaggcccccactgggtctacccagtgcatcttcgggcctgccagctcctgaacatgtcaccatttcttcatgtccacagtcatcacctgatgcctgaccctctgactcttggacgatagccagcctccttccaggacaggctcatgcttggggctgccactgtggaggtcggggcccatggtctccaggagcatttgtgaaatctccattttgcctgtaaactgatggtagtgcccatctctcacaatctcattcaaataggatcctccaggcctctgaatggcccgagctcatcagcagtgacaccacctcacatgtggagcccagctgagttcctgcagtacttgttgtctgtaccactcacctggcacttatttattattgttgtggaagacagactcaaagacagcctcccttcatgatcctcacctcttggaattcatgcccttgtttggtcccctccccttgagtgtaagtgggatctgtgacttgcttctaatgaatggaataaggcaaaggtgatagggtgtcactctggcaactgtgttgcattgtatagaactcctccttgctggcccacccttttagagcccctcctaggagccaagagcagcttccagccaacaacaagcagaggccctcagtcttgtggctgcaagaacctgaattctgccaacaacccgagtgagcttggaagcagattcttccccaactgagccggataagaacctagtccagccaacaccttgattatagtcttgtgagtacctaagctgaggacccagtgaagctgtgccaaaatttcccacccacagaaacagtgtgacaataaatgtgtgtgtgtttttttgttaaaaaataaaaaaaaaaaaaaa

SEQ ID NO: 1111 - DNA, 2697 bp, Homo sapiens
accggctgcagtcggctgtgccgggagggtaggatggcgtctggccgatgcggtgatagcaccgaaagcagacggccgccaggcgctccccctaccccccgaagtttctccccagcggcgggggatgggggtaggcggttcctctgttctttctgcgttccccgcggcctcttaccacagagacgcgggcctccaccgtcctagccctcccgccctgttctctagtgcggactagagcgtctcctcgccatttcctgtcgccctggggccccgcggggaaaaagggggagtagcaggacagcggagggaagtcgcgagcttaggtggtgtgtagacgccggaagtgttgggaaggaggccggaagctaggggcggggccaggaagtgaggaggggcgggggtttatgaggagtccaagggagcattggggcagacttgtactcagagccacctgagggacttggcggtggcgcccagcactgtcccctcccctcgtagagacacggttgtcgtttgggagtagggaacactgtgttggggtgggttgtcggcaggacatctctctggctgctcttggggcgaggtgtggaggggcagggctgggggtggagccgggtcgccagggcgtcggtagggaagacccccgcccctcgcccccccaccgaacctctacactggctggctggacactaagatggctgccgttgccatgacacccaaccctgtgcagacccttcaggaggaggcggtgtgcgccatctgcctcgattacttcacggaccccgtgtccatcggctgcgggcacaacttctgccgagtttgtgtaacccagttgtggggtggggaggatgaggaggacagagatgagttagatcgggaggaggaggaggaggacggagaggaggaggaagtggaggctgtgggggctggcgcggggtgggacacccccatgcgggatgaagactacgagggtgacatggaggaggaggtcgaggaggaagaagagggtgtgttctggaccagtggcatgagcaggtccagctgggacaacatggactatgtgtgggaggaggaggacgaggaggaagacctggactactacttgggggacatggaggaggaggacctgaggggggaggatgaggaggacgaggaggaagtgctggaggaggttgaggaagaggatctagaccccgtcaccccactgcccccgcctccagcccctcggaggtgcttcacatgccctcagtgccgaaagagctttcctcggcggagcttccgccccaacctgcagctggccaatatggtccaggtgattcggcagatgcacccaacccctggtcgagggagccgcgtgaccgatcagggcatctgtcccaaacaccaagaagccctgaagctcttctgcgaggtagacgaagaggccatctgtgtggtgtgccgagaatccaggagccacaaacagcacagcgtggtgccattggaggaggtggtgcaggagtacaaggccaaactgcaggggcacgtggaaccactgaggaagcacctggaggcagtgcagaagatgaaagccaaggaggagaggcgagtgacagaactgaagagccagatgaagtcagagctggcagcggtggcctcggagtttgggcgactgacacggtttctggctgaagagcaggcagggctggaacggcgtctcagagagatgcatgaagcccagctggggcgtgcgggagccgcggctagtcgccttgcagaacaggccgcccagctcagccgcctgctggcagaggcccaggagcggagccagcaggggggtctccggctgctccaggacatcaaggagactttcaataggtgtgaagaggtacagctgcagcccccagaggtctggtcccctgacccgtgccaaccccatagccatgacttcctgacagatgccatcgtgaggaaaatgagccggatgttctgtcaggctgcgagagtggacctgacgctggaccctgacacggctcacccggccctgatgctgtcccctgaccgccggggggtccgcctggcagagcggcggcaggaggttgctgaccatcccaagcgcttctcggccgactgctgcgtactgggggcccagggcttccgctccggccggcactactgggaggagcctaaagaaccctcctggcctccagctcagccttctctcacctactatgtctgtccaacagaccggccagaatttagcttcacttgagagagatctggaatggtcgccatgattgaaaccacgcaccattacatcatcattacattaattacatcaacataaattatttcttcccccttcccttttccagcactcaaccaaggagcaaagctcatcccaccccacacccctcccaggtctgctcactgccaggctcctctcccctttgttcagtggagctggcttttctcccagcccctttccatgcctttcactccatttggcaagctctgagggggagcctggggacgggtttgggtccccaggaggagagccttgggtataatctatttttctaggagcctcttgccttgtcacttgcagctttcgccctctgctttgatggctgaggtgaactcatgttctttgggaaaagggaaggcgtgctgtggaaataaaatgtttatttgcttctctaaaaaaaaaaaaaaaaa

SEQ ID NO: 1112 - DNA, 2268 bp, Homo sapiens
ggcggcgccctgggcggccgcggagtcatggacggcagtggacccttcagctgccccatctgcctagagccactccgggagccggtgacgctgccctgcggccacaacttctgtctcgcctgcctgggcgcgctctggccgcatcgtggcgcgagtggagccggcggacccggaggcgcggcccgctgcccgctgtgccaggagcccttccccgacggccttcagctccgcaagaaccacacgctgtccgagctgctgcagctccgccagggctcgggccccgggtccggccccggcccggcccctgccctggccccggagccctcggcacccagcgcgctgcccagtgtcccggagccgtcggccccctgcgctcccgagccgtggcccgcgggcgaagagccagtgcgctgcgacgcgtgccccgagggcgcggccctgcccgccgcgctgtcctgcctctcctgcctcgcctccttttgccccgcgcacctgggcccgcacgagcgcagccccgccctccgcggacaccgcctggtgccgccgctgcgccggctagaggagagcctgtgcccgcgccacctacggccgctcgagcgctactgccgcgcggagcgcgtgtgtctgtgcgaggcctgcgccgcacaggagcaccgcggccacgagctggtgccgctggagcaggagcgcgcgcttcaggaggctgagcagtccaaagtcctgagcgccgtggaggaccgcatggacgagctgggtgctggcattgcacagtccaggcgcacagtggccctcatcaagagtgcagccgtagcagagcgggagagggtgagccggctgtttgcagatgctgcggccgccctgcagggcttccagacccaggtgctgggcttcatcgaggagggggaagctgccatgctaggccgctcccagggtgacctgcggcgacaggaggaacagcgcagccgcctgagccgagcccgccagaatctcagccaggtccctgaagctgactcagtcagcttcctgcaggagctgctggcactaaggctggccctggaggatgggtgtggccctgggcctggacccccgagggagctcagcttcaccaaatcatcccaagctgtccgtgcagtgagagacatgctggccgtggcctgcgtcaaccagtgggagcagctgagggggccgggtggcaacgaggatgggccacagaagctggactcggaagctgatgctgagccccaagacctcgagagtacgaacctcttggagagtgaagctcccagggactatttcctcaagtttgcctatattgtggatttggacagcgacacagcagacaagttcctgcagctgtttggaaccaaaggtgtcaagagggtgctgtgtcctatcaactaccccttgtcgcccacccgcttcacccattgtgagcaggtgctgggcgagggtgccctggaccgaggcacctactactgggaggtggagattatcgagggctgggtcagcatgggggtcatggccgaagacttctccccacaagagccctacgaccgcggccggctgggccgcaacgcccactcctgctgcctgcagtggaatggacgcagcttctccgtctggtttcatgggctggaggctcccctgccccaccccttctcgcccacggttggggtctgcctggaatacgctgaccgtgccttggccttctatgctgtacgggacggcaagatgagcctcctgcggaggctgaaggcctcccggccccgccggggtggcatcccggcctcccccattgaccccttccagagccgcctggacagtcactttgcggggctcttcacccacagactcaagcctgccttcttcctggagagtgtggacgcccacttgcagatcgggcccctcaagaagtcctgcatatccgtgctgaagaggaggtgatgccgggcacgggcgctcctgctgccgtctctgctccaggaagctgcctcctctgggccctctccttcgtctgggaaggcaccagcatgagtcccacacacccagccttctcatttctagaggcttccacctttttatacactcagccttccctctcccaggcaggaggacccccagaccctgttcccctgcagacctcacttctgggagacagagctacagctgggacagctccaagctaccctaacccctcctttcccaggtttctagaatagtgtctggcatgtagtagatgctcaataaacacttgttgaatgaaaaaaa

SEQ ID NO: 1113 - DNA, 1463 bp, Homo sapiens
cttagagggagctgtgttttggtgacctctgaaactcagtactgcagcgaatgagctcctgaccttgaggagtacttaacagaattatgtctcgaagaatcattgtgggaacccttcaaagaacccagcgaaacatgaattctggaatctcgcaagtcttccagagggaactcacctgccccatctgcatgaactacttcatagacccggtcaccatagactgtgggcacagcttttgcaggccctgtttctacctcaactggcaagacatcccaattcttactcagtgctttgaatgcataaagacaatacagcagagaaacctcaaaactaacattcgattgaagaagatggcttcccttgccagaaaagccagtctctggctattcctgagctctgaggagcaaatgtgtggcattcacagggagacaaagaagatgttctgtgaagtggacaggagcctgctctgtttgctgtgctccagctctcaggagcaccggtatcacagacactgtcccgctgagtgggctgctgaggaacactgggagaagcttttaaagaaaatgcagtctttatgggaaaaagcttgtgaaaatcagagaaacctgaatgtggaaaccaccagaatcagccactggaaggcttttggagacatattatacaggagtgagtccgtgctgctgcacatgccccagcctctgaatctagcgctcagggcagggcccatcactggactgagggacaggctcaaccaattctgagtggatattactctgcatcacaatgaagccaacagtcatatcttccgatgtggagatttgagaagcatttgtattggatgtgaccgtcaaaatccgccccatatcactgcaacacctacaagttttcttgcatggggtgctcagactttcacctctggcaaatattactgggaggtccatgtgggggactcttggaattgggcttttggtgtctgtaataagtattggaaagggaagaatcagaatggcaatatatatggagaggagggactctttagtcttgggtgtgttaagaacgacattcagtgcagtctctttaccacctccccaattacactgcagtatgtcccaagacctaccaaccatgtagaattattcctggattgtgaagctagaactgtgagcttcgttgatgttagtcaaagctcccctatatacaccatccctaattgctccttctcacttcctctcagacctatctttttctgtattctcctctgaccagagacaaatcagaaatgtgttcatctgctgtgggaacccctttatcccagaaagccctcttccttgtgccttatcaaacaggacaaataggttcggttttatgtcttgaattgcattctaatgttattaaaactcatttattgtgttactattaaatgtagtaaaaacactaaaagtataaaaaaaaaaaaaaaaaaa

SEQ ID NO: 1114 - DNA, 3399 bp, Homo sapiens
agtttatctttcactttcctgccctgagtgtgagcaagaatttcctgcggttcctctaggaaaattcctttgtgcagatcaggcccgtggattggtgagtgaatcctaaccacgtcttccctggcctgtcttcactcttctccccagaatcaccacttctgcactggtgtctgaaggtgtattgagtgattttgtggagggcagaagtaggaagtctttgggacaaaactgtatttaccttgggatctgtgaacaagaggaacctcagcagccaggacaggcaggagcagtggaatagctactatggcttctggaatcctggttaatgtaaaggaggaggtgacctgccccatctgcctggaactcctgacacaacccctgagcctggactgcggccacagcttctgccaagcatgcctcactgcaaaccacaagaagtccatgctagacaaaggagagagtagctgccctgtgtgccggatcagttaccagcctgagaacatacggcctaatcggcatgtagccaacatagtggagaagctcagggaggtcaagttgagcccagaggggcagaaagttgatcattgtgcacgccatggagagaaacttctactcttctgtcaggaggacgggaaggtcatttgctggctttgtgagcggtctcaggagcaccgtggtcaccacacgttcctcacagaggaggttgcccgggagtaccaagtgaagctccaggcagctctggagatgctgaggcagaagcagcaggaagctgaagagttagaagctgacatcagagaagagaaagcttcctggaagactcaaatacagtatgacaaaaccaacgtcttggcagattttgagcaactgagagacatcctggactgggaggagagcaatgagctgcaaaacctggagaaggaggaggaagacattctgaaaagccttacgaactctgaaactgagatggtgcagcagacccagtccctgagagagctcatctcagatctggagcatcggctgcaggggtcagtgatggagctgcttcagggtgtggatggcgtcataaaaaggacggagaacgtgaccttgaagaagccagaaacttttccaaaaaatcaaaggagagtgtttcgagctcctgatctgaaaggaatgctagaagtgtttagagagctgacagatgtccgacgctactgggttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttacacactcagccccttctgtacagcacctcttgtccaggtgcatctcatacacctgaactcatttgcatcattttaaccatcttttccttgctgtctcccttctttctatttgaacgtccttcactcatcagtaaaatgtaataattgccttgtgccatattgtccccaatattttattgacatttgatagcaatttttttcatcattttccgtactcctaaggaaaactgacctatacctcataaaatgagaccgctatttaggtattacttctgccagatatttatcacccaattgcctctgacactgactaagaagatgaagaaaagcttttcaacagcctttctatatcatcgtgtgataattgttcaccaatgaatgagtccttagccctgtgtcagtttaccctcgatgcccttatttgtgagttaaagagaaaatatcataaatggtatactcttaagtatagaggttttgtatctagaggatctcagttcaactcctgtctctccatataccagcagtgtaactgtgaataacatacttaaatggctgtgcttatttccttttcttttcttttttctttttttttttttttgagatgaagttttgctcttgttccccaggctggagtgcaatggcacgatctcggttcactgcaacctccacctctcagattcaagcaattctcctgcctcagcctcccaagtagctgggattacaggtgcccaccaccacccctggctaaatttgtattttcagtagagacggggtttccccatgttggttaggctcgtctagaacctctgacctcaggtgatccacccgcctcggcctcccaaagtgctgggattacaggcgtgagccacggcgcccagcctgtgcttattttcttaaaataatttttgtattaaaaacttcacattaaataagtgctaatgttttattgcatagtagggtgactagagttaacaataacctattgcatatattttgaaatagctagaagagaggattttgaaagttctcaacacaaagaaatgacacatatttgaggtgatggatatgctaattaccctggttcggttattacgcaatgtatacatgtatcaaaacatcacactgtaccacataaatatgtatatttattatttgtcaattaaaagcaaaataaaacaaaaaaccttcatctaatactttggatcattgtgaaaaaataaattcctgaagtataaagcatctatctaagtgtcttgatctaataagtacttgttctacaaattattgaaaaacataaactctgttaatgtctcatggaacaggttgtgccttcagggaaactaggattggatttactaaattctcattttttagatctcagatactactgtcaaaatgacttcaattctgccttctatatataatacacacatatatttaggattttattgtaattctagtgttgctacatattagtctttatcaaacaaactgaattatgtgggaatcagtttattaattgtaaaaaataattataataaaattagctgatgtagttttttaaaagttaaacgagttttttgaatagcttcactcatttctagc

SEQ ID NO: 1115 - DNA, 8106 bp, Homo sapiens
gatccgctgccgctttccgagcgagtgtcatggcggccggcgtcgagttggcaggagtaacccacggaactgaggaaagtcattagagctgagaaagaagtggcccaatctggacggtgggaattcgtgggaatgagcagaaggccctccgtaggtgactgtgtcactagaggcgggcccctggtaaaattccaggccaggcctctgcgtttctaggcagaacctggagtcggccttgcctgagaacccagctttgtgttatcgtatcctgtctcgcgaaggcaggcgttcaaggatatttggtcggatcgcccggcggcgctaaacgttttcttttttccgagcggaccgggtcgttctctaaactcgccgcgatgtcgtcctggcttgggggcctcggctccggattgggccagtctctgggtcaagtcgggggcagcctggcttccctcactggccagatatcaaactttacaaaggatatgctgatggagggcacggaggaagtggaagcagaattacctgattctaggacaaaggaaattgaagccattcatgcaatcttgagatcagagaatgaaaggcttaagaaactttgtactgatctagaagagaaacatgaagcatcagagattcaaataaagcagcaatctacaagttaccgaaatcaacttcaacaaaaagaggtagaaatcagccatcttaaagccagacagattgcactccaggatcagttgctgaaactgcagtcagctgctcagtcagtaccttcaggagctggtgtaccagcaaccactgcatcatcttcattcgcttatgggattagtcatcatccttcagctttccatgacgatgacatggactttggtgatataatttcatcccaacaagaaataaaccgactctcaaatgaagtttcaagacttgagtctgaagttggccattggaggcatattgctcagacttccaaagcacaaggaacagataactctgatcaaagtgaaatatgtaaactacaaaatatcattaaggaactaaaacagaaccgaagtcaggaaattgatgaccatcaacatgaaatgtcagtactgcagaatgcacaccaacagaaattgacagaaataagtcgacgacatcgagaagaattaagtgactatgaagaacgaattgaagaacttgaaaatctgttacaacaaggtggctctggagttatagaaactgatctctctaaaatctatgagatgcaaaaaactattcaagttctacaaatagaaaaagtggagtctaccaaaaaaatggaacaacttgaggataaaataaaagatataaataaaaaattatcttctgcagaaaatgacagagatattttgaggagagaacaagaacagctaaatgtggaaaagagacaaataatggaagaatgtgaaaacttgaaattggaatgtagtaaattgcagccttctgctgtgaagcaaagtgatactatgacagaaaaggaaagaattcttgcccagagtgcatcagtggaagaagtgttcagactacaacaagcactgtctgatgccgaaaatgaaataatgagattgagtagtttaaaccaggataacagtcttgctgaagacaatctgaaacttaaaatgcgtatcgaagttttagaaaaagagaagtcattactgagtcaagaaaaggaagaacttcagatgtcacttttaaaattgaacaatgaatatgaagtaattaaaagtacagctacaagagacataagtttggattcagaattacatgacttaagacttaatttggaggcaaaggaacaagaactcaatcagagtattagtgaaaaggaaacactgatagctgagatagaagaattggacagacagaatcaagaagctacaaagcacatgattttgataaaagatcagctatcaaaacaacaaaatgaaggagatagcatcatcagtaaactgaaacaagatctaaatgatgaaaaaaagagagttcatcaacttgaagatgataaaatggacattactaaagagttagatgtacagaaagaaaagctaattcaaagtgaagtggccctaaatgatttacatttaaccaagcagaaacttgaggacaaagtagaaaatttagtagatcagctaaataaatcacaagaaagtaatgtaagcatccagaaggagaatttagaacttaaggagcatattagacaaaatgaggaggagctttctagaataaggaatgagttaatgcagtctctaaatcaagactctaatagtaattttaaggataccttacttaaagaaagagaagctgaagttagaaacttaaagcaaaatctttcagaattagaacagctcaatgaaaatttaaagaaagttgcttttgatgtcaaaatggaaaatgaaaagttagttttagcatgtgaagatgtgaggcatcagttagaagaatgtcttgctggtaacaatcagctttctctggaaaaaaacactattgtggagactctaaaaatggaaaaaggagagatagaggcagaattgtgttgggctaaaaagaggctgttggaagaagcaaacaagtatgagaaaaccattgaagaactgtcaaatgcacgtaatttgaatacctctgccttacagctggaacatgagcatttaattaaactcaatcaaaagaaagacatggaaatagcagaactcaaaaagaatattgaacaaatggatactgaccataaagaaactaaggacgttttgtcatctagtttagaagagcagaagcagttgacacaacttataaacaagaaagaaatttttattgaaaagcttaaagaaagaagttcaaagctgcaggaggaattggataaatattctcaggccttaagaaaaaatgaaattttaagacagaccatagaggaaaaagaccgaagtcttggatccatgaaagaggaaaataatcatctgcaagaagaattggaacgactcagggaagagcagagtcgaaccgcacctgtggctgaccctaaaacccttgatagtgttactgaactagcatctgaggtatctcaactgaacacgatcaaggaacatcttgaagaggaaattaaacatcatcaaaagataattgaagatcaaaaccagagtaagatgcaactacttcagtctttacaagagcaaaagaaggaaatggatgagtttagataccagcatgagcaaatgaacgccacacacacccagctctttttagagaaggatgaggaaattaagagtttgcaaaaaacaattgaacaaatcaaaacccagttgcatgaagaaagacaggacattcaaacagataactctgatatttttcaagaaacaaaagttcagagccttaatatagaaaatggaagtgaaaagcatgatttatctaaagctgaaacggaaagattagtgaaaggaataaaagagcgagaactggagattaaacttctaaatgaaaagaatatatctttaactaaacagattgatcagttgtccaaagatgaagttggtaaactaactcagattattcagcagaaagatttggagatacaagctcttcatgctagaatttcttcaacttcccatactcaagatgttgtttaccttcaacagcaactgcaggcttatgctatggaaagagaaaaggtatttgctgttttgaatgagaagactagggaaaatagccatctaaaaacagaatatcacaaaatgatggatattgttgctgccaaggaagcagctcttatcaaactgcaagatgaaaataaaaaattgtccactagatttgaaagtagtggccaagatatgtttagagaaactattcagaatttatcacgtatcattcgagaaaaagacatcgaaatagatgcactaagtcagaaatgtcagactttattggcagttttacaaacatccagcactggtaatgaggctggaggtgttaatagtaatcaatttgaggagcttctacaggaacgtgacaagttaaaacagcaagtaaagaaaatggaagagtggaagcagcaggtgatgaccacagtacaaaatatgcaacacgagtcagcccagcttcaggaagagcttcaccaacttcaagcacaggttttggttgacagtgataataattctaaattacaagtggactatactggcctgatccaaagttatgagcagaatgaaaccaaactcaaaaattttgggcaggaattagcacaagttcagcacagcattgggcagctttgcaataccaaggatcttcttttaggaaaacttgatattatttcaccccagctgtcttctgcatcattgcttactccccagtctgcagagtgtcttagagcaagtaagtctgaagtattgagtgaatcttctgaattgcttcagcaagagttagaagagctaagaaaatcactacaggaaaaagatgcaacaattagaactctccaggaaaataaccacagattgtctgattcgattgctgccacctcagagctagaaagaaaagaacacgaacaaaccgattcagaaatcaagcagctaaaggagaaacaagatgttttgcaaaagttacttaaggaaaaagacctcttaatcaaagccaaaagtgatcaactactttcttccaatgaaaatttcactaacaaagtaaatgaaaacgaacttttgaggcaggcagtaacaaacctgaaggagagaatattaattctagagatggacattggcaaactaaaaggagaaaatgaaaaaatagtggaaacatacaggggaaaggaaacagaatatcaagcgttacaagagactaacatgaagttttctatgatgctgcgagaaaaagagtttgagtgccactcaatgaaggagaaggctcttgcttttgaacagctattgaaagagaaagaacagggcaagactggagagttaaatcagcttttaaatgcagttaaatcaatgcaggagaagacagttgtgtttcaacaggagagagaccaagtcatgttggccctgaaacaaaaacaaatggaaaatactgccctacagaatgaggttcaacgtttacgtgacaaagaatttcgttcaaaccaagagctagagagattgcgtaatcatcttttagaatcagaagattcttatacccgtgaagctttggctgcagaagatagagaggctaaactaagaaagaaagtcacagtattggaggaaaagctagtttcatcctctaatgcaatggaaaatgcaagccatcaagccagtgtgcaggtagagtcattgcaagaacagttgaatgtagtttccaagcaaagggatgaaactgcgctgcagctttctgtctctcaggaacaagtaaagcagtatgctctgtcactggccaacctgcagatggtactagagcatttccaacaagaggaaaaagctatgtattctgctgaactcgaaaagcaaaaacagcttatagctgaatggaagaaaaacgcagaaaatctggaaggaaaagtgatatcattacaggaatgtttggatgaagcaaatgctgcattggattcagcatcaagacttacagaacagttagatgtaaaagaagaacaaattgaagaacttaaaagacaaaatgagctccgacaagaaatgctggatgatgtacaaaagaaattgatgagcttagcaaacagctcagaaggaaaagtagacaaagtcctaatgagaaacctcttcattggtcatttccacacaccgaaaaatcagcgtcatgaagtgttacggttaatggggagcatcctgggcgtcagaagggaggagatggagcagttgtttcatgacgatcagggcggtgttaccaggtggatgactgggtggcttggaggaggatcaaaaagtgttcccaacacacctttgagaccaaatcagcaatctgtggttaatagttctttttcagaactttttgttaaatttctagaaacagaatctcatccatccattccaccaccaaagctttctgttcatgatatgaaacctctggattcaccaggaagaagaaaaagagatacaaatgcaccagaaagttttaaagatacagcagaatccaggtctggtagaagaacagatgtaaatccgtttttggctcctcgctcggcagctgtacctcttattaacccagctggacttggacctggtgggcccgggcatcttcttctgaaacccatctcagatgttttgcccacatttacacctttgccagcgttacctgacaacagtgctggggttgtgctgaaagaccttttaaagcaatagatgattctcaagccagagacaatctagcactttaaagaaaccatgaacactatatgtatgtactttatcacaaagtggcctttggggagaaagtcatgtatttgttcgcaattatgctttctctgaatttaataaaaatattcctaatgcttttagaaactgcaggtgtcaggagcaagtgtttgctatataatctgctttattccttctgatttgacctaatttaagctaggaacatttaatttatcttttaccttaatttacaaaaatacagacagacaaaaatactagtagctatatggcagctttttatttccttttgtgatttccaagctcatttaagctagagattgtggtttatcaagagagtgttttttttttttaaacgaagaataaaaaaatactagtagtggcttctctgcatagtgcagaaagttgatttgaagcatatattgatcatctttagaggactttgtggagacaggccaacaagattgttgctggaaggtcataggttccctgaggtgaagtatgtatttggtcctgtgcaatattatcatgtgtgtagattctttttttgtttgttttaaatagagatggggtctcactatgttgccaggctggcctcaaactcctgggctcaagtgatcctcccacctcagcctcccaaagtgctgggattaaggcatgagccactgcgcctggccctgtgtgtaaattcatgtgactaccaccacaggcaagacacggaagacttccattacaagcatccccctgtgttgccctctcataatcattgccacctctctccctggccctctccttaatccctgacaaccacttactgttctccatctcagtcattttgttattttgagaatgttatataaatggaatcaatatataccctcttgagactggctttttttcactcagcataattcccttgagatccatccaaggctttggatgtatcactagtttgttcctttttattgttgagcatatagtgcagatatatcacttagttttaacagctaaggtatctatttaaagataccatcttaaaactaaatgttacacaaattcatgcaactttcatataagcattaaaccatacagctgcatctacgtaagtataattagcaaaatcactgaacatgccacttcctgcctccgtctgcggtgttgacatatgaggtacagcaatccgagagtcaactgttatcacggtggccactgagggcagtgaaatcactttgatagcaccagtacccagatgtttgaaacttaagaaagtatttctttaatttttcataaacccatcataaaaaaaaaatcccgacttgaaacttaactgtatctggatgttcatatttttattagttgttgaagttgtacatttaaaaagatatttcttgcaaattttgtaaatttctatatgcttttaaaatagaaacatttgtataacaaggaaggatgaaaataaaacaaattcaaatatgtgaatagtcctggctgaggccagaactaaatttggttatttgcaagttttactgtgattaactgtactttctaatgtatttggaagactggaagtcttaattccatgttgatgggtgaaacttgtttttctgaaaaatgaagtaactgaaaatgctgcttcagaatgtcttgtatctccttagataactaatttatattgccattctttatttactatactttaaaggaagttgtcatgcaagttctatattagaactgtcaaactgccaaaaaaaaaaaaaaaaaa

SEQ ID NO: 1116 - DNA, 2408 bp, Homo sapiens
cgggtcaggaggtggtgcgcctcgcgcggcagattcgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaattttaaaaaaaaaaaaaaaaaa

SEQ ID NO: 1117 - DNA, 4103 bp, Homo sapiens
agctgagagtgacgcctctgagccgcggaggattgtgggaggaggttgtctccaatttctcctccccctcccggccaagatgtctgacatggaggatgatttcatgtgcgatgatgaggaggactacgacctggaatactctgaagatagtaactccgagccaaatgtggatttggaaaatcagtactataattccaaagcattaaaagaagatgacccaaaagcggcattaagcagtttccaaaaggttttggaacttgaaggtgaaaaaggagaatggggatttaaagcactgaaacaaatgattaagattaacttcaagttgacaaactttccagaaatgatgaatagatataagcagctattgacctatattcggagtgcagtcacaagaaattattctgaaaaatccattaattctattcttgattatatctctacttctaaacagatggatttactgcaggaattctatgaaacaacactggaagctttgaaagatgctaagaatgatagactgtggtttaagacaaacacaaagcttggaaaattatatttagaacgagaggaatatggaaagcttcaaaaaattttacgccagttacatcagtcgtgccagactgatgatggagaagatgatctgaaaaaaggtacacagttattagaaatatatgctttggaaattcaaatgtacacagcacagaaaaataacaaaaaacttaaagcactctatgaacagtcacttcacatcaagtctgccatccctcatccactgattatgggagttatcagagaatgtggtggtaaaatgcacttgagggaaggtgaatttgaaaaggcacacactgatttttttgaagccttcaagaattatgatgaatctggaagtccaagacgaaccacttgcttaaaatatttggtcttagcaaatatgcttatgaaatcgggaataaatccatttgactcacaggaggccaagccgtacaaaaatgatccagaaattttagcaatgacgaatttagtaagtgcctatcagaataatgacatcactgaatttgaaaagattctaaaaacaaatcacagcaacatcatggatgatcctttcataagagaacacattgaagagcttttgcgaaacatcagaacacaagtgcttataaaattaattaagccttacacaagaatacatattccttttatttctaaggagttaaacatagatgtagctgatgtggagagcttgctggtgcagtgcatattggataacactattcatggccgaattgatcaagtcaaccaactccttgaactggatcatcagaagaggggtggtgcacgatatactgcactagataaatggaccaaccaactaaattctctcaaccaggctgtagtcagtaaactggcttaacagagaacaagcttttacagacgtccttaaggcaacagtgcagagatgtaatccttaaaagaactgggaatggcaaaactactgtcggttgatgtgtcctgaaaattattggagttatggcagaagtgcttttttgatcaactggtttgtgttttgctgctgcatttatcccaagaaaaacagctttaatctccagaagaaaaccaaaataccatgggatttatgctgtattgacatcttgccctaaacgtacaacatcatagtaatttgtcatgggcaacatgaccagagagaagatttttgtcatgattttaaatacactgacacgctactgttggttaaatttaaacatgttttacctgcagaaattctctcacaaataacctgcaataacttgaaatgcatacccttttgaacacttccttttctcatgtataaattaaaatgtttgctgcattttgcaaaatgtcaattctctaaaaatgtgtccgtatatttctgtacctgcagtgtagtaaaggtttagacgaaaccccataattatagtggcatactgtcacttaggtttcaagcagcaaaataaacagtgcagctcagaaattgtagtttggttcttgatgtgtttttattacatttggagttgttttgttttttagtaccttcgaaatttcaaattattttatcttcagttaatgattttaaaaagcctgggggcaaataagttggttatttgctttcaagtttttaaaagtagtctttattgatagagtaaggagaactactttctaacaaaacacgtgcatagttatgacagtgatgctttaaaggaataaaattctttttttttaaagagtgatattccttttcaaaagaatactaactctcagaatgttcactttaaacgaatatgccagaacatagacagctaaatgaatgttactctgcatagtgatcatgctggaaggttatttcctaatgccagcaatctaccattgcccaaaacctgctgagtttactcttttagaattgcattcaaagttaatttgtcacacacactaaactttatgattatacattgttttaaaaaatatagtattaggaagcttgattatttttagttaccattacttggcaccaaatgaaagtttccaaaacttccacctaactttgaggtaatgcagaaagtatataactggctttgaaggcaatcccaaaagagttttaaaggttttttgagcagtggcagtatacttaggagaatgaactgtggccttccaaggtaactaccttaaaggaactcagctcatttgaatgtattgagttttggatgtatttgtttcattttttaaaaagttcacattattttatagtgtcgaaaggaagaactaggattaacataatttctttggtttttctattgcttgttattattatgtaaaaactgggtggcagttcagaaggaagattgtggttacagaagagtgacaaccaagaattttttgatcattaaatcagattttataaacagtggaaggagcatggacttaaaacaaggcatgcttattcggttttgtcaaaattttacgaaaatatgtgatatatatttatactaaaaatatataatccttagatttagaaaagcaatcagttaatgtctttagcagactaaagcagtattaaacacaggtacaagttggaaattgtagaaaacggaaagaaaacaaaagacaaaatgtctatggtagggaataaaagtttaagatattataaaattatgtgtattttctcttttacataaatcatttgtgaaaagtgtgctaaactttttttacaagagtgatattaattaggatttatttttcaatataatttggagaccctttgttatccaaataaaaatgatgagtttttgtgcctgtattcaaatatgtatgcatgtgataacccttgaaagctaaagcccttcttaacttttgagttgatggaattagaattcaaagatttgaatgaaatgatttaacctttatcctccaattcttacagtgcccagttctcctgtgctatctttgctttgtacaatagtgcatcttccactttctagagagaaagcatgcacttgttatttggaaaactgggctaaatatataacagtatccaaagttataccataataatttattgtaattgtgtattacatagctttgtttacccagatataggtgcgttcttttttttctgttagtcatctgtgacttttgttctggaatacaggtttttaaatatatcttaacagtctgactaacttaaaataatttattcttcccttaaaacatttttctgtgtttttgtgcatcaaatattgtagagttgaaatcttagagattgcttatcgaaatataaatttaggggaagttaaaaatcgattggcaaatttgtagcatttattcactgattaaatcttttccacttttgtgaaaaccataccagtggtttacatcatattgtaatgtgttcatctcattcttctttttatccctaaacctagctaaaagttactgcaaagaaatctttggctgccacaagtagatgctctctactacaagagctggatttccattactcactcttgctcttacattaaagttgttgattaaatactttttctctacatcttaaaaaaaaaaaaaaaaaa

SEQ ID NO: 1118 - DNA, 2044 bp, Homo sapiens
ggacgtggggcttttgcagctcagctggttccggctggggaagatggcggtggctggggcggtgtccggggagccgctggtgcactggtgcacccagcagttgcggaagactttcggcctggatgtcagcgaggagatcattcagtacgttttgtcaattgagagtgctgaagagatacgagaatatgttactgatctcctccagggaaatgaaggcaaaaaaggtcaattcatagaagaacttataaccaaatggcaaaagaatgatcaggagttgatttcggatcctttgcagcagtgcttcaaaaaagatgaaattttagatgggcagaaatcaggcgaccatctaaagcggggtaggaagaaagggagaaacagacaggaagttcctgcatttactgaacctgacacgactgcagaggttaaaacaccttttgatttggccaaggcacaagagaacagcaactccgtaaagaagaagacaaagtttgtcaatttatacacaagagagggacaggacaggcttgcagtcctgctccctggtcgtcacccttgtgattgcctgggccagaagcacaagctcatcaataactgtctgatctgtgggcgcattgtctgtgaacaagaaggctcaggcccttgcttattctgtggcactctggtgtgtactcatgaggaacaagatattttacagcgtgactcaaacaagagccagaaactgctaaagaaactcatgtcaggagtggagaattctggaaaggtggacatctctaccaaggaccttcttcctcatcaagaattgcgaattaagtctggtctggagaaggctatcaagcataaagacaaactgttagagtttgacagaactagtattcgaaggacccaagtcattgatgatgagtcagattactttgccagtgattctaaccaatggttgtccaaacttgagcgggaaaccttgcagaagcgagaggaggagctgagagaacttcgacacgcctctcgactttctaagaaggtcaccattgactttgcaggaaggaagatcctggaagaagaaaattcactagcagagtatcatagcagactagatgagacaatacaggccattgccaatggaaccttgaaccagccactgaccaaattggatagatcttctgaagagcctttgggagttctggtaaatcccaacatgtaccagtcccctccccagtgggttgaccacacaggtgcagcctcacagaagaaggctttccgttcttcaggatttggactagagttcaactcatttcagcaccagttgcgaatccaggatcaagaatttcaggaaggctttgatggtggctggtgcctctctgtacatcagccctgggcttctctgcttgtcagagggattaaaagggtggagggcagatcctggtacaccccccacagaggacgactttggatagcagccacagctaaaaaaccctcccctcaagaagtctcagaactccaggctacatatcgtcttcttcgtgggaaagatgtggaatttcctaatgactatccgtcaggttgtcttctgggctgtgtggacctaattgactgcttgtcccagaagcaatttaaggagcagtttccagacatcagtcaagagtctgattctccatttgttttcatctgcaaaaatcctcaggaaatggttgtgaagtttcctattaaaggaaatccaaaaatctggaaattggattccaagatccatcaaggagcaaagaaggggttaatgaagcagaataaagctgtctgacccaggagaaaaggaactatacagcatagtggagttttgtgtactaaaattgctatctactggtcctttggaattgaagtagtagaaacctaaaggcttggcgtcaggcttgaatatctcagaacttaaactcttaccaaaatctgtatatttttcttaaggagtgggattcctactttatgtaatggggtcgaaatctttgaacacattatttataaaaacctgtttaaaaattctaaaaaaaaaaaaaaaaaa

SEQ ID NO: 1119 - DNA, 660 bp, Homo sapiens
atgccgggcccacttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgcattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcaggcctggcgcatccaggagctctcagccaccgtcaggactgactgctgagtcttccatgaagtacctgctgggttctcagttccagttcccatcctttgattgatcactctccctgacatccacctgtatgactttgtcaccaaatgctgtcttctctttctccaatcaagaaataataatccctcgagtttacaaaacaaaaaaa

SEQ ID NO: 1120 - DNA, 8415 bp, Homo sapiens
tcgttctcatttgggtgtctgcactgttggaagctactgcactgtgtttccacgcagacagagtacagtgggaaaggctttctccagctgatggatggctgttctctttatttggagtatcttactggttatgtaagcgacctcgagagaaattatcctgacccagatcggaggatgcagtagtgcttcagctgcaggatttcttagtcgttaacaccacagtgctgatgacaaagagcgagttgtaatcctcatcactgccagggctgagccagagcagacagaaaatcgtcatttgctcgttggagacttgttaggttacagctcctgcttcgttctgtggtcttggcttttcttcctatacaatgacgccgctgcaagtgagctcagaaatgcttggtttgagagccatttgcctgtgatttttgaagactaaagaagtatttacactagatactcttccagaacaaaatagaaatttcagcaaatacttactgacctttaaagccttgttgtggatttctgagatttaaagatactttaaaattctcaagaacaaagtccttattccttaaatggatacagagtgagagtatatagacaagactctgccacccagtggtttactggcataattactcatcatgatctcttcacccgcaccatgatcgttatgaatgatcaggtactagaaccacagaatgtcgatccttctatggttcaaatgacctttctagatgatgttgttcactctttgttaaaaggtgaaaatattggcattacatcacgacgcaggtctcgtgccaatcaaaacgtcaacgctgttcacagccattatacacgtgcccaagcaaatagtcccagaccagcaatgaactcccaagctgctgtaccaaaacagaatacacaccagcaacagcaacaaagaagtatccgtccaaataagaggaagggctcagatagcagtataccagatgaagagaagatgaaggaggaaaaatatgattatatatcacgaggagaaaatcctaaaggtaaaaacaaacacttgatgaataaaagaaggaaacctgaggaggatgaaaagaaactaaatatgaaaagacttcgaactgacaatgtttcagacttttctgagagcagtgactcagaaaattcaaataagagaataatagataattcctcagaacagaagccagagaatgaattgaaaaataaaaatacttcaaaaataaatggagaagaaggaaaaccccataataatgagaaggcaggagaagagaccctaaaaaatagccagcctccctgggatcaaatacaggaagataaaaaacatgaagaagcagagaagcggaagtctgttgacactcagcttcaagaagatatgattattcattcgtcagaacagtccacagtttctgatcataattctaatgatttacttcctcaggaatgcaatatggataaaacacataccatggaattgctaccaaaggagaagtttgtatccagaccacccacaccaaaatgtgttattgatattacaaatgacactaatttagaaaaggtggctcaggaaaactcaagtacctttggccttcagacacttcagaaaatggatcctaatgttagtgattcaaaacactctattgcaaatgcaaaattcttggaaacagcaaaaaaagattctgaccagagctgggtcagtgatgtagttaaagtggatctaacccaatcaagtgttacaaatgcttcttcaggaaatgatcacttgaacatggaaaaagagaagtatgtctcttacatttctcctttaagtgcagtttctgtcatggaagataagctgcataagcgaagtccacctccagagactataaaatctaaacttaatacttcagtagatactcacaagataaaatccagcccatcacctgaagttgttaaacccaaaataactcattctcctgattctgtaaagtctaaggccacttatgtgaacagccaagctactggtgaaagaagattggcaaataagatagaacatgagctatcaagatgcagttttcatccaattcctactcgaagcagtacattagaaactacaaagagtcctcttatcattgataaaaatgagcattttacagtttacagagatcctgcacttattgggtcagaaacaggagctaatcatatttcacctttcctaagccagcatccttttcctcttcactcctcatctcatagaacctgtttaaatccaggtacccatcatcctgccttaactcctgcaccccatttactagccggatcatctagtcaaactccattacctaccattaacactcatcctctgactagtggtccacaccatgctgttcatcaccctcatttacttcccactgtgttacctggagtgcctactgcctccttacttggtggccacccacgactagagagtgctcatgccagcagcttgagccacttagcgctagcacaccagcaacaacaacagttgttacagcaccagtcacctcatcttcttggacaagcccatccttctgcttcatataatcagcttggactttatccaattatttggcagtatccaaatggaacacatgcatactcaggacttggtttgccttcttctaagtgggttcacccagaaaatgcagttaatgctgaagcttcattaaggaggaattctcccagtccttggctacatcagcccacccctgtgacctcagcagatggtattggattacttagtcacattcctgtcagaccttccagtgcagagcctcatcggcctcttaaaattacagcccattccagtccaccattgacaaaaactttagtagatcatcataaggaagaattagaaagaaaagcttttatggaaccattacggtctgttgcatccacatcagccaaaaatgacctggatctaaataggtcacagactggaaaagattgtcacttacataggcattttgtggatccagtattaaatcagttacagaggccaccccaggagactggagagaggttaaacaaatacaaagaggaacaccgtcgaattcttcaagaaagtattgatgttgctccctttacaactaaaatcaagggacttgagggtgagagagagaattattccagagtggcatcatcatcttccagtcctaaaagccatatcatcaaacaagatatggatgtagaacgctcagtatcagatctttataaaatgaagcactcagtgcctcagagtttaccccaaagtaactatttcactacattgtctaatagtgtggtcaatgaaccaccaagatcatacccatccaaagaagtttcaaatatttacggtgataaacagagtaatgcccttgcagcggcagcagctaatcctcaaactctgacttcatttataacatctctttcaaagcctccacctttgattaaacaccaaccagaaagtgaaggtttagtaggcaagataccagaacatcttccacatcagattgcatctcactcagtaacaaccttcagaaatgattgtaggagtcctacccatttgacagtttcttctacaaatacactccgcagtatgcctgcattacatagagcaccagtatttcacccaccaatccatcacagcctggaaagaaaggaaggcagctatagtagtctttcccctccaactttaactccggtgatgccagtaaatgctggtggtaaagttcaagaatcacagaagcctccaactctaatacccgaaccaaaagactcccaggcaaattttaagagttcttcagaacagagtttgacggagatgtggagacctaataataacctcagcaaagagaaaactgaatggcatgtggagaaaagcagcggaaagttacaggctgctatggcatctgtcattgtgcgtccatcttctagtacaaaaactgatagtatgccagcaatgcagttagcttctaaagatcgagttagtgaaagatcttcagctggggcacataaaacagattgcctcaaactagcagaagccggagaaactggaagaatcattttgccaaatgtgaattcagacagtgttcacacaaaatctgaaaaaaactttcaggctgtctcacagggcagtgttcccagttcagtcatgtctgctgtaaatacgatgtgtaataccaaaacggatgtaatcacatctgctgccgatactaccagtgtttccagctggggtggttcagaagtaatttcctctttatcaaataccattttggcctctacatcatcagaatgtgtatcttcaaaaagtgtcagtcagccagtggctcaaaaacaagaatgcaaggtcagcaccacagcaccagttacattagccagtagtaagacaggaagtgttgttcaacccagttctgggttctcaggcacaactgattttatccatttaaaaaagcacaaggcagcattggctgcagctcagtataaaagtagtaatgccagtgagactgaacctaatgctataaaaaatcagacactttcagcctcccttcctctggatagcactgtaatctgtagtacaattaacaaagcaaactctgtaggaaatgggcaagcttcccagacaagtcaaccaaactaccatactaaactgaaaaaggcctggctcaccagacactcagaagaagataaaaatactaataaaatggaaaattcagggaattctgtatcagaaattattaagccatgttctgtcaacttaatagcctctacatctagtgatatacaaaatagtgtagatagtaagatcatagttgataaatatgtaaaagatgataaagtcaacaggagaaaagccaaaagaacttatgaatctggctctgaaagtggagactcagatgaaagtgaaagcaagtcagagcaaaggactaaaagacaacctaagccaacttacaaaaagaagcaaaatgatttgcaaaagagaaaaggtgaaatagaagaagatttgaaacccaatggagttctcagcaggagtgccaaagaaagaagtaaactgaagttgcaaagcaacagtaatactggcattcctcgttcagtattgaaagattggcgtaaagtcaagaagctgaagcaaactggggaatcctttttacaggatgactcctgctgtgagatagggcctaatttacaaaagtgtcgagaatgtagacttattcgcagtaaaaaaggagaagaaccagctcactcaccagtattttgtagattttactactttagacggttgtcatttagtaaaaacggagtagttagaatagatggtttctcttctcctgaccaatatgatgatgaagctatgagtttgtggacacatgaaaattttgaagatgatgaactagatatagagacttctaaatatatcttggatataataggtgataagttctgtcaattagtaacatctgaaaaaacagctttgtcctgggtgaaaaaggatgccaaaattgcctggaaaagagcagtgagaggagtccgggagatgtgtgatgcatgtgaagcaacattgtttaacattcactgggtctgccaaaaatgtggatttgtggtctgcttagattgttacaaggcaaaggaaaggaagagttctagagataaagaactatatgcttggatgaagtgtgtgaagggacagcctcatgatcacaaacatttaatgccaacccaaattatacctggttctgttttgacagatcttctagatgccatgcacactcttagggaaaaatatggtattaaatcccattgtcattgtactaacaaacagaatttacaagttggaaattttcctacaatgaatggtgtatctcaatctcagcagcaaaatactcctccgaagtctgagaaaaatggtggcagcagcccagagagtgatgtaggcacagataacaagttaactcctccagaatcccagtcaccactgcactggttagcagatcttgcagagcaaaaagccagagaggaaaaaaaagaaaacaaagaacttacccttgaaaaccaaattaaagaagaaagagaacaagacaactctgaatctccaaatggcagaacatcacctcttgtgtcccagaataatgaacaaggctcaaccttacgggatttgctgactacaacagctggaaagctacgtgtggggtctacagatgctggcattgcctttgccccagtatattcaatgggagccccaagtagcaaaagtggacggactatgcctaacattcttgatgacataattgcttcagttgttgaaaacaaaattccaccaagtaaaacctccaagataaatgtaaaaccagagcttaaagaagagcctgaagaaagcataatatctgcagtggatgaaaataataaattatacagtgatataccacattcttggatctgtgagaagcatattttatggcttaaggattataagaatagcagtaattggaagcttttcaaagaatgttggaaacaaggacagcctgcagtggtttctggtgtgcataagaaaatgaacattagcctatggaaggcggaatcaattagtcttgattttggagaccaccaagctgatctcctgaactgcaaagatagcatcatttcaaatgccaatgttaaggaattctgggatggttttgaagaagtttcaaaacggcagaaaaacaagagtggagaaacagttgttttaaaattgaaagactggccttcaggagaagacttcaagactatgatgccagcaagatacgaagatcttttaaaaagtctgccattgccagaatattgtaatccagaaggaaaattcaatttggcctctcatttgccaggattttttgtacgtcctgatctaggacccaggttgtgcagtgcctatggtgtagttgctgctaaagatcatgatataggaacaacaaatctccatattgaagtttctgatgttgtaaatatactagtttatgttggcatagcaaaaggaaatggcattctctcaaaagcaggaattctcaagaaatttgaggaagaagatttggatgacattttaaggaaaagattgaaggactcaagtgaaatacctggtgctctgtggcatatttatgctgggaaagatgttgacaagataagggaatttcttcaaaagatttcaaaagaacaaggccttgaagttctaccagaacatgatccaatacgtgaccaaagttggtatgtgaacaaaaagctccgtcaaaggctgcttgaagaatatggagtcagaacctgtactcttattcagttccttggtgatgctattgttttgccagcgggagcacttcatcaggttcagaattttcacagctgtattcaggtaactgaagattttgtgtctccagaacatcttgtagagtcatttcatttaacacaggaactgagacttttgaaggaagaaatcaattatgatgataaactacaggttaaaaatattttgtatcatgcagtcaaagaaatggtgagagccttgaagatacacgaggatgaagtagaggatatggaagaaaattaagtgtgatccagtttgatatttttaggttgttgaactgggattacttaaccttgaatgatgatatgtatgcacactgactttaagcttcataaaaccatcagtgccaagaaattctctttgtagtaattacttgttactgacaccacagcagtatagcatatgtcacagctcctgtgattcaatgttataaaacaagcagaattttaaaagcagcactatatagctgttttgtattatagtgtatatgatgtttgtgaaaatgccagatttaaaatgatgtatttatttttggtaaaaaataaaaaattctatgctatattgttgatcaagtgtaaatgtgaccttgtacagtttactaaaattactgatatttttcactacattgagacagttactgtgagaataggacacaaacaccagctattgcctgcatctgggaaattgctgaatcgcacagcagtcatgtcataatcagaaaattactgccaaataattgtaaaatttgtaaagtataaagtatataaagtagatactaaatacagacacttcaatattttgttgaagctattgactgtacaattaaacattttcaaaaggtgtaatttatttaaaattgtctcattttggtaaaatttatgtgaacttttaaagctaaatattaaacttaatatgctatgtaaatatatacatatatacatttaatgatgtatttttttaaaacattggcttgcttttgttaaagtgcaagtgttacatatggctttgtacattaaagttgaaaggggttttacattttccattaaaaggactttatcaaaaaaaaaaaaaaaaaaaaaaaa

SEQ ID NO: 1121 - DNA, 5565 bp, Homo sapiens
ctcctgcacggcgagtgctggagcacgacgtaccgctcgctcggtcagggcgccccctccgcccgcctcctgcttcctcctccgctgcctgccgccgccgcctccaccattgtataatgctcggggcgcgcaggcagagaacggcggagtcttagcttcagcctcgcctgctgcccgctccccggcgccaccctcgggcccctggagcggggcactccgcatggagcgggagtagctgaggagtgggcggaaacccctcctgatgcgttagttcccaggtggagctgcatgtgatatatgttgggtaaaggaggaaaacggaagtttgatgagcatgaagatgggctggaaggcaaaatcgtgtctccctgtgacggtccatccaaggtgtcttacaccttacagcgccagactatcttcaacatttcccttatgaaactctataaccacaggcccctgacagagcccagcttgcaaaagaccgttttaattaacaacatgttgaggcggatccaggaggaactcaaacaggaaggcagcctgaggcccatgttcaccccctcctcccagcccaccaccgagcccagcgacagctaccgagaggccccgccggccttcagccacctggcgtccccgtcctcccacccctgcgacctcggaagcactacgcccctggaggcctgcctcaccccggcctcactgctcgaggacgacgatgacacgttttgcacctcccaggccatgcagcccacggctcccaccaaactgtcacctccagccctcttgccagaaaaggacagtttctcctctgccttggacgagatcgaggagctctgtcccacatctacctccacagaggcggccacggctgcgactgacagtgtgaaagggacctccagcgaggctggcacccagaaactcgacggtcctcaagagagccgcgcagatgactcaaaactgatggactctctgcctgggaattttgaaataacgacgtccacgggtttcctgacagacttgaccctggatgacatcctgtttgctgacattgatacgtccatgtatgattttgacccctgcacttcctcatcagggacagcctcaaaaatggcccctgtgtctgccgacgacctcctcaaaactctggctccttacagcagtcagcctgtcaccccaagtcagcctttcaaaatggacctcacagagctggaccacatcatggaggtgcttgttgggtcctaagacccagggacccagcgactatgcccacccagaccccagagcgttcccataaccctgacagttctccacactgtgcatgcacccttgcttgcctttttcagagaaaaagaaaattttacaacaggatcacactagtttttgctttgagcagagttggagtgccttcatccaagtatgaccacttttaatacacttttttgagtggttcctcagagacctactaccctggtataggaaagaatccatttgaagacaatgttgcaatgttgaatgacaaaaataaacagttcaagtgaagcacaaggattaagttggaaaagctgtaaattgcatgtgcatatttgtctattttttctataagttttattgcaagaggtaaagaagaaaactatatatatatatcttatttagataatctcagtaccttttctggcatttttgccctgtataggttgacttggcaattcggcctttttagaggcattaactactcctcgtaagtgttgcatttacatggctgtttagaaaactgctgcccaaatttattttatatttttgtacagattctgcagtttatgatattgtttttctaaaaacaaatgctgtttatacatatgagatagctattttgataggatttgctcacatagttcctgcaaacttcagatgtacaagttgcacttgtacttttatagagttgtaatgttttatatgtgtatggtgcaagagaaaattggatcaaatcaatctgcagttgatgtccccaaatgcaaacacaggcacacacatgcacacacccataaacacacacacagtgctttaagaaagggccaggtgatatcacacccaaatttcacaagcactgaccccctggcaccaacacccgccagtactgtgacttccaaagccagagccacatgtgctcatcaaacttgcattaagcagttggcgggagatggctgtggagctgggggtttaagtgatggttctcttttgctccctcttttgagggtaaagctactgtctttcttaagagtgtatttatgccaagtttgcgcttttaattgtttttattttgttttttaatgaaaacccagatctttcctttttggcataatttttatgatgacctgaaattttacatccgaacaaaattttacatccgaaaagcaaccaacttcttcatggaactcagccctgttgcaatgcttagggcccttaaagaagaaaatctccccagaaggcatccatcatgttgcttaattgtcttctgcagcttcctttccctagagctttccctgtgttgctaagagctgaaaatggcatcttcgtgatcaccacagtgagcttggctcgcctcggccggcccgggatgcactcttacaacatgtgtgactcttgaacctggagttcatcacattacgtcacagcttcccatctggttgctttcctgagtcagctacttcacacttgtcaaggctgttttaccccaaaactcagacaggactttctatgcatgttttccctcctccccccaattcccccccccatcaccttatctcccaggacacacttgagaagtagctttttattcctagtggtgtacatttaattttaaaaaggttgcaatgtatcatgcttgttgccgaaactgtttatggccttcttgtttcagttttttcttttcttccaatggtactttagctgttgagtgcaggttacaacctatattgttatgcagatggcttctttaggaataacttttatatttatttaaaaatttttaaattatgggatgttttgttgttgttgttgtctttgttgttggtcatttgtcaatattcagtcaccaattctgctcacttcttgccatggataaaattgggtctttctggctaattaaaaaagacaactttataaaatggcactttaagcaagccatagttagttttatttttgtaatgcacatggcaaagcaaagacgtttgtgatgaaggaactgctcatctaagcaaaagatttgagtatgatatgataaaggctttctacattctaatttactttttccccccacttgaatgtgttttaaaggctaattatcagctcagtagagcagtgagaaactgatcaaattgcacttgttctcctacaagcaacctccacgcagacacctcgtactgctacaggtgtgtcatttcctttaataggaccagggaccatgtaactgaggtgagggttgtagtagatgcttccagtgtcagtatgcctgttaattttaagagcttccctttcttgcagagaacaagtctgcccagattccatgctttctataactggaggacctggcaaacctgccgcatgctgcacacatctacctacgtacacatatacaatagtattgatgattctgaacaataacagggtaaaacagttggtttgccattgttaaaaactgatttacagtaacttacaacaactgtacttttgttggattagcaaatcatgtgtttaaacaaatcccatatgttgggcaacagttcaaataagcacggagaagtgttgcccaaacttggttctctgactcttatgtatttgtaaggctgggcttcaaaatcaaaacaaaaaccccaaaaacagcaggcaaatgctttttaactctgacaccgttgccataaatccctgatactcaaagtctaacaagaaagacatggaaaattagcagcccattttcagaaagatcaaaatgatctagggttctaattgcttttgcatcctattcttacaaagtgatgtcccaacagggaacagtaggagctggagtgggatctccaagtcccagtttgagtgtgggatgtgcttccagcagtgccttccctttatgaaagacatcacatggcatccagggccaggcaggcagcttgaggtgcctttacgagaaaaccgagctggggctgggagaggacagttattgacactgatgtgcaatgaagtgacaagatgagagcagaatcgtaagagctttgaatttgaagtgagtttttttccccccataagttatttattccttttttctgtgtaaatatatttattttactgtggagcgctaacatctggatcgtaacatgtgcagaatgtatggtaggaatgtattctcttgtaggaatgtaaatctgtattaaaagggggtccaagccaggcccccaggtcttctcattgtatgcacagtccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggagcaaccacatgggcacccttgttcataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtaaaaaaaaaaaaaaaaaagactctacttcgtgcagcaattgctactctatacgaattgtcttaatttgaaaaccttgctgttacaaattggacctttatacattttctgaaaacaatgaaaagagtatatttaaccttttctggctgtaaatggttaccttcctgtaactgccccgcacctggaggcatggagttgtgtgcatcctgcttatgtacaattgttttcagtgtttctaagaatgagtctgaatggttcttgaaaattagccaggatcaaatgctattgcagacaaagccaataaaaagttggacttcttttggggataacaagttttggaagagaaatgcaggccatatgtgcgcatgaccgagattttgaaaaaagatgtacatagtgacatgtttggtgcatggtttttgaggagggcttttgtcaaaaaggaggtataacctttcccccacagacctgagagctgtgccttttctatgcaatattacagacgttacatcggaacccagatggctgtattcacatgtaggtttgggctgtaatctaaacaattggacagattaaatgtacatggaaatgagcagtcttacttttgtagttttatattatacaataaacagttaaaagatgaaaaaaaaaaaaaaaaaa

SEQ ID NO: 1122 - DNA, 9990 bp, Homo sapiens
aatagtgttggtgtcttgaaactgacgtaatgcgcggagactgaggtcctgacaagcgataacatttctgataaagacccgatcttactgcaatctctagcgtcctcttttttggtgctgctggtttctccagacctcgcgtcctctcgattgctctctcgccttcctatttcttttttttttttttaaacaaaaaacaacaccccctcccctctcccacccggcaccgggcacatccttgctctatttcctttctctttctctctctctctctctctctctcttttttaataagggtgggggagggaaaggggggggaggcaggaaagacctttttctctcccccccgcaataatccaagatcaactctgcaaacaacagaagacggttcatggctttggccgccgcgccaccatctttcgggctgccgagggtgttcttgacgattaatcaacagatgtacagatcagctctcaaaatgtcttctgtgtcttctgagcgtcttctaagacaattgcattagcctcctgctagttgactaatagaattaataattgtaaaaagcactctaaagccacatgccttatgaagtcaatgctgggtatgattttacaaatatggtccggaaaaagaacccccctctgagaaacgttgcaagtgaaggcgagggccagatcctggagcctataggtacagaaagcaaggtatctggaaagaacaaagaattttctgcagatcagatgtcagaaaatacggatcagagtgatgctgcagaactaaatcataaggaggaacatagcttgcatgttcaagatccatcttctagcagtaagaaggacttgaaaagcgcagttctgagtgagaaggctggcttcaattatgaaagccccagtaagggaggaaactttccctcctttccgcatgatgaggtgacagacagaaatatgttggctttctcatctccagctgctgggggagtctgtgagcccttgaagtctccgcaaagagcagaggcagatgaccctcaagatatggcctgcaccccctcaggggactcactggagacaaaggaagatcagaagatgtcaccaaaggctacagaggaaacagggcaagcacagagtggtcaagccaattgtcaaggtttgagcccagtttcagtggcctcaaaaaacccacaagtgccttcagatgggggtgtaagactgaataaatccaaaactgacttactggtgaatgacaacccagacccggcacctctgtctccagagcttcaggactttaaatgcaatatctgtggatatggttactacggcaacgaccccacagatctgattaagcacttccgaaagtatcacttaggactgcataaccgcaccaggcaagatgctgagctggacagcaaaatcttggcccttcataacatggtgcagttcagccattccaaagacttccagaaggtcaaccgttctgtgttttctggtgtgctgcaggacatcaattcttcaaggcctgttttactaaatgggacctatgatgtgcaggtgacttcaggtggaacattcattggcattggacggaaaacaccagattgccaagggaacaccaagtatttccgctgtaaattctgcaatttcacttatatgggcaactcatccaccgaattagaacaacattttcttcagactcacccaaacaaaataaaagcttctctcccctcctctgaggttgcaaaaccttcagagaaaaactctaacaagtccatccctgcacttcaatccagtgattctggagacttgggaaaatggcaggacaagataacagtcaaagcaggagatgacactcctgttgggtactcagtgcccataaagcccctcgattcctctagacaaaatggtacagaggccaccagttactactggtgtaaattttgtagtttcagctgtgagtcatctagctcacttaaactgctagaacattatggcaagcagcacggagcagtgcagtcaggcggccttaatccagagttaaatgataagctttccaggggctctgtcattaatcagaatgatctagccaaaagttcagaaggagagacaatgaccaagacagacaagagctcgagtggggctaaaaagaaggacttctccagcaagggagccgaggataatatggtaacgagctataattgtcagttctgtgacttccgatattccaaaagccatggccctgatgtaattgtagtggggccacttctccgtcattatcaacagctccataacattcacaagtgtaccattaaacactgtccattctgtcccagaggactttgcagcccagaaaagcaccttggagaaattacttatccgtttgcttgtagaaaaagtaattgttcccactgtgcactcttgcttctgcacttgtctcctggggcggctggaagctcgcgagtcaaacatcagtgccatcagtgttcattcaccacccctgacgtagatgtactcctctttcactatgaaagtgtgcatgagtcccaagcatcggatgtcaaacaagaagcaaatcacctgcaaggatcggatgggcagcagtctgtcaaggaaagcaaagaacactcatgtaccaaatgtgattttattacccaagtggaagaagagatttcccgacactacaggagagcacacagctgctacaaatgccgtcagtgcagttttacagctgccgatactcagtcactactggagcacttcaacactgttcactgccaggaacaggacatcactacagccaacggcgaagaggacggtcatgccatatccaccatcaaagaggagcccaaaattgacttcagggtctacaatctgctaactccagactctaaaatgggagagccagtttctgagagtgtggtgaagagagagaagctggaagagaaggacgggctcaaagagaaagtttggaccgagagttccagtgatgaccttcgcaatgtgacttggagaggggcagacatcctgcgggggagtccgtcatacacccaagcaagcctggggctgctgacgcctgtgtctggcacccaagagcagacaaagactctaagggatagtcccaatgtggaggccgcccatctggcgcgacctatttatggcttggctgtggaaaccaagggattcctgcagggggcgccagctggcggagagaagtctggggccctcccccagcagtatcctgcatcgggagaaaacaagtccaaggatgaatcccagtccctgttacggaggcgtagaggctccggtgttttttgtgccaattgcctgaccacaaagacctctctctggcgaaagaatgcaaatggcggatatgtatgcaacgcgtgtggcctctaccagaagcttcactcgactcccaggcctttaaacatcattaaacaaaacaacggtgagcagattattaggaggagaacaagaaagcgccttaacccagaggcacttcaggctgagcagctcaacaaacagcagaggggcagcaatgaggagcaagtcaatggaagcccgttagagaggaggtcagaagatcatctaactgaaagtcaccagagagaaattccactccccagcctaagtaaatacgaagcccagggttcattgactaaaagccattctgctcagcagccagtcctggtcagccaaactctggatattcacaaaaggatgcaacctttgcacattcagataaaaagtcctcaggaaagtactggagatccaggaaatagttcatccgtatctgaagggaaaggaagttctgagagaggcagtcctatagaaaagtacatgagacctgcgaaacacccaaattattcaccaccaggcagccctattgaaaagtaccagtacccactttttggacttccctttgtacataatgacttccagagtgaagctgattggctgcggttctggagtaaatataagctctccgttcctgggaatccgcactacttgagtcacgtgcctggcctaccaaatccttgccaaaactatgtgccttatcccaccttcaatctgcctcctcatttttcagctgttggatcagacaatgacattcctctagatttggcgatcaagcattccagacctgggccaactgcaaacggtgcctccaaggagaaaacgaaggcaccaccaaatgtaaaaaatgaaggtcccttgaatgtagtaaaaacagagaaagttgatagaagtactcaagatgaactttcaacaaaatgtgtgcactgtggcattgtctttctggatgaagtgatgtatgctttgcatatgagttgccatggtgacagtggacctttccagtgcagcatatgccagcatctttgcacggacaaatatgacttcacaacacatatccagaggggcctgcataggaacaatgcacaagtggaaaaaaatggaaaacctaaagagtaaaaccttagcacttagcacaattaaatagaaataggttttcttgatgggaattcaatagcttgtaatgtcttatgaagacctattaaaaaaatacttcatagagcctgccttatccaacatgaaattcccttcttttgttattctttcttttgatgagtaggttaccaagattaaaaagtgagataaatggtcaatgagaaagaatggaagatggtaaacaatcactttttaaaacctgttaagtcaaaaccatcttggctaatatgtactggggaaataatccataagagatatcaccagactagaattaatatatttataaagaaagagaccaaaactgtctagaatttgaaagggtttacatattattatactaaagcagtactggactggccattggaccatttgttccaaaacccataaattgttgcctaaatttataatgatcatgaaaccctaggcagaggaggagaaattgaaggtccagggcaatgaaagaaaaatggcgccctctcaatttagtcttctctcattggccatgtttcagattttgacctagaaatgcgagctgtggttaggcttggttagagtgcagcaagcaacatgacagatggtggcacgctgtttttacccagccctgcctgtacatacacatgcacaccctctctgatatttttgtcctttagatgttcaaatactcagtagtccttttgtttgcggtttagattcattttgtccacacatgtacccattttaaaaaacaatgtcctcgatgcttctgtagtgatttcattttagccaggtatttctttcttgtgtgtgatgaaccagtatggatttgcttttctaagcctcctgttggttactaatctcacttggcacattataactaaaggaatcccctcaattcaaaagcatagatggatacaaatgtcagaccgtgggtttaatttgtttagaacacatggcatttcttcacaaggtaacctgctgtatttatttattttcttttggttaaatataatttccaaactttgtggtcaggcagcgtctaaggttacgttaccacagactgacagttggtatatgtaccagccaatcccttcattaaatgtatacagatttagttaagtagcattaaataggattcttagaagtatgtcctcatagaacttttaatacttaaggctttgtaaaaactatccatgaagggaaagctcctcagcataactgctcagggaaatagggctaaataactgaacattaaataattggttaaaggtgctgttagtcgagcctcaatgcttgctacaaggatgtatgtacaaggactgactttaataatttgcattatattgtcccaaccagtagtttattttttgccacggagatgtagaagatattacaagctactggatgcactgtcagattaacttatttcattaaagaagttgggagaacaaataggaaaaaaaaaacttatttttctagtaaatattaatgtattacatttcaaataatggtgcctgacatattgaataattattttctacagtgtacgtatgcaacaaagatattccatcatgcattagagtcagttctggctctgcctagctgtttacatttgcaaatgtagcaaacaaggtaatgaagcaactatttctattgcagtagatatccttttgtgtgtgtgtgtgtgcattaaagttgtaaacggtaacatgaaacaaatgaaagttcttgctataatggtatggaaaacaagaaggaaatgaaaatatttttatgcctacttaggaaaaaaagggtagcacttattcattccaagtacttttttttttttaatttttaagctcttaactcacattgttatgcttaagatgataaacatatatcctctttttattgctttgtctatgtttcatatgaaacatttcagaaattattttgataagtgttgctggaatctgcaacgctgatttttttttgcattctgtagtcgcatttgcactccatttttacattaattcgcagttgctttgtatcattgttttgtttgggttttgtttctttttcacagtgccgggtcttcgtttcttaaagttggatggcaggtagagttcaaccagttcgtgactgttgtagcgaatgaagttaaaaaaatgtctttctgatgttgtgttgtcattttcatttttgcatttttttgtttgcatattaaaaaaagagaaaagagaaagcaagagacagaaatcaggactaagtcctctgcttcagtttcattgttaacgggccttattctgatctcacctgtcgcgtagctctaatattcacataaactgaaataaagaagtggaatgaggagctttgacattcaaattatgtgatgtaatttatcttccttaggaattttgatggatgcatctcaaaatgtatagccagacttgagaggtgacaattaaagatctaaaaaagagaggagattcccccaaacaacaatatttaattttcttagtaaaaagaataacagaatgcatcgtggcaatccttaagcaacattatctatgtggactgcttaaatcagcaaaacaccagaagtttggttaacttgggcaatatgacaagtattactttttgggcaaaactactcattaagcaatttctctagtgtgtcggacacaaataggttctttatttttggcatgtatgcctttttattttcattcaattttttttttttctcagacagacatagtagtatcaactagcattggaaaatacatatcactattcttggaatatttatggtcagtctactttttagtaaaatatttttggatagcgttgacacgatagatcttattccatacttctttattattgataattttattttcattttttgctttcattattatacatattttggtggagaagaggttgggcttttttgaaagagacaaaaatttattataacactaaacactccttttttgacatattaaagcctttattccatctctcaagatatattataaaatttatttttttaatttaagatttctgaattattttatcttaaattgtgattttaaacgagctattatggtacggaactttttttaatgaggaatttcatgatgatttaggaattttctctcttggaaaaggcttcccctgtgatgaaaatgatgtgccagctaaaattgtgtgccatttaaaaactgaaaatattttaaaattatttgtctatattctaaattgagctttggatcaaactttaggccaggaccagctcatgcgttctcattcttccttttctcactctttctctcatcactcacctctgtattcattctgttgtttgggatagaaaaatcataaagagccaacccatctcagaacgttgtggattgagagagacactacatgactccaagtatatgagaaaaggacagagctctaattgataactctgtagttcaaaaggaaaagagtatgcccaattctctctacatgacatattgagattttttttaatcaacttttaagatagtgatgttctgttctaaactgttctgttttagtgaaggtagatttttataaaacaagcatggggattcttttctaaggtaatattaatgagaagggaaaaaagtatctttaacagctctttgttgaagcctgtggtagcacattatgtttataattgcacatgtgcacataatctattatgatccaatgcaaatacagctccaaaaatattaaatgtatatatattttaaaatgcctgaggaaatacatttttcttaataaactgaagagtctcagtatggctattaaaataattattagcctcctgttgtgtggctgcaaaacatcacaaagtgaccggtcttgagacctgtgaactgctgccctgtttagtaaataaaattaatgcatttctagagggggaatatctgccatccagtggtggaaatgtggagtaaagaagctggtggtctgcttctgtgctgtatgccagccttttgccttaagttgagaggaggtcaactttagctactgtctttggtttgagagccatggcaaaaaaaaaaaaagaaaaaaagatcaagtcgtctttggtgagccagtaaggtgaaagcttgctgactgtccaaggcacaagagaaaattgaggaattgaaatgcaacctgagtatcaaactaaatattctaatcaaaggtaggtactgttaggtggaattctatcagcaggcaactgcaaatgagaagaagatagaaggacgcccgtcgggactttggagggcattgttattttcccaaagaaagacggccaagggcagaggcatggattctttgcagagcacttccttttggtttttcagtactgtttcatagacagtgggctcacatgttcctgatagtgctgcagttgcttagaaagcatcccagttaattgcagtaattagaacttctggaatatgctagggcagaagtatgtcaagtatgtcacatgaagaaaatgtgaaattcaagagtaatccacacgtgagaaactagacaatgtacattcatgtgttctcttgaaaggaaagggagagctgtaagcttcactctgtcctacaccggagaaaagcaggaataactttaccgtggaaataatgtttagcttttatcagagaaaattgtccttctagagcatagagtcccaaaactcaattctggttttcccctgttttttttttttttttttttcccaacatatgaactgcagcatatcactttttctttttgtgcctcaggttcctcacctgtaaaattgaaaaatatatgtattaataatattattaataataataatggtaatgtagtacttgtttgtaaagcactttgagatccttggttgaaaggcaccataggagtgccaagtattattatgtggccaagggggttatttaaactgtcagttcccaaaggccaggaaaggttggggtcatttttcttaaagacgagctgtaaatatcaactaggcagccaatagtgttgactatgaagatgcaaaactattactaggctgataaaatcatagtttcttaatggctaccaataaggcaaatatcacaataataaacgccaaattccttagggcggactatttgacaaccacatggaaaactttgggggaggcatgaggggggaacatctcaaaatgccaatgtaaaatttaacttacagcaatattcaccagcagaaaatgtctttcatatggaatgatttcatgttgctaagaaaaagaattcaatttgtagtcctgatttgaatactagaatgttggctataatagttctgttcttacaacacatgaaattttttcgttttattttattttgttttcatagtgcatgttcatttctactcacaaacatgttcttggtgtatttcttatgcaaacaatcttcaggcagcaaagatgtctgttacatctaaacttgaataataaagttttaccaccagttacaca

SEQ ID NO: 1123 - DNA, 1791 bp, Homo sapiens
gagcccggctgcggatctgggaagcgcctcttcacggcactgggatccgcatctgcctgggatcatcaagccctagaagctgggtttctttaaattagggctgccgttttctgtttctccctgggctgcggaaagccagaagattttatctagcttatacaaggctgctggtgttccctctttttttccacgagggtgtttttggctgcaattgcatgaaatcccaatggtgtagaccagtggcgatggatctaggagtttaccaactgagacatttttcaatttctttcttgtcatccttgctggggactgaaaacgcttctgtgagacttgataatagctcctctggtgcaagtgtggtagctattgacaacaaaatcgagcaagctatggatctagtgaaaagccatttgatgtatgcggtcagagaagaagtggaggtcctcaaagagcaaatcaaagaactaatagagaaaaattcccagctggagcaggagaacaatctgctgaagacactggccagtcctgagcagcttgcccagtttcaggcccagctgcagactggctccccccctgccaccacccagccacagggcaccacacagccccccgcccagccagcatcgcagggctcaggaccaaccgcatagctgcctatgcccccgcagaactggctgctgcgtgtgaactgaacagacggagaagatgtgctagggagaatctgcctccacagtcacccatttcattgctcgctgcgaaagagacgtgagactgacatatgccattatctcttttccagtattaaacactcatatgcttatggcttggagaaatttcttagttgggtgaattaaaggttaatccgagaattagcatggatataccgggacctcatgcagcttggcagatatctgagaaatggtttaattcatgctcaggagctgtgtgcctttccatcccttccggctccctacccctcacttccaagggttctctctcctgcttgcgcttagtgtcctacatggggttgtgaagcgatggagctcctcactggactcgcctctctcctctcctccccccaggaggaacttgaaaggagggtaaaaagactaaaatgagggggaacagagttcactgtacaaatttgacaactgtcaccaaaattcataaaaaacaatagtactgtgcctctttcttctcaaacaatggatgacacaaaactatgagagtgacaaaatggtgacaggtagctgggacctaggctatcttaccatgaaggttgttttgcttattgtatatttgtgtatgtagtgtaactattttgtacaatagaggactgtaactactatttaggttgtacagattgaaatttagttgtttcattggctgtctgaggaggtgtggacttttatatatagatctacataaaaactgctacatgacaaaaaccacacctaaagaaattttaagaatttggcacagttactcactttgtgtaatctgaaatctagctgctgaatacgctgaagtaaatccttgttcactgaagtctttcaattgagctggttgaatactttgaaaaatgctcagttctaactaatgaaatggatttcccagtaggggtttctgcatatcacctgtatagtagttatatgcatatgtttctgtgcatgttctctacacaattgtaaggtgtcactgtatttaactgttgcacttgtcaactttcaataaagcatataaatgttgataaaaaaaaaaaaaaaaaaaaaaaaaaaaaaaaaaaaaaaa

SEQ ID NO: 1124 - DNA, 6432 bp, Homo sapiens
cttgaggattcagtctggtcctgaagggtttggggggagactgcgaccagaagatgtttccatgtcctaattaatgggtgatggtggttgttagtctgactgttgccacggtgatgaagggagacatccaagtgctggtttcagtactgaggcgaatacagggaatttcaacaggctccaggtcttactatgcagcctgaagtgggaccatcccttaaacccactccatcctgtggccacgatgggggccaggacacctttgccttctttctgggtttctttctttgccgagacagggattttgttcccaggaggcactccctggcccatgggatctcagcattcaaagcagcacaggaaacctgggcccctgaaacggggccaccgaagagatcggagaacaaccaggaggaagtactggaaggaaggaagggagatcgctcgtgtcttagatgatgagggcagaaacctgaggcagcagaagcttgatcggcagcgggccctgctggagcagaagcagaagaagaagcgccaggagcccctgatggtgcaggccaatgcagatgggcggccccggagccggcgggcccggcagtcagaggaacaagcccccctggtggagtcctacctcagcagcagtggcagcaccagctaccaagttcaagaggccgactcactcgccagtgtgcagctgggagccacgcgcccaacagcaccagcttcagccaagagaaccaaggcggcagctacagcagggggccagggtggcgccgctaggaaggagaagaagggaaagcacaaaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggcatctccagcagcatgagctttgacgaggatgaggaggatgaggaggagaatagctccagctcctcccagctaaatagtaacacccgccccagctctgctactagcaggaagtccgtcagggaggcagcctcagcccctagcccaacagctccagagcaaccagtggacgttgaggtccaggatcttgaggagtttgcactgaggccggccccccagggtatcaccatcaaatgccgcatcactcgggacaagaaagggatggaccggggcatgtaccccacctactttctgcacctggaccgtgaggatgggaagaaggtgttcctcctggcgggaaggaagagaaagaagagtaaaacttccaattacctcatctctgtggacccaacagacttgtctcgaggaggggacagctatatcgggaaactgcggtccaacttgatgggcaccaagttcactgtttatgacaatggagtcaaccctcagaaggcctcatcctccactttggaaagtggaaccttacgtcaggagctggcagctgtgtgctacgagacaaacgtcttaggcttcaaggggcctcggaagatgagcgtgattgtcccaggcatgaacatggttcatgagagagtctctatccgcccccgcaacgagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgacccggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctcctttgcctctgctactgaggcaggggagtagtggagagcgggtgggtgggtgtgaagggatgagaataattctttccatgccacgagatcaacacacactcccacccttggggtagtagtgtgttgtagtcgtacttaccaagctgagcaacctcttcagctgggaaggccgcaagaggcatagagggagaggaagcacactgcagggctgctgtggcccagtcgtccgctcagccaaggagtcagatggcaatgggtactccagcaggtaggggcacagtgaatgtgtgtatgtatgaaggccacatcaactttatgtagcaaagggcttggtggccaagcctggcccttaaacaactgcagaaagcccttcaacttcagaaggcctcactcaagcctgagagaagttgggagggtggtggggacaggtaagtggcaggaccctgtcaggattgcaggtgcctggcttgctgtggctatgggaatcagctggtggctaggtttctagcgcatttgatttctccaggtttgctgtgtctcacagaggcagtaggaacccagctctcagggctgtcttggtggatgggccctgcaagacacaggctcagcatgcagaagtgcatgaacagggtccctggatcagggttgttctgggagtcctgtcagcttccccaggagctctctgctgagcagcccagcacaacccccaggaaacacaaatggggtccaggtcaccagcctgactgcacacagctaggcatgcctgggaatcctgctgccagagaaccattcccaagccatggcatgctccttgaagaatctctcctctctctctctctctggaaagacccaactttctcactgctgtcagccaagtcatggttggtaaccatgtaggttcttgggagggaatgggacagggtgaataaagcagggaatattttagaaccacaagagatcagcagtggcaggacccttaggaatctagtacaaccttgttgctttaggtgagtcacactcagaaaatggggcttgccctgggtcacctagctggttaatggcagcattcagaacttcaagttctcttgatttctttgttcccactgtcccccaagaaactagtatctctggcctcctgggggcccattctgcatgccctccccacttcccccgattcagagacttagaagcatcagagttgataaattagattgaaaccattccagtaggaaatcaggcagttccctgttgaaagttgtctggctttttgcacgtgagtatgatccaggattggcctgtgtctggcccctccgcgagggctactcagcagtaagcaggccttagtacggctgctgcacacttctcggtctaggtgggagagagtgcataaaggttctggggctgggcctgagcctaactccctccactaccgctatttctccttggatggcaccatccaccctgcaggcttgggaactgtaagctcaagcttttgctcatttgtcatttaccctggtggaggcttcttgcccagatagagatctgaaattggtgggaagcaagcaggggtcgtaccttgctttagagtagatgtttggaaaagctaagtagaaattttttaaaatagaagttgtattttaaacgtgttaggctttataggtgaaggacttgttttgacttaagtagaagtaatatgctctcatttctttgtaatctagattttcctatgttgaatgcttaaagcaaggcatacctgtcctagcaggatctgcccacacctcggccgtacatctctgtgagagaccccctccaacgattagcttttgcaacatggtccagtttctagagggcactagaactttgtgccagcgctggcgagataccatggtgccatcctcctttctatagttccagtttagcccttccctgcctttaaggagaagagatcttcatggtgacatttgagatgatggaaactagatcgtctctaatgttaggtcaagctatttctctggatctatgattttaagatagaacaggctggttctgagttctggtgagacggagaccccggtggcagtggaaaaatcagaagcacaaaggaaaactcttggcctctgctttctcctgtagcacaaagagggagttggctggatcttttggtggagtcaggaaagacaggctgagctttctagcctaagtgtggagaaggatagcctcagccacaaaactctgtcaggcattgaatgacaagcatcagtagctgagtgcactcctggtgatcctggttttccttgaccactggccctggggccatgggtgcatggactcgtaaagctgctagggcccctagaaaccacctgggttcagcctctcccacaataagagttcttgcccttcataccctctacctggatggatggtctttgggcagggaattaatgacagaatgagcagtccctaatggtattgggcagttgggagtgagtttaggcagcttctctgtaaccgcttctggggccacaccccaaaactctacaccctctgccccagaacaattctgcagagtggtgaagttcacttccccaactcttctccaagtctagctttcctttccttctggctccaaggtgctctgtgtccgtctgtgtatgtgtgtgtctgtgcgtctgtgtgtttatttggggaaaagggcaatcagcaatcaactgaggtttcttaattgtgattatattcctgagaatgaatgagtaggaaaggaataaggatgttgttatgatcgcctgtggattttgtccattcatctcatgctctctgaacagaaggtatacctgggaagataccagctttttctctcagggttctgagtcagaggacaccatccaagaatgttgttagcttttcagttcccgctctgcattgcctgaaaaaactggtatgttgcacgtatgcttttggttgaaattgaacatactctagtgaatgtgccttaaaaatcaagacactagttcagaggaagcacataatgtccagatctatggcgaacacaggtgttggaagccaggactgtgataatcagaagctataagagaactttcggagcctgcctccttcagtgacaagtagggcacaaaattctagaagcagaaggttgtttttttttttttttctccattctgaaaatagcaggacatttacctcttaaataaacttagcatttagaggtaattctaaatttaacaagtgacagggttggtttcaaagaaaaaggtccatgctttgcttacaatggagtctgcagtgaggggagatgctgggatagccatttccatggctctgttatgcaagcacaaatttcatctcctagatggacttcctggttttctcttactgcagtaacactggccttcccttctctaattccttaccccagctgcggcatccctgtgttaactcaggatgccaagtggccctcagattacacttctccagatagctgaatgagtctgctttcactgtgactgggacctgaatgacctgcagtcagggcccagagttgggactctatactaccctgggctctggtctgtaggtttgtagtagccaccggtaataagccaagggctaggctcttgtttgagtttatggccacctggaattttcagtcatctcatgatacaggcgggaggggcagaacagatagattacgacaggtttggtttttaaattttccaaccaagtggaaaggcaagttggtcttatagaaagcactactgcacttagtagctatgtgattttgagcaaaccacataatctctctaggtccattttcctaaccacaagataaagatgttacattgtcaaagcttgccgtaggatttggggtgaatgaaaattattccttgctttcatcactacctttatagctctcatcactacctttatagctcatcactgtgcctttttttctttcctaagaaagacatcacatccctctcctctcctcctctgtgctcctgtccctccctccccctagcaaggtccaggcaaagctggagatgaggctgagatccagagtttcctagaacgcaacttaggatggctaggaaagggaagcctgactgctcggtcaggagggtgcagtatctcttgctgggaacacagccagttttcacaatgcctagactgtgtatgtctatttgcacaagattgtcttttcctattttggagtggtcagacattttatttttgttcaagattatctggcgttttagacaaatttgcaaaactgtgcttttattgactttttgaataaactttggtattctggaaaaaaaaaaaaaaaaaa

SEQ ID NO: 1125 - DNA, 2107 bp, Homo sapiens
ggcaaaggcaccatgcctctgcgggatgaaaccctccgagaggtgtgggcctctgacagtgggcatgaagaagaaagcctgagcccggaggccccgcggcgccccaaacagcgacccgccccggcacagaggctaaggaagaagaggacggaggcccccgaatccccctgccccacgggatccaagccccggaagcccggagctgggcggacggggaggccgcgggaggagccttccccagacccagcccaggcccgggcgccgcagacggtctacgccaggttcctcagggaccccgaggccaagaagcgcgacccccgggaaacctttctggtagcccgtgccccagacgcggaggacgaggaggaggaggaagaggaggacgaggaggacgaggaagaggaggcagaggaaaagaaagagaaaatccttctgcctcccaagaagcccctgagagagaagagctccgcagacctgaaggagaggagggccaaggcccagggcccaaggggagacctgggaagccctgaccccccaccgaaacctctgcgtgttaggaataaggaagctccagcaggggaggggaccaagatgagaaagaccaagaagaaagggtctggggaggccgacaaggacccctcagggagcccagccagtgcgaggaagagcccagcagccatgtttctggttggggaaggcagtcctgacaagaaagccctgaagaagaaaggcactcccaaaggcgcgaggaaggaggaagaagaggaggaggaggcagctacggtgataaagaagagcaatcaaaagggcaaagccaaaggaaaaggcaaaaagaaagcgaaggaggagagggccccgtctccccccgtggaggtggacgaaccccgggagtttgtgctccggcctgccccccagggccgcacggtgcgctgccggctgacccgggacaaaaagggcatggatcgaggcatgtatccctcctacttcctgcacctggacacggagaagaaggtgttcctcttggctggcaggaaacgaaaacggagcaagacagccaattacctcatctccatcgaccctaccaatctgtcccgaggaggggagaatttcatcgggaagctgaggtccaacctcctggggaaccgcttcacggtctttgacaacgggcagaacccacagcgtgggtacagcactaatgtggcaagccttcggcaggagctggcagctgtgatctatgaaaccaacgtgctgggcttccgtggcccccggcgcatgaccgtcatcattcctggcatgagtgcggagaacgagagggtccccatccggccccgaaatgctagtgacggcctgctggtgcgctggcagaacaagacgctggagagcctcatagaactgcacaacaagccacctgtctggaacgatgacagtggctcctacaccctcaacttccaaggccgggtcacccaggcctcagtcaagaacttccagattgtccacgctgatgaccccgactatatcgtgctgcagttcggccgcgtggcggaggacgccttcaccctagactaccggtacccgctgtgcgccctgcaggccttcgccatcgccctctccagtttcgacgggaagctggcctgcgagtgaccccagcagcccctcagcgcccccagagcccgtcagcgtgggggaaaggattcagtggaggctggcagggtccctccagcaaagctcccgcggaaaactgctcctgtgtcggggctgacctctcactgcctctcggtgacctccgtcctctccccagcctggcacaggccgaggcaggaggagcccggacggcgggtaggacggagatgaagaacatctggagttggagccgcacatctggtctcggagctcgcctgcgccgctgtgcccccctcctccccgcgccccagtcacttcctgtccgggagcagtagtcattgttgttttaacctcccctctccccgggaccgcgctagggctccgaggagctggggcgggctaggaggagggggtaggtgatgggggacgagggccaggcacccacatccccaataaagccgcgtccttggccaaaaaaaaaaaaaaa

SEQ ID NO: 1126 - DNA, 1791 bp, Homo sapiens
tttgttggaagtggagagtggagggtcagaagggagtggaccagttcaggtcccagagggaatcctccctccctctgagccgtctttcttctcctccctatttcgcagatatcccgagattaggtccccagcttccaaagagaggatcagaatgtctcaggataatgacacattgatgagagacatcctggggcatgagctcgctgctatgaggctgcagaagctggaacagcagcggcggctgtttgaaaagaagcagcgacagaagcgccaggagctcctcatggttcaggccaatcctgacgcttccccgtggctttggcgctcttgtctgcgggaggagcgccttttaggtgacagaggccttgggaaccctttcctccggaagaaagtgtcagaggcacatctgccctctggcatccacagtgccctgggcaccgtgagctgtggtggagacggcaggggcgagcgcggcctcccgacaccgcggacagaagcagtgttcaggaatctcggtctccagtcccctttcttatcctggctcccagacaattccgatgcagaattggaggaagtctccgtggagaatggttccgtctctcccccaccttttaaacagtctccgagaatccgacgcaagggttggcaagcccaccaacgacctgggacccgtgcagagggtgagagtgactcccaggatatgggagatgcacacaagtcacccaatatgggaccaaaccctggaatggatggtgactgtgtatatgaaaacttggccttccaaaaggaagaagacttggaaaagaagagagaggcctctgagtctacagggacgaactcctcagcagcacacaacgaagagttgtccaaggccctgaaaggcgagggtggcacggacagcgaccatatgaggcacgaagcctccttggcaatccgctccccctgccctgggctggaggaggacatggaagcctacgtgctgcggccagcgctcccgggcaccatgatgcagtgctacctcacccgtgacaagcacggcgtggacaagggcttgttccccctctactacctctacctggagacctctgacagcctgcagcgcttcctcctggctgggcgaaagagaagaaggagcaaaacttctaattacctcatctccctggatcctacacacctatctcgggacggggacaatttcgtgggcaaagtcagatccaatgtcttcagcaccaagttcaccatctttgacaatggggtgaatcctgaccgggagcatttaaccaggaatactgcccggatcagacaggagctgggggctgtgtgttatgagcccaacgtcttaggatacctggggcctcggaaaatgactgtgattctcccaggaaccaacagccagaaccagcgaatcaatgtccagccactaaatgaacaggagtcgctactgagtcgttaccaacgtggggacaaacaagggttgcttttgttgcacaacaaaaccccgtcgtgggacaaggagaacggtgtctacacgctcaatttccatggtcgagtcactcgggcttcggtgaagaacttccaaatcgtggatcccaaacaccaagaacatctggtgctccagttcggccgagtgggcccagacacattcaccatggacttctgctttccatttagcccgctccaggccttcagcatctgcttgtccagtttcaattagaagctggctgttgaataactcaataaaataccatacccttgccagcaaaaaaaaaaaaaaaaaaaaaaaaaaaaaaa

SEQ ID NO: 1127 - DNA, 3106 bp, Homo sapiens
acgcggcggcgtgccagcctagccactctagcgacggcggggaagagtgtgtacgtggtgggggcttcctcggtggcgggcatggaggcttcgcgctgccggctcagtcccagcggcgacagtgtcttccatgaagaaatgatgaagatgcgacaggctaagctggattatcagaggctactacttgagaagaggcaaaggaaaaagcgccttgagccatttatggtgcagcccaatccagaagccaggctacgtcgggcaaagccaagggccagtgatgagcagactcccttggtgaactgtcatactccccacagcaatgtcatcttacatggtattgatggtccagctgctgtcctgaaaccagacgaagttcatgctccatcagtaagctcctctgttgtggaagaagatgctgaaaacaccgtggatactgcttccaagccaggacttcaggagcgtctccaaaagcatgatatctctgaaagtgtgaacttcgatgaggagactgatggaatatcccagtcagcatgtttagaaagacccaattctgcatcaagccagaattcaaccgatacaggcacttccggttctgctactgccgcccaaccagctgataacctcctgggagacatagacgacctggaggactttgtgtatagtcctgcccctcaaggtgtcacagtaagatgtcggataatccgggataaaaggggaatggatcggggtctcttccccacctactatatgtacttggaaaaagaagaaaatcagaagatatttcttcttgcagctagaaagcggaaaaagagcaaaacagccaactaccttatctccattgatccagttgatttatctcgtgaaggagaaagttatgtcggcaagcttagatccaacctcatggggaccaagtttacagtttatgaccgtggcatctgccccatgaagggccggggtttggtaggagcggcccacacccggcaggagctggctgccatctcctatgaaacaaacgtacttggatttaaaggtcctaggaaaatgtctgtgatcattcctggaatgacactgaatcataagcagatcccctatcagccacaaaacaaccatgacagtttgctctcaaggtggcagaacagaactatggaaaatctggttgagctgcacaacaaggcccccgtctggaacagtgacactcagtcctatgtcctcaacttccgtggccgggtcactcaggcgtctgtgaagaacttccagatagtccacaaaaatgaccctgattatatagtcatgcagtttggacgtgtggcagatgacgtgttcacactggattacaactacccactttgtgcagtacaggcctttggcatcggtctttctagctttgacagtaagctggcgtgtgaatgagagaacagtcaggcagggagcccttctccccacagagctttcaggagcagacagtggcctccccttcccctccctgccccaggacttaaagagcaatagtttgccccttttggaatgatctctgaatatataaaacacacacacaaagagcaatagtttgccccttttggaacgacccctgaatatataaaacacacacacgaagagcaatagtttgccccttttggaacgacccctgaatatataaaacacacacgaagagcaatagtttgccccttttggaacgacccctgaatatataaaacacacacacgaagagcaatagtttgccccttttggaacgacccctgaatatataaaacacacacacaccccgcgcactctcactccttttccaggtttcatagacttggtgagggatcacagcttagcatgggtgagagatgatttaaagcacagggagattcttgtcacattggggtctccaaagctagaatgggatttcatgtgcttggaaacttgcagtagaatcagggactgacatcgcagttcctctcctctcttcattccctcacagcagattggccggcaccaatcttagtcaagagtggctgtgatcacatttgtgatcaattatgtgagaattttatataattgtcttcatttcaattaaggctgaaagcataaactctagaggtgactcagtcaggactgacagtaatgtgataattgccttcattttcaacccaggagtgcctctcacagctatatgactacggatccattagtgaggagcgacacacacacctgtaggcatcctgtgcaaacactttgtcattatcaagagagatggcagtattgaccatttagtttagttaaaaaaaaaaaaaaaaaggtggcaggagaggctttggggaggatcagccagcagacatgagcactgctggcccgtgtggcagagctgtggactttcttctcggctccctcaaccctggctcaggcacagaaggtgttttgctacgtttttttgattattacacccctccacgtattatgtgactcttacaccagttcacccttcccagaatgtatccaaaccttgagaatgcaggagctctgtgagctccaccgtcagcaccattcagctgcatcccttgtgcacagaactgtttgccagcgttgggtgggacacccgtggcggctgctccctcagacctcccttctgtggactgacctctcacctccgcctgttgttcctgcaccacatcagataagcatgtgaaggagggccaactggcagctgcgggacccttggcttgtcccccaccgacaagtcccacctgctgggtgaggacgagactgtttccatctcaggcatgtatcccaccaagtgcctccctcacagccatgcccagaagcctcacacctcgtcaccaccaccaccccccaccccatcctgaggcactgcctggcagataaccctggttggccacagaagctattaatacacgacagcatgtggggaaggacttatggtgggccaggtggacctcatcctgcttcttcctccctctggtttaaagagatatataaactaatttcacataatttgtgtgtgcaggtgattggtttttacataagtcctatttataccttttatatgttacagaaataaaagttaatttatataaaaatg

SEQ ID NO: 1128 - DNA, 11123 bp, Homo sapiens
gaaattttaatttattattcccccctttttttcctgcatctataggataatattgtaaaatagcaattgaaaccaataatcattaaataaatatcaaggaaaatccaagcaaagctttctttttgttggactagtggtgtggtgtttggagacagtctctgaatgtgaacaggaaagcacccatcagcaaaacacgatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagtagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcagtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagtgactccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgaggttgtgctggtgaggtggaatgagccctaccagaaactggccacgtgcgatgcggacggaggcatattcgtgtggattcagtacgagggcaggtggtctgtggagctggtcaacgaccgcggggcgcaggtgagtgatttcacgtggagccatgatggaactcaagcacttatttcctatcgagatgggtttgtcctggttgggtctgtcagtggacaaagacactggtcatccgaaatcaacttggaaagtcaaattacgtgtggcatatggactcctgacgaccaacaggtgctgtttggcacggccgatgggcaggtgattgtcatggattgccacggcagaatgctggcccacgtcctcttgcacgagtcagacggtgtcctcggcatgtcctggaactacccgatcttcctggtggaggacagcagcgagagcgacacggactcagatgactacgcccctccccaagatggtccggcagcatatcccatcccagtgcagaacatcaagcctctgctcaccgtcagcttcacctcgggagacatcagcttaatgaacaactacgatgacttgtctcccacggtcatccgctcagggctgaaagaggtggtagcccagtggtgcacacagggggacttgctggcagtcgctgggatggaacggcagacccagcttggtgagcttcccaatggtccccttctgaagagtgccatggtcaagttctacaatgttcgtggggagcacatcttcacactggacactctcgtgcagcgccccatcatctccatctgctggggtcaccgggattcgaggctgttgatggcatcaggaccagccctgtacgtggtgcgtgtggagcaccgggtgtccagcctgcagctgctgtgccagcaggccatcgccagcaccttgcgtgaggacaaggacgtcagcaagctgactctgcccccccgcctctgctcctacctctccactgccttcatccccaccatcaagcccccaattccagatccgaacaacatgagagactttgtcagctacccatcagccggcaacgagcggctgcactgcaccatgaagcgcacagaggacgacccggaggtgggcggcccgtgctacacgctctacctggagtacctgggcgggcttgtgcccatcctcaaagggcggcgcatcagcaagctgcggccagagttcgtcatcatggacccgcggacagatagcaaaccagatgaaatctatgggaacagcttgatttctactgtgatcgacagctgcaactgctcagactccagtgacattgagctgagtgatgactgggctgccaagaaatctcccaaaatctccagagctagcaaatcacccaaactcccaaggatcagcattgaggcccgcaagtcacccaagctgccccgggctgctcaggagctctcccggtccccacggttgcccctgcgcaagccctctgtgggctcgcccagcctgactcggagagagtttccttttgaagacatcactcagcacaactatcttgctcaggtcacgtctaatatctggggaaccaaatttaagattgtgggcttggctgctttcctgccaaccaacctcggtgcagtaatctataaaaccagcctcctgcatctccagccgcggcagatgaccatttatctcccagaagttcggaaaatttccatggactatattaatttacctgtcttcaacccaaatgttttcagtgaagatgaagatgatttaccagtgacaggagcatctggtgtccctgagaacagcccaccttgtaccgtgaacatccctattgcaccgatccacagctcggctcaggctatgtcccccacgcagagcatagggctggtgcagtccctactggccaatcagaatgtgcagctagatgtcctgaccaaccagacgacagctgtagggacagcagaacatgcaggtgacagtgccacccagtacccagtctccaaccggtactccaatcctggacaggtgattttcggaagcgtggaaatgggccgcatcattcagaacccccctccactgtccctgcctcccccgccgcaggggcccatgcagctgtccacggtgggccatggagaccgagaccacgaacacctgcagaagtcagccaaggccctgcggccaacaccgcagctggcagctgagggggacgcagtggtctttagtgccccccaggaggtccaggtgacgaagataaaccctccacccccgtacccaggaaccatccccgctgcccccaccacagcagcacccccgccccctctgccgcccccacagcccccagtggatgtgtgcttgaagaagggcgacttctccctctaccccacgtcagtgcactaccagacccccctgggctatgagaggatcaccaccttcgacagcagtggcaacgtggaggaggtgtgccggccccgcacccggatgctgtgctcccagaacacctacaccctccccggcccgggtagctctgccaccttgaggctcacggccactgagaagaaggtccctcagccctgcagcagtgccaccctgaaccgcctgaccgtccctcgctactccatccccaccggggacccacccccgtatcctgaaattgccagccagctggcccaggggcggggggctgcccagaggtccgacaatagcctcatccacgctaccctgcggaggaacaaccgtgaggctacgctcaagatggcccagctggccgacagcccgcgggcccccctgcagcccctggccaagtccaagggcgggcccgggggggtggtgacacagctcccagcgcggcccccacctgccctgtacacctgcagtcagtgcagtggcacagggcccagctcacagcccggagcctccctggcccataccgccagcgcctccccgttggcctcccagtcctcctacagcctcctgagcccacccgacagcgcccgcgaccgcaccgactacgtcaactcggccttcacggaggacgaggccctgtcccagcactgtcagcttgagaagcccttgaggcaccctcccctgcctgaagctgctgtcaccctgaaacggccacccccttaccagtgggaccccatgctgggtgaggacgtttgggttcctcaagaaaggacagcacagacttcagggcccaaccccttaaaactgtcctctctgatgctgagtcagggccagcacctggacgtgtcccgactgcccttcatctcccccaagtctcctgccagccccactgccactttccaaacaggctatgggatgggagtgccatatccaggaagctataacaacccccctttgcctggagtgcaggctccctgctctcccaaagatgccctgtccccaacgcagtttgcacaacaggagcctgctgtggtccttcagccgctgtacccacccagcctctcctattgcaccctgccccccatgtacccaggaagcagcacgtgctctagtttacagctgccacctgtcgccttgcatccatggagttcctacagcgcctgcccgcccatgcagaacccccagggcactctccccccaaagccacacttggtggtggagaagccccttgtgtccccaccacctgccgacctccaaagccacttgggcacagaggtgatggtagagactgcagacaacttccaggaagtcctctccctgaccgaaagcccagtcccccagcggacagaaaaatttggaaagaagaaccggaagcgcctggacagccgagcagaagaaggcagcgttcaggccatcactgagggcaaagtgaagaaggaggctaggactttgagtgactttaattccctaatctccagcccacacctggggagagagaagaagaaagtgaagagtcagaaagaccaactgaagtcaaagaagttgaataagacaaacgagttccaggacagctccgagagcgagcctgagctgttcatcagcggggatgagctcatgaaccagagccagggcagcagaaagggctggaaaagcaagcgctccccacgggccgccggcgagctggaggaggccaagtgccggcgggccagtgagaaggaggacgggcggctgggcagccaaggcttcgtgtacgtgatggccaacaagcagccgctgtggaacgaggccacccaggtctaccagctggacttcggggggcgggtgacccaggagtccgccaagaacttccagattgagttagaggggcggcaggtgatgcagtttggacggattgatggcagtgcgtacattctagacttccagtatccgttctcagccgtgcaggcctttgcagttgccctggccaacgtgactcagcgcctcaaatgaagagactggtgtggggaggagagagatgcagagagcctttggaagaggtcttcggagatgccagaggagccctctaggggtccgatgcctgggaggaccagaagccaacagcaaaactggaaaagcccggcaggcccaggagagggcgctgacctgtggtcgtcatttatttggttgggttttattaccttttattgtctgttcttcttttcttctttcatttcagtggcatttggaagcaaagagtgctaggcacctgctgttctttcaggaaacagcttggctgtggtaatgctctactgggcccttcagaatgaagacagtctgccttagagcctgctattcttttagacatagggaggatgcattatcctgtattctcctccaacatcaccactagcgtaaaagcaaaaagcttttacaaaacacagccaaaaattctcaagatgcaggttcttggggaatgggatggggacagcatttgatttacactgattatgttactccccaaaaggtgacttaattaataaagggcatttgggcagacacactgtgttggaccaacaaagtaggctctttacaggggtgttctcaccaggtagaaatgcgatttgctcactgaggatgttggggaagggacgaagggtaaagaagaaactgcacgtatacacaggttcacatcactctgcagacagcaatgtgactcagcgtgtgacttgtagcagcagtacgagggctacactcctctgctgaggatgtctacattgaaagcctccactagtttcatcgtttgtcaaagttccgtaggatcagtgatggtcattcagcatgactggttctgggagaaggtgagagacaaaaatggaaagatcctggcctgtggtagtggtagcagttttctcaaataatgtggtgacagtcactagatcctcacatgctgagaaacagcctctactctctctgccccttttactttttaatctggaatgcattactgtaaacatgatctttcccatgagataccatgttctatgccttcccattctaaaagtgtggacaacgcttgatttgaaaccactccttttctcctcttggctacattaaaattcagttgactacaaatgctttctatcaaattagaaatgtaaccaaaaaaatgttaagtgttcaccagggtattaaaatacagaggagtatggtcaaatctttgacaaaattttcatgatcttctctaacaaaaaaagttgtttattaactgtacagactgtttactaaggagctaaaccactgagaaaacgttattaaaattgtaatacctaggtagttggttgatcacagtttgttaattgtataaaaaaaaattacctagaatatctcttcccacttcctcgtcctcgtgagaacctgtgggcagtattcaagccctgatgacaaaacccagtgttttttgttgttgttttttgttgttgttttttgtttttgtttttgtttttctcagtcttacctgtgatgttgtttaggatcaggcccctctcctgggcctgctgtgcaggagcacaggaactatctgctggcgttgggttccaaatttgcattttatttggaaacagacaagtagaagatgctacagaaaagtattttcaaatttaaacgttttttaatcccctgttttagttaaaaaattggaaaagaaaccgacccatttttttcccagatcaagatgacatgacatcactcccaattctctccaaaccccagagaaatactgacgaagttttctgatgtggcaaaggatatttcccatctaataccagtttctcatttatatttaacgtattggacctgatatttttagtgggtgcattcttccagaaagaattcagcaatgttatcagaattaattcttttatatgagtttatgtagcttgatatggtgtttcagtgcttattggttgtgcaataatggttatagcctgttagataatctaaatgcaattcccctgttttgtcgtttaggagataattatttatcttgcttttcatagtgttcttaggaattattttgttgttacgttttggtgagttatacccattttatttatttagaaaaatagtatctttgttaacgacttacatggtcacagtatattttgctgcaagaaataaagaggatatgatagaaggtttttttttttttttttttttttttttgagacggagtcccactcttgtcgcccaactagagtgtagtggcacaatctcggctccccacaacctctgactccagggttcaggtgattattttgcctcagcctcccaagcagctgggattatagacacccgccaacacgccaggctaatgtttttgtatttttaatagagatggggttttgccatgttggccaggctggtcttgaactcctgacctcaggtgatccgcccgcctcggcctcccaaagtgctgggattacagacgtgagccaccactcccggcccatagaaggttttttgctggataatttgtaacttttctaattgggaaaaaattcctattaatcacttaaaaatttttttttgtattttgtgttattgattatatacaaaggagactttttttttgagataacactcaaatagtattctcttcttttgaaaattttatttttatctgaaaataacagttgatctgaaataaaaaggggagacctattagaatgagagtagccaaggaaagagttactaggtaataagcttcactttttgtgttctaattgtttttgagatataaagaccctgaaaaagcccattttagaacctgtttaataagagcaaatataggggaaaatctttgaaatgaaagctacaaatacatgtgagaagaaaaaaatggatttttttagcaaataattaactaagcttctaaatgcctagctccctcccccaaaggcgctttcccccgatggaggcacaggcttctgtctcggatgtttggcgcacgtgagtttgtatgagtttgtaccggagtgaccccggcagccactgcccacctcccctctacccaggggcctgaaaagaggggctgccctcctgcgccaaggcagacacaagctgcgggctgtgcggtcctagtagtgtgacgtttcagttaatagtggtggtcttattttcaactatgctttcattcagtcagtctctgttgactaaatacgacgaaaattcatactttatgcaggagatttctaaaaatttaatgtttattaatagtttatgaatatcaagatacctcattgaatccctaaatttaaaagcagtccagtaaaaggttaactgtataaagaatctatgactttttgagggaagtgtgatatattaacaaatataaccaattctaaatttgttttagctctaacctcatcaaaccaaaggcacagatttgtgtacaatatacccattgaatgtatatcctgagaaaaattggggccaaagaagcaggaaaatctcaaagctctaatggcagcataaatcaaagaatttcacaggctagtgtttttatccatagccattgctcccttgtcaagtgtctcacaaggacatggaagaatgtgttatgttcatcttgtaatcatagcaaaaagtctgcaaaccccagggtcaagcctgctctgccacagggttggatggtgaccttgggcaagtccctggggctggctaggcctccacttgtccatctgtgaaatgaaaggatcagcctggacagccctctaaactcccttacagctctcagcctaagagcgcagcactgaacagcctcatcattccacttttcatgggaaatatatttcacaccattgcctttgtgtagagaaatatttcttttcctgtgttaatgagctatgtactgaatataaaccagtgcatttaaagtaatatcttttgtgcacctctaaatgtgtttggaattgtgtttgttctcatagaatatacaaaagtactgattctaggtaagaaggagtctccacgggtgtgccctgctcagctggatgtccatgagaacagccatgaaataagtcactacttgtccccaaaaccacaggaatatatacctaggtcacctcaaattcctgagtgtgctctgccatgttacacggtcttcaaattgaaaaggtttcttgaaaaggaaagtttggcccagcaactggagaaggagtccatggtgtcgctgtgtgcctgtatcatttggccaagtcaatggttgtaagcaaagttagtggagacaaaaatgtgtccaaaatgtcgtttgagttcctgggatttctgtaatagcacacaactcagaactcttcagcatttgtgtgattccttacctctggctgataaaactctaatgggttgtggcttactttgtttccattttctttggctttgtgcaatttttgtgtaactttacttgtacctatattttctgtttacagttctttttaaggggaggggtagggttctaagatcttgttgtttattgtagataaaaattttttcgtgttgtagaaaagcatgggttatgcgtttgactgaaaaagacactgtattatttaccaaaggggtattgtttttgcatttgtttataaatgcattattttggtactgtaaatttggacataatttctgagtttattactactggcattttctttttcccttttttttttttttaaccgtaagtgcacgatgcaggtgcataggccccagaccaaactagaccaccagcatgttcatgtccagacctcggcagtggcgtgcactgcttgtgcacctcagttcctccagtgttggtttgtttgttttttaattcagcatcctgctggttttactttccaagcaagatctgttgcgactcccaaatgcgttttaatgagctcatccttatttgcctttcttcttacgtattttgtgtattagattgtgcaggagatattctagaaggcattaatggtttgcattcaaaacgatgtggtttgtccaagttattttctgtctttattactgagacggattaatctccttatttttttcttgatgatttgaagttgtaagagttgtccagctattgcttaataaaattttgcagatcaaaaaa

SEQ ID NO: 1129 - DNA, 1669 bp, Homo sapiens
gaggtataagagcctccaagtctgcagctctcgcccaactcccagacacctcgcgggctctgcagcaccggcaccgtttccaggaggcctggcggggtgtgcgtccagccgttgggcgctttctttttggacctcggggccatccacaccgtcccctccccctcccgcctccctccccgcctcccccgcgcgccctccccgcggaggtccctcccgtccgtcctcctgctctctcctccgcgggccgcatcgcccgggccggcgccgcgcgcgggggaagctggcgggctgaggcgccccgctcttctcctctgccccgggcccgcgaggccacgcgtcgccgctcgagagatgatgcaggacgtgtccagctcgccagtctcgccggccgacgacagcctgagcaacagcgaggaagagccagaccggcagcagccgccgagcggcaagcgcgggggacgcaagcggcgcagcagcaggcgcagcgcgggcggcggcgcggggcccggcggagccgcgggtgggggcgtcggaggcggcgacgagccgggcagcccggcccagggcaagcgcggcaagaagtctgcgggctgtggcggcggcggcggcgcgggcggcggcggcggcagcagcagcggcggcgggagtccgcagtcttacgaggagctgcagacgcagcgggtcatggccaacgtgcgggagcgccagcgcacccagtcgctgaacgaggcgttcgccgcgctgcggaagatcatccccacgctgccctcggacaagctgagcaagattcagaccctcaagctggcggccaggtacatcgacttcctctaccaggtcctccagagcgacgagctggactccaagatggcaagctgcagctatgtggctcacgagcggctcagctacgccttctcggtctggaggatggagggggcctggtccatgtccgcgtcccactagcaggcggagccccccaccccctcagcagggccggagacctagatgtcattgtttccagagaaggagaaaatggacagtctagagactctggagctggataactaaaaataaaaatatatgccaaagattttcttggaaattagaagagcaaaatccaaattcaaagaaacagggcgtggggcgcacttttaaaagagaaagcgagacaggcccgtggacagtgattcccagacgggcagcggcaccatcctcacacctctgcattctgatagaagtctgaacagttgtttgtgttttttttttttttttttttgacgaagaatgtttttatttttatttttttcatgcatgcattctcaagaggtcgtgccaatcagccactgaaaggaaaggcatcactatggactttctctattttaaaatggtaacaatcagaggaactataagaacacctttagaaataaaaatactgggatcaaactggcctgcaaaaccatagtcagttaattctttttttcatccttcctctgaggggaaaaacaaaaaaaaacttaaaatacaaaaaacaacattctatttatttattgaggacccatggtaaaatgcaaatagatccggtgtctaaatgcattcatatttttatgattgttttgtaaatatctttgtatatttttctgcaataaataaatataaaaaatttagagaaaaa

SEQ ID NO: 1130 - DNA, 1960 bp, Homo sapiens
gccgtcatctctaagaaacaaccataccactgaatgctactgtgtacttacaaaccacactcatattcgtcacgtcatttcatcttcacccccacctccaaatgaggcttgaaatgagatgagatgttcctccctcccctttcaaccatggacctcacactgtggacttcctcttagagcctctgagttaggtacccaagccaaggcacaatgtccctgccccccataagactgcccagcccctatggctctgatcggctggtacagctagcagccaggctccggccagcactctgtgatactctgatcaccgtagggagccaggagttccccgcccacagcctggtgctagcaggtgtcagccagcagctgggccgcaggggccagtgggctctgggagaaggcatcagcccttctacctttgcccagctcctgaactttgtgtatggggagagtgtagagctgcagcctggagagctaaggccccttcaggaggcggccagggccttgggagtgcagtccctggaagaggcatgctggagggctcgaggggacagggctaaaaagccagatccaggcctgaagaaacatcaggaggagccagagaaaccctcaaggaatcctgagagagaactgggggaccctggagagaagcagaaaccagaacaggtttctagaactggtgggagagaacaggagatgttgcacaagcactcgccaccaagaggcagacccgagatggcaggagcaacgcaggaggctcagcaggaacagaccaggtcaaaggagaaacgcctccaagcccctgttggccaaaggggagcagatgggaagcatggagtgctcacgtggttgagggaaaatccagggggctctgaggaaagtctgcgcaagctccctggcccccttcccccagcaggctccctgcaaaccagcgtcacccctaggccctcgtgggctgaggccccttggttggtggggggccagcctgccctgtggagcatcctgctgatgccgcccagatatggcattcccttctaccatagcacccccaccactggagcctggcaggaggtctggcgggaacagaggatcccactgtccctaaatgcccccaaagggctctggagccagaaccagttggcctcctccagccctaccccaggttccctcccccagggccccgcacagctcagccctggggagatggaagagtctgatcaggggcacacaggcgcacttgcaacctgtgcgggtcatgaggacaaggcaggctgcccacctcgcccgcaccctcccccggcccctcctgctcggtctcggccctatgcgtgctctgtctgtggaaagaggttttcactcaagcatcagatggagacgcactaccgagtccacacaggagagaagcccttctcctgtagcctttgtcctcagcgctcccgggacttctcggccatgaccaagcacctgcggacacacggggccgctccgtaccgctgctccctgtgcggggccggctgtcccagcctggcctccatgcaggcgcacatgcgcggtcactcgcccagccaactcccgcccggatggaccatccgctccaccttcctctactcctcctcgaggccgtctcggccctcgacctctccctgttgtccttcttcctccaccacctgacggggtgtcggtagcgtcttagccaagagtccaattaaagaacgaaaagcgggccggctcggcttctgacctggcaccgctgctacggcggcctagcaaattccgccccagaagcgccccaggaagggcgccgagtgccctctcctggacgatcgcgggtcgcagaagcccaggccagcgagccctacagagtgaggacactgaagtgtgcaggagcgaaggttaacagtaggggagattgtcgatctcatcaccataataaagagtttcctgtgccctcccttca

SEQ ID NO: 1131 - DNA, 4162 bp, Homo sapiens
gtcgcgttgaagccagcgtccggccggcagagcggcgtcggcggggttggccggggcggtgtggcgctagagcctgggcgggccgggggcaaggagtcaaggcttgggggcgggtgacgggcgggcggagggcttgcccccgtgtggtcctcggagcggcccgaggtccagcctcccagcggtcccggaggaggatgcgaccggggggccccgggcggggcggtcggcggcggctgcagcgctagcggcgcgggggctgggcggcggcgccggcatgaggcgcagggccggtgtccgcgggagggtggcgctgccggcggcccggccgctcccgctgcaattgctcgctgggctcgtcgtgccctgccagtggggcccccgcagctctcgtcccggccgccgctggtgaccactcgccgcccctccggaggcttcacccgcgccctcccccaggacgcgccagcggagctccggctccttcgccctggacgcggaggccgcggtgtgcggggcgacggcgaggccggaagatggcctgggtgctcaagatggacgaggtgatcgagtccgggctggtgcacgacttcgacgccagcctctcgggcatcgggcaggaactgggcgccggcgcttacagcatgagtgatgtcttggcattgcccattttcaagcaggaagattccagccttccattggatggtgaaacagagcacccaccctttcagtatgtgatgtgtgctgcaacgtcaccagcagtaaaactgcatgatgaaacgcttacttatttgaaccaaggtcagtcatatgaaattcggatgctggataatcggaaaatgggtgatatgcctgagatcaatggaaaattagtaaagagcatcataagggttgtattccatgacagacggctacaatacacagagcatcagcaacttgaaggatggaagtggaatcgcccaggagacagacttcttgatttagatattccaatgtctgtgggaataattgacacaaggacgaatccaagccagttaaatgcggttgaatttctgtgggacccagcaaaacgcacctctgctttcattcaggtacactgcatcagcacagaatttactccacggaagcacggaggtgaaaagggagtgccctttaggatccaggttgacacctttaagcagaatgaaaatggagaatacacagatcatctacactcagctagctgccaaatcaaagtttttaagcctaaaggtgcagacaggaaacaaaaaactgaccgagagaagatggagaagagaacagctcatgaaaaagaaaagtatcagccgtcctatgataccacaatcctcacagagatgaggcttgagcctataattgaagatgcagttgaacatgagcagaaaaagtccagcaagcggactttgccagcagactacggtgattctctggcaaagcgaggcagttgttctccgtggcccgatgcccccacagcctatgtgaataacagcccttccccagcgcccactttcacctccccacagcagagcacttgcagtgtcccagacagcaattcttcttccccaaatcatcagggagatggagcttcacagacctctggtgaacaaattcagccttcagctacgatccaggaaacacagcaatggctgctcaaaaacagattctcttcctacacaagactgttctctaatttttcaggtgccgacttattaaaactgacaaaggaggatttagttcaaatttgtggtgcagccgatggaattcggctctataattcactgaagtcaaggtcggttagaccccgtttaaccatctatgtctgccgggagcagccaagcagcacagtgctgcaagggcagcagcaagctgcaagcagtgcaagcgagaatggcagtggggcaccctatgtttatcatgcaatctacttggaagaaatgattgcctcagaagttgctcgaaaacttgcgctggtgtttaatatccctctccaccaaattaatcaggtttacagacagggtcccaccggtattcacattcttgttagtgatcagatggttcagaattttcaagatgagagttgttttttattctccacagtaaaagctgaaagtagtgatggcatccacataattttgaagtgatgtcttatatagactgaactgtattcagtaccaaatagtcacgcttaaaagtgtgtgaagactgaatccaagaagtcttgggattggattttaccatatgaaatgtttcatattgaaaacacaagatgacctttctaatgagctgtatgagaggtgaatctcctcactgtcactgccatagccaagcatcctcatgagagtgagcacatcggcacagcatgcatccagctctggaggccacggtgcaggcatagctgcctgctgctctggcagaggccagtaaatacagttcctagaagcagcctttgctgtctttttacactgtatgcggtttggaaatgaatgtagaaacttactgtgggcatttacctttctgtgccagtttggcttttattgcctgaaccttatgctgacctggagaggagatgggggacagtgctgttgtggggccagcagtgaatctgtatgcggagagttgtgttgtgctgatgtggccgttggtggtcaggtaagaggctcggcaccttcttggaagaaatcatgtctgagggtgtacgtttgatatgatcatgccagattggagaagatccaagccaggaagatgggcttgaagcaaactgcattatcaggagtaccttggtgagaggatcagtgtaaatcctaataggtacaaagacttttgtgttttggctttgtcacagatttattgaaaaacttttttgcttctgcttccatttttagcattttagtttctggttttcatttttggagattccttgccttttaaactcgtggtttttctctcattttcttccctctctccctccatctctgaccacccccaccctaaccccccacccccaccatcctattaaacatttttaaagccctaccccagacattggaaataggtgacccaagtagggggagaaagtattattgttgatagcttctgactaggtgttaagggatcttcattatgaacaagatgaatttttttctggaaacactagatgttatcaatcaaacactaaaatgtaccatacaaatcccttaagcctctcaaatattgagctttagtacaatcatggatagacattctggtgatgatttaggggctttttatacaccacatactagcttctttctctataagagtgcctctttcataaaaccaaatgcttgtctgctagcatacttttcaaagggaatccactgttttctcactttcctcccatatctccgtccttcatccaaaaccttcccagaatccatcagcaagcatgtttgaggcctgtggtgtaggggactgaattttttttttaacttctattccattttaattgtaggatatctttgtccatatacccaggtgtcctgatttgaatgtactatttgatcctcattgtgttcaggcaaaaaataggaaatgagtaattttgagtttgaaatctctcccagaagacaaactacttcagtgagtaaaagctttgacattttatgttttattcataaagggggttaattatttgctacaaagaagcacgatctattttcatcatcgatttgaaaatatctgtaactcctatagatcctataggcagagagttttcctttctgactttttccctttgctttcgtgtgaccacatgttttctgtaccagtcactggggaaagaagtgagtttatctcgtttgttttaaaagttttgcttgtctatttagcattcctttttgggtctcaagatttatggaacaataaatgtcatttaatgctgtgtgcttattttgaattcctcatcaggttttagaagcggggtaaaaatacttagatgcttatcagacttgaaattatactgagtggcattgaacgtgagtttgtcccagtgaaacaggctaaataaattttggcaccagcaaatttgttactttgtttttttaatagtaggatgtacacatttcagtataataaatgttttctgattgttttgcaaaaaaaaaaaaaaaaa

SEQ ID NO: 1132 - DNA, 4603 bp, Homo sapiens
ggtgaggtggctttgaccccgggttgcccggccagcacgaccgaggaggtggctggacagctggaggatgaacggagaagccgactgccccacagacctggaaatggccgcccccaaaggccaagaccgttggtcccaggaagacatgctgactttgctggaatgcatgaagaacaaccttccatccaatgacagctccaagttcaaaaccaccgaatcacacatggactgggaaaaagtagcatttaaagacttttctggagacatgtgcaagctcaaatgggtggagatttctaatgaggtgaggaagttccgtacattgacagaattgatcctcgatgctcaggaacatgttaaaaatccttacaaaggcaaaaaactcaagaaacacccagacttcccaaagaagcccctgaccccttatttccgcttcttcatggagaagcgggccaagtatgcgaaactccaccctgagatgagcaacctggacctaaccaagattctgtccaagaaatacaaggagcttccggagaagaagaagatgaaatatattcaggacttccagagagagaaacaggagttcgagcgaaacctggcccgattcagggaggatcaccccgacctaatccagaatgccaagaaatcggacatcccagagaagcccaaaaccccccagcagctgtggtacacccacgagaagaaggtgtatctcaaagtgcggccagatgccactacgaaggaggtgaaggactccctggggaagcagtggtctcagctctcggacaaaaagaggctgaaatggattcataaggccctggagcagcggaaggagtacgaggagatcatgagagactatatccagaagcacccagagctgaacatcagtgaggagggtatcaccaagtccaccctcaccaaggccgaacgccagctcaaggacaagtttgacgggcgacccaccaagccacctccgaacagctactcgctgtactgcgcagagctcatggccaacatgaaggacgtgcccagcacagagcgcatggtgctgtgcagccagcagtggaagctgctgtcccagaaggagaaggacgcctatcacaagaagtgtgatcagaaaaagaaagattacgaggtggagctgctccgtttcctcgagagcctgcctgaggaggagcagcagcgggtcttgggggaagagaagatgctgaacatcaacaagaagcaggccaccagccccgcctccaagaagccagcccaggaagggggcaagggcggctccgagaagcccaagcggcccgtgtcggccatgttcatcttctcggaggagaaacggcggcagctgcaggaggagcggcctgagctctccgagagcgagctgacccgcctgctggcccgaatgtggaacgacctgtctgagaagaagaaggccaagtacaaggcccgagaggcggcgctcaaggctcagtcggagaggaagcccggcggggagcgcgaggaacggggcaagctgcccgagtcccccaaaagagctgaggagatctggcaacagagcgttatcggcgactacctggcccgcttcaagaatgaccgggtgaaggccttgaaagccatggaaatgacctggaataacatggaaaagaaggagaaactgatgtggattaagaaggcagccgaagaccaaaagcgatatgagagagagctgagtgagatgcgggcacctccagctgctacaaattcttccaagaagatgaaattccagggagaacccaagaagcctcccatgaacggttaccagaagttctcccaggagctgctgtccaatggggagctgaaccacctgccgctgaaggagcgcatggtggagatcggcagtcgctggcagcgcatctcccagagccagaaggagcactacaaaaagctggccgaggagcagcaaaagcagtacaaggtgcacctggacctctgggttaagagcctgtctccccaggaccgtgcagcatataaagagtacatctccaataaacgtaagagcatgaccaagctgcgaggcccaaaccccaaatccagccggactactctgcagtccaagtcggagtccgaggaggatgatgaagaggatgaggatgacgaggacgaggatgaagaagaggaagatgatgagaatggggactcctctgaagatggcggcgactcctctgagtccagcagcgaggacgagagcgaggatggggatgagaatgaagaggatgacgaggacgaagacgacgacgaggatgacgatgaggatgaagataatgagtccgagggcagcagctccagctcctcctcctcaggggactcctcagactctgactccaactgaggctcagccccaccccagggcagccagggagagcccaggagctcccctccccaactgaccacctttgtttctcccccatgttctgtcccttgcccccctggcctcccccactttctttctttctttaaaaaaaaaaaaaaatacggtgggggtagggggctggaggagcccaggccaggactctgcagcctcagagacatcagcccttgggggtcctcctccagggacagcaactatcagactaagccagcaccggaccagcctggcccaccccacccacttctgcacttgcggttccggcatggacaatggaccggagagtgggggtggggggtcccaaagagtttgatgaggccctccacacctgcggcccaatccaaggtggggtggaagcttggggaagacccattccttcccagaggggcctgccacctggacccctgcattggaactggaggcagggaacatggggaggaggagggtcggtgccttcaagaaaacaggcactgccctggtggccctctcccctgccccctgcaggaaggagctgcctggacccgttcatgggggagggggcagaagtgttttttatatatgtgtatatatttttttttaagctctgagctgtcaacgagacgtttcctaccgatctcggctgccgtctctgttgtcatttctgggagagggagggtttaggggtagatttggaaccttttaaaaatggtcttgatgtatgtggaagagagtatgtgtatgtgtgttcctgtacatagcatgggtgcagctgtggatgtgtgcaaaagagtgtgagtgtgtgtgtgtgtgtgtaaaggggtctgtcctagagcccacatcagtttgttgtgaatctggaaaaagggtcggtgagggccgggagatgttgaccctggtgggagcaggctgaggctgccccgttctccacatcctctgttttgcccagtctctgattccattagggggagtgtgctgaagccattctcggatgcttcccagaccaggctccctctgccagagtcacatgcatccgagctgctggtctccattgtccagcaggaaggcggaaaggcaggcaagatggtgtgaagcttaaagcttgtatttgatggaaaaggtctcccctgttcatctgagaggccaagcctggccaccccaggctcagaacctgggcttcaagaaatgtgctgggagctcctaacttacacatccctccagccttccttgaatcctcccaccaccccctatttcctttaatttctcaggtctgctccctcctcccccaaccccacagctgggcaagaagtctgcaaaagctgcatctgcagctgtctctaactcttcccagccatctcccgtattttttggtaccttgattccttgactcttaataagccaagccaccttatctctgtagttcttatttttttgttgactaaatttggggggttcttttttatggtcatgtcactgacctattaaattggggcttggtgcttttccaccttccccctctgaatgaaagccaaggaatgggggaagagcgggaactctgccgcggaggtggagcaagaacggtgaagggccctggtcccagagaggctggtgggtccctctcccaaaggaaggcagacagtctctgctttgccttggaccttggtgctgggggtggggaggcctgggggggacactccccactcccattccccttcctttgtcctaatcctggaattaagtacaggggtttataggttctatttcttcccaagagccctgcaaagaaccccagtttcctatttggatgcccctacactgttgtgtttcagtggaatgtattttcatttaaaaacaactttgaatggggcactttttctttcctgttttaaaaattgaaaaattcttacagtacaaacaggactgtcagggtgggggtgttggtgctgtaagaggtcactcttgagtgcattttggcactgggatgggatggctggggtgggaagacccccatccccacccccaacttcttttctaatatttaaggagtgttttgtaggattcaacaaccaccacaacttgaatttgtatcatgggaggtgggagggagtggcttagaggtgtctgcctatgcttaaagccaactgtggaagttttgttttcccttttttgtataataaagtgaaaaacaaaggtttgaaaaaaaaaaaaaaaaaaaaaaaaaaaaaaaaa

SEQ ID NO: 1133 - DNA, 4086 bp, Homo sapiens
ggccacttggcccgggcctcctttctcctctggtcgtggggaaggagggatgggttggaccttctgcttttctttcaattccctcttttcattctccttcctcctcaatcttcaacacttggctagtcgttaatgccttaagtgcttaatttgttgtgtctggtcctggccagggtctggctgtacaggaggactggaagggcatcctgggagtttcctggtgtccacaggccggacaaaagcaaccccgactccttagagcatggcatggctcagaggtgctggtaaaactgatgggggtttttgctgtccctcccctcagcgccgacaccatgtggatccaggttcggaccatggacgggaggcagacccacacggtggactcgctgtccaggctgaccaaggtggaggagctgaggcggaagatccaggagctgttccacgtggagccaggcctgcagaggctgttctacaggggcaaacagatggaggacggccataccctcttcgactacgaggtccgcctgaatgacaccatccagctcctggtccgccagagcctcgtgctcccccacagcaccaaggagcgggactccgagctctccgacaccgactccggctgctgcctgggccagagtgagtcagacaagtcctccacccacggtgaggcggccgccgagactgacagcaggccagccgatgaggacatgtgggatgagacggaattggggctgtacaaggtcaatgagtacgtcgatgctcgggacacgaacatgggggcgtggtttgaggcgcaggtggtcagggtgacgcggaaggccccctcccgggacgagccctgcagctccacgtccaggccggcgctggaggaggacgtcatttaccacgtgaaatacgacgactacccggagaacggcgtggtccagatgaactccagggacgtccgagcgcgcgcccgcaccatcatcaagtggcaggacctggaggtgggccaggtggtcatgctcaactacaaccccgacaaccccaaggagcggggcttctggtacgacgcggagatctccaggaagcgcgagaccaggacggcgcgggaactctacgccaacgtggtgctgggggatgattctctgaacgactgtcggatcatcttcgtggacgaagtcttcaagattgagcggccgggtgaagggagccccatggttgacaaccccatgagacggaagagcgggccgtcctgcaagcactgcaaggacgacgtgaacagactctgccgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactggggcaagggcatggcctgtgtgggccgcaccaaggaatgtaccatcgtcccgtccaaccactacggacccatcccggggatccccgtgggcaccatgtggcggttccgagtccaggtcagcgagtcgggtgtccatcggccccacgtggctggcatacacggccggagcaacgacggagcgtactccctagtcctggcggggggctatgaggatgatgtggaccatgggaattttttcacatacacgggtagtggtggtcgagatctttccggcaacaagaggaccgcggaacagtcttgtgatcagaaactcaccaacaccaacagggcgctggctctcaactgctttgctcccatcaatgaccaagaaggggccgaggccaaggactggcggtcggggaagccggtcagggtggtgcgcaatgtcaagggtggcaagaatagcaagtacgcccccgctgagggcaaccgctacgatggcatctacaaggttgtgaaatactggcccgagaaggggaagtccgggtttctcgtgtggcgctaccttctgcggagggacgatgatgagcctggcccttggacgaaggaggggaaggaccggatcaagaagctggggctgaccatgcagtatccagaaggctacctggaagccctggccaaccgagagcgagagaaggagaacagcaagagggaggaggaggagcagcaggaggggggcttcgcgtcccccaggacgggcaagggcaagtggaagcggaagtcggcaggaggtggcccgagcagggccgggtccccgcgccggacatccaagaaaaccaaggtggagccctacagtctcacggcccagcagagcagcctcatcagagaggacaagagcaacgccaagctgtggaatgaggtcctggcgtcactcaaggaccggccggcgagcggcagcccgttccagttgttcctgagtaaagtggaggagacgttccagtgtatctgctgtcaggagctggtgttccggcccatcacgaccgtgtgccagcacaacgtgtgcaaggactgcctggacagatcctttcgggcacaggtgttcagctgccctgcctgccgctacgacctgggccgcagctatgccatgcaggtgaaccagcctctgcagaccgtcctcaaccagctcttccccggctacggcaatggccggtgatctccaagcacttctcgacaggcgttttgctgaaaacgtgtcggagggctcgttcatcggcactgattttgttcttagtgggcttaacttaaacaggtagtgtttcctccgttccctaaaaaggtttgtcttcctttttttttttatttttatttttcaaatctatacattttcaggaatttatgtattctggctaaaagttggacttctcagtattgtgtttagttctttgaaaacataaaagcctgcaatttctcgacaaaacaacacaagattttttaaagatggaatcagaaactacgtggtgtggaggctgttgatgtttctggtgtcaagttctcagaagttgctgccaccaactctttaagaaggcgacaggatcagtccttctctcgggttctggcccccaaggtcagagcaagcatcttcctgacagcattttgtcatctaaagtccagtgacatggttccccgtggtggcccgtggcagcccgtggcatggcgtggctcagctgtctgttgaagttgttgcaaggaaaagaggaaacatctcgggcctagttcaaacctttgcctcaaagccatcccccaccagactgcttagcgtctgagatccgcgtgaaaagtcctctgcccacgagagcagggagttggggccacgcagaaatggcctcaaggggactctgctccacgtggggccaggcgtgtgactgacgctgtccgacgaaggcggccacggacggacgccagcacacgaagtcacgtgcaagtgcctttgattcgttccttctttctaaagacgacagtctttgttgttagcactgaattattgaaaatgtcaaccagattctagaaactgcggtcatccagttcttcctgacaccggatgggtgcttgggaaccgtttgagccttatagatcatttacattcaatttttttaactcagcaagtgagaacttacaagagggtttttttaaaatttttttttctcttaatgaacacattttctaaatgaattttttttgtagttactgtatatgtaccaagaaagatataacgttagggtttggttgtttttgtttttgtattttttttcttttgaaagggtttgttaatttttctaattttaccaaagtttgcagcctatacctcaataaaacagggatattttaaatcacatacctgcagacaaactggagcaatgttatttttaaagggtttttttcacctccttattcttagattattaatgtattagggaagaatgagacaattttgtgtaggctttttctaaagtccagtactttgtccagattttagattctcagaataaatgtttttcacagatagaaaaaaaaaaaaaaaaaaaaaa

SEQ ID NO: 1134 - DNA, 3720 bp, Homo sapiens
gcgagatccggcttggcgccgtgacctccatgtgggagctccagctctataagtaaacactctgcgcggcgcagacatggcctcttcctatctttgaggcggtgtctgcggcagcgcctcagagtggttccggtcgtctctcctcaagtcggctagtcgggcgcgcgcgctgagagtcgtcgccgcctgtcgggcccggcgtccggtcggtccggtgggcgcgctcgcccgcctgccgctgagggcccgagccgcagggaaagcggcgcgggccgggcggggcgcggcgcccagagctcagggggagacaaaggggaccggttcctctctaggcgccaagatgtggatacaggttcgcaccattgatggctccaagacgtgcaccattgaggacgtgtctcgcaaagccacgattgaggagctgcgcgagcgggtgtgggcgctgttcgacgtgcggcccgaatgccagcgcctcttctaccggggcaagcagttggaaaatggatataccttatttgattatgatgttggactgaatgatataattcagctgctagttcgcccagaccctgatcatcttcctggcacatctacacagattgaggctaaaccctgttctaatagtccacctaaagtaaagaaagctccgagggtaggaccttccaatcagccatctacatcagctcgtgcccgtcttattgatcctggctttggaatatataaggtaaatgaattggtggatgccagagatgtcggccttggtgcttggtttgaagcacacatacatagtgttactagagcttctgatggacagtcacgtggcaaaactccactgaagaatggcagttcttgtaaaaggactaatggaaatataaagcataaatccaaagagaacacaaataaattggacagtgtaccctctacgtctaattcagactgtgttgctgctgatgaagacgttatttaccatatccagtatgatgaatacccagaaagcggtactctagaaatgaatgtcaaggatcttagaccacgagctagaaccattttgaaatggaatgaactaaatgttggtgatgtggtaatggttaattataatgtagaaagtcctggacaaagaggattctggtttgatgcagaaattaccacattgaagacaatctcaaggaccaaaaaagaacttcgtgtgaaaattttcctggggggttctgaaggaacattaaatgactgcaagataatatctgtagatgaaatcttcaagattgagagacctggagcccatcccctttcatttgcagatggaaagtttttaaggcgaaatgaccctgaatgtgacctgtgtggtggagacccagaaaagaaatgtcattcttgctcctgtcgtgtatgtggtgggaaacatgaacccaacatgcagcttctgtgtgatgaatgtaatgtggcttatcatatttactgtctgaatccacctttggataaagtcccagaagaggaatactggtattgtccttcttgtaaaactgattccagtgaagttgtaaaggctggtgaaagactcaagatgagtaaaaagaaagcaaagatgccgtcagctagtactgaaagccgaagagactggggcaggggaatggcttgtgttggtcgtacgagagaatgtactattgtcccttctaatcattatggacccattcctggtattcctgttggatcaacttggagatttagagttcaggtgagcgaagcaggtgttcacagaccccatgttggtggaattcatggtcgaagtaatgatggggcttattctcttgtactggctggtggatttgcggatgaagtcttgacagagttatgaatatgaatattgtggagtctgtccagataccgggtggaagactggttttgatcagtttaagaagtattctaaactgttctagatgaccgaggtgatgagttcacatacactggaagcggtggtaaaaatcttgctggtaacaaaagaattggtgcaccttcagctgatcaaacattaacaaacatgaacagggcattggccctaaactgtgatgctccattggatgataaaattggagcagagtctcggaattggagagctggtaagccagtcagagtgatacgcagttttaaagggaggaagatcagcaaatatgctcctgaagaaggcaacagatatgatggcatttataaggtggtgaaatactggccagagatttcatcaagccatggattcttggtttggcgctatcttttaagaagagatgatgttgaacctgctccttggacctctgaaggaatagaacggtcaaggagattatgtctacgtttacagtatccagcaggttacccttcagataaagaagggaagaagcctaaaggacagtcaaagaagcagcccagtggaaccacaaaaaggccaatttcagatgatgactgtccaagtgcctccaaagtgtacaaagcatcagattcagcagaagcaattgaggcttttcaactaactcctcaacagcaacatctcatcagagaagattgtcaaaaccagaagctgtgggatgaagtgctttcacatcttgtggaaggaccaaattttctgaaaaaattggaacaatcttttatgtgcgtttgctgtcaggagctagtttaccagcctgtgacaactgagtgcttccacaatgtctgtaaagattgcctacagcgctcctttaaggcacaggttttctcctgccctgcttgccggcatgatcttggccagaattacatcatgattcccaatgagattctgcagactctacttgaccttttcttccctggctacagcaaaggacgatgatctgcctgctttcactgtgttgttcatggtggctttttggacaataaagaatctaaaatgggtggggagggtggaagaaatggtggactgtatctctcacgttctgaagcagctaatcctctttcccacatagccatcatcttgtgtgtgtagtaagaggcccatttctcaactgtcttttaaatatctaaaggtagttcctgtaacaactagttttaatgagtaaaaagtcaaagcctcagctctagttgatatccaagttatgatttattttgcaactacctcaggacagaaaagatttatggggattttaaaaatcattgaataactagttaaatgaaattttagctacacactgcctcccaaatattagttgtgcctggttcttgtaatttgattttacagaaaaggaaatgacacttgagatccttggaatgaacacagcttctaaagtgtgcatatacttttttaacgtctcttcttccattacaatgtgtgttttgcaaggacaggttcattttttttagcccactttgtgaactccattgtgcttttttctggtgttttatgcaagttgactactaatgactaatgagaacaataatgaatgcattgttgctgcattagtgtaatgtggtgtggttttgcacttaaaagaggtattcatatgctctagttgtaaatgttcatgaaaatccacttctctactagtcgaactgcttttagtgtctcaccagtggttttacatctgcagagttttgagggctgtgctgacctttgagaggatttgaaattgcttcatattgtgatcctaaattttatattcactatattccctaaagtataccttaataaatattttatgatcagaa

SEQ ID NO: 1135 - DNA, 1831 bp, Homo sapiens
aacatggccgcgggctggaagtgcgcatgagcagctgtctatggagatacctaggccgggagagggagaacacagttggagaaaatcggcagctgagacggccttggccggacttagcactcaggcctgtgaatcaggagatacaaagacctccaaaaaaggaccagttcctcggatgtgccccctcacagagagatgaaggggcagcagaaaacagctgaaacggaagaggggacagtgcagattcaggaaggtgcagtggctactggggaagacccaaccagtgtggctattgccagcatccagtcagctgccaccttccctgaccccaacgtcaagtacgtcttccgaactgagaatgggggccaggtgatgtacagggtgatccaggtgtctgaggggcagctggatggccaaactgagggaactggcgccatcagtggctaccctgccactcaatccatgacccaggcggtgatccagggtgctttcaccagtgatgatgcagttgacacggaggggacagctgctgagacgcactatacttacttccccagcacggcagtgggagatggggcagggggtaccacatcggggagtacagctgctgttgttactacccagggctcagaggcactgctggggcaggcgacccctcctggcactggtcaattctttgtgatgatgtcaccacaagaagtactgcagggaggaagccagcgctcaattgcccctaggactcacccttattccccgaagtcagaagctccccggacgactcgggatgagaaacgcagggctcagcataatgaagtggagcgtcgccgccgagacaagatcaacaactggatcgtgcagctctccaagataatcccagactgctctatggagagcaccaagtctggccagagtaaaggtgggattctatccaaagcttgtgattatatccaggagcttcggcagagtaaccaccgcttgtctgaagaactgcagggacttgaccaactgcagctggacaatgacgtgcttcgacaacaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtgggggtcgttttttttttttcttttcttttttttttttttttttttttttttttaagataaaattgttcaaagccaaaaaaaaaaaaaaaaaaaaaaaaaaaaaaaaaaa

SEQ ID NO: 1136 - DNA, 1732 bp, Homo sapiens
gtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggtggccatcaccagcgtccagcaggcggcgttcggcgaccacaacatccagtaccagttccgcacagagacaaatggaggacaggtgacataccgcgtagtccaggtgactgatggtcagctggacggccagggcgacacagctggcgccgtcagcgtcgtgtccaccgctgccttcgcgggggggcagcaggctgtgacccaggtgggtgtggacggggcagcccagcgcccgggccccgccgctgcctctgtgcccccaggtcctgcagcgcccttcccgctggctgtgatccaaaatcccttcagcaatggtggcagtccggcggccgaggctgtcagcggggaggcacgatttgcctatttcccagcgtccagtgtgggagatactacggctgtgtccgtacagaccacagaccagagcttgcaggctggaggccagttctacgtcatgatgacgccccaggatgtgcttcagacaggaacacagaggacgatcgccccccggacacacccttactctccaaaaattgatggaaccagaacaccccgagatgagaggagaagagcccagcacaacgaagtggagcggaggcggagggacaagatcaacaactggatcgtccagctttcgaaaatcattccagactgtaacgcagacaacagcaagacgggagcgagtaaaggagggatcctgtccaaggcctgcgattacatccgggagttgcgccagaccaaccagcgcatgcaggagaccttcaaagaggccgagcggctgcagatggacaacgagctcctgaggcagcagatcgaggagctgaagaatgagaacgccctgcttcgagcccagctgcagcagcacaacctggagatggtgggcgagggcacccggcagtgacgcccgccaccaccacgcagccgccgccgcccacgccggcctctgctgcccccttccccagcccttagcacagagagggacacatgcccctcccccagctgcgtttttttatagtagatttttaacaaaaaacggggagaaataatgcatttctgtggatacagtgcccaccgccctcctccacttggaaacggtatcctccctgcccatccgtctgtctgtcgcccttctcccggccctcactaagccccggcacttctagtggtctcacctggaggcaagagggaggggacagaggccctgccacgtcccgctgcctcctgctctctggaggtactgagacagggtgctgatgggaaggaggggagcctttggggggccacccggggcctggacctatgcagggaggccacgtcccaccccacctcttgtttctgggtccctgctcccctttgggggtgtgtgtgtgtgttttaattttctttatggaaaaattgacaaaaaaaaaatagagagagaggtatttaactgcaataaactggccccatgtggcccccgcaaaaaaaaaaaaaaaaaaaaaaa

SEQ ID NO: 1137 - DNA, 1157 bp, Homo sapiens
cgccccagccccgggatgctgctccggccccgcaggccgcccccgctcgcgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccagacgccaccccgctgcccaccgcccgcgaccgcgacgcggaccccacctggacgctccgcttcagcccgtccccaccgaagtctgcggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacatcctgggcccgctgcgcgaccagctgctgaccttgaaccagcacgtggagcagctgcgcggcgccttcgaccagacagtgtccctggccgtgggcttcattctgggcagcgcggccgccgagcgaggggtcctcagggacccgtgccagtgagtcccggctgcggccagtctcccctctccaggccgaggcccctccgccctgacccctcctgctgccttcccacccccgttcttgggtatgttcaataaaaggattgttttcctaga

SEQ ID NO: 1138 - DNA, 4494 bp, Homo sapiens
accagactggccgcctctcggcgagcgcgccactctcccgtcgccgctgacccgcgcgcggccgccgaagcctccccgcggggacattcattcttgccccttgcctgtcgccgggccgggcgtacgggccgcgttgtcgggggttttgtcccctttttcctcttttttttttccttctccgccccccccccttttttttttttttgctttttttttcctttctgtttttgttgttgttcttgcctatgttcgggaaaccagacaaaatggacgttcgatgccactcggacgccgaggctgcccgggtctcgaagaacgcgcacaaggagagtcgggagagcaagggcgcggaggggaacctcccagccgccttcctcaaggagccgcagggcgccttctcagcgtcgggcgctgctgaggattgtaacaaaagtaaatccaattccgcagcggacccggattactgccgccggatcctggtccgagatgccaaggggtccatccgagagatcatcctgcccaagggcctggacttggaccggcctaagaggacgcgcacgtccttcaccgcggagcagctctatcggctggagatggagttccagcgctgccagtacgtggtgggccgcgagaggaccgagctcgcccggcagcttaacctctccgagacccaggcaaatagtgaagaaaataatgaacgattcaaacgcgggataaaaaaacaaaagaagaaaaggaagaaagagccagcaaatgatgagtctcggcgtggggactccgggggcagagggtggcagcccctatagtgcggggccctgcgactggtaccgtgagcgcctgggatgaggtttgggcggatttcgggtttccggagaggcagagacgcctggctacgacgatttgttccacttccttgagtgtttcgctctcgatttctctatctgtccctctgaggtcggcccctcagaccctcctccttaatttcccactgcgtaattcttagtttatttaggaactcatctctgggcactataaagtctctgcctcctaatgctaggtttctagagtcttccagctgcatcttcatgccggcagcattttggattttgtgcaatcatgggcccagaataggcaaggttttattttcttctgacttagaatataagtctcgccatcgtcaaagagaaactttgaaggagcaggagactgaaatcgatattaattcctgcaaagagacctcctcaccctggtgcttatgcggtggtgacgggtgtagacgttgcaaacaaatcttgggaagcgaggagggccggggaggacacttccggacacgctcttctaaagcgtgtgcagcacggggcgaagtccgcgctgcgggggcagcggccccggctccttcttgtagcgcctgcacacctgggtgttgcagggacccgcagctcccgtgcggcaccggccctagccaggccttactgcccctactcgtgtactgtgcctgaagctgaagttggaggcatccaaaataaggcggggcacagtgtgggcggcggagtccctgagccttgagctccgctttttgctgagatcacagcagccgcccacagacagttcacttttatttctcaaagttgctgcagatccctcagcttggcttctcttggctcttcccctccctgtccgcctctccttactttctcttgcttgaaactgcttttccttttctactcttttcttccgcgctcctgtcccgtaaacgcctgcgcttcctttaaggagttctctctctgtggtgtgggctcccctctcgttccccctgtctccctcctccattacttcttccttccaggtctctctctctcttttggttttctggtttttttctcctgctcaaggggtcccaaaggccaaggcagtgggtggctctcgctgcagcttcaaggctggtggctgggaccctccaggggtgagaaggaagggagaaggtggcataactttttggaacaaaagaaaacacaaaatcctagcttgggattcccaacaaattcagcctcctctcccaggggcctcagcctgggaagtcaccaagcagatccctccttccagcttcctgctctttctcctttttgctttcttacccctgaaagagggaaggacaagtcacctcataacttctgctctcacctcccttccctccctggctttgggaagagctgctgagctctttgcctgccactcagggagtgcaattgttcttaaagagcctcttctgcatagaaaaagaattgcaattttaatttaaaaacatttatagaaaattcatttaattttagtgactatcttcttttccctccttccccaagggcctccagtaagctgccttggtccctggaggcttctggcttccaactggagactcacaggccttggaggaggaggcaggtaccctctatgccaatagctgggcctgcctggggaaaggtggaaggagaaacagctgcaggaggggggagctgaaaggaatctgatgctcaggcctgcacaaagcaaccgccaaattgtttcagagcagaaaagaaaaagggagaaaacctcttagcaaagccctgtgagtttgggggtcaggttcaagaaagatgtgggaagtcacttggagagctaaacgggacacatgctcctatccacacttgcagttggtctaaccttcagccagaatgtattcataagtagcatttggcaaccctttatagtttacaaatagcattttacatacaccattctactattcctcatggtggctttgggaggtccagctccgttttaaagactcacacaggactgaagcaaataacttgctcaaagccacatagctgctcagaacccaagattgtaagctccccctagggccagaggcctctttctttcagtttttttctttcgtccccctttgacccctctttccttcttccctttctcccctccttcctcctttccttctttttgtgcccacagtgtctggatcatggtacctgaattctttagcctatttgcacccacatctgctaatgtccatatctagccatctattacaccagctgctgaggatttacttggtgccctcatcaagaagtttgaatttctccctccttcctttttttttcctgccactgtcccaactctttccctctacgtctctctagaatgacatctttaaaccccttacactctttggtcttacacatccttaaaaatgattatttataaattgaattataatatccatgaggtaaacactcatagggtaaagtacacaaagcttaactatacaagttgatgatttacacacacacacacacacacacacacacaccccttcttgaatggctccaaggatacccttttaacttcttcccttcagccacataagccatatgatgacacacagtgtctttctcctgtttgaaaagaaattgtgtcatattggtgtgctgttcttgcatagaaagccttttttaagaagtctttttaagatttcttgaaggattttagaaatcatatatctcttctaaccccctgaaatcctgagtttaagtggcttgattaaatggctgatcaaaacttaaaaacacactaggtcaatgtttttcaagatacaactgaggaccagctgcttcagaatcatctggggactggctaaaattccaggttcctaagccctagtcccatctgatgaatcagaaactaggttggggcttaggaacgtgcattttaaacacttttccaaagtgattcttatccagactaatatttgagaagtactgtattaaatggcaaactcccaaaacactgcagcctcctgcatctggcccagggcctggcatttggtaggaatacaatgaatgtttgttaaacaaattaatccacagtttctgacacagtttagaatttcttggaccacattatgctattgtaatttaacaccatttctacgtcgggaaatctttacatttcagtctttttcattttcatggaggtttcattttaatggagcaggagagaaaagagagatctactttggtggtttctcaggtctcagggaaggtcttttataaactcaatggggaccaccttcctggagaggctgctcccttacagacctggtagtttggggaaaggaggaggagagcccttcaggtttgctgaaaagcattcagatgcacacccttcttggttggaactgaaagcttctgtttgaagagacatgagttctggaaggagcaaggccaccaggtccagagaacctggcatgcaatggacatggaagctgaaaattacttgggtattctctgatttctagctaatatgaaaataattttctttctagaaacacatttgcctatcttcttaccctgaaacagaaaataaatattgtgctttatgtggtagtgttgtacccattcttaaaaataaatcacatcatatatatgtgtaaaatat

SEQ ID NO: 1139 - DNA, 1163 bp, Homo sapiens
ccgccgtagaggggttggcagtggcggtcagcatgggcgatgggggcgccgagcgcgaccggggccccgcgcgccgggcggagtctggtggcggcggtgggcgctgcggagaccgcagcggagcgggggacttgcgagctgatggcggtggccacagcccaacggaggtggccgggacctcagcctccagtcccgcaggctccagggagagtggagccgacagcgacgggcagcccgggcccggcgaggcagaccactgccgccgcatactggtgcgagatgccaaagggacaattcgggaaattgtcctgcctaagggcctggacctggaccggcccaagcggacacgtacatccttcactgccgagcagctgtaccgcctggagatggagttccagcgctgccagtatgtggtgggccgcgagcgcactgagctggcccgccagctgaacctctccgagacccaggtgaaggtctggttccagaaccgccgcaccaagcagaagaaagaccagagcagagacctggagaagcgggcgtcctcctcagcctccgaggcctttgccacctccaacattctgcggctgctggagcagggccggctgctctctgtgcccagggcccctagcctcctggcgctgacccctagcctgccaggcctacctgccagccacaggggcacctccttaggtgaccccaggaactcctccccacgcctcaacccgctgtcctcggcctcagcgtcccccccactgccgccccctctgccagctgtctgcttttcctcggccccgctcctggatctgcctgccggctacgaactgggttcctcggccttcgagccatacagctggctagaacggaaagtgggcagcgccagcagctgcaagaaagctaacacttaagactcccaccctgtgacactgagtcccgagcacagcaccttcccagtctcctgtgccccagcggacagcactgagcaggccccggagaggaggggctgcagccacacactcttccccacctgccccccagctcagagactcgtgaccaaatggccttggtcccgcagcttgtgtgcgtgagtgcagtgtgagtgtgtgtgtctctcactgaaataaaaggaaaacaatgacaagaagggaaaaaaaaaaaaaaaaaaa

SEQ ID NO: 1140 - DNA, 4669 bp, Homo sapiens
ctgcttgtcaaaaggcggcagcggagccgtgtgcgccgggagcgcggaacagcttgtccacccgccggccggaccagaagcctttgggtctgaagtgtctgtgagacctcacagaagagcacccctgggctccacttacctgccccctgctccttcagggatggaggcaatggcggccagcacttccctgcctgaccctggagactttgaccggaacgtgccccggatctgtggggtgtgtggagaccgagccactggctttcacttcaatgctatgacctgtgaaggctgcaaaggcttcttcaggcgaagcatgaagcggaaggcactattcacctgccccttcaacggggactgccgcatcaccaaggacaaccgacgccactgccaggcctgccggctcaaacgctgtgtggacatcggcatgatgaaggagttcattctgacagatgaggaagtgcagaggaagcgggagatgatcctgaagcggaaggaggaggaggccttgaaggacagtctgcggcccaagctgtctgaggagcagcagcgcatcattgccatactgctggacgcccaccataagacctacgaccccacctactccgacttctgccagttccggcctccagttcgtgtgaatgatggtggagggagccatccttccaggcccaactccagacacactcccagcttctctggggactcctcctcctcctgctcagatcactgtatcacctcttcagacatgatggactcgtccagcttctccaatctggatctgagtgaagaagattcagatgacccttctgtgaccctagagctgtcccagctctccatgctgccccacctggctgacctggtcagttacagcatccaaaaggtcattggctttgctaagatgataccaggattcagagacctcacctctgaggaccagatcgtactgctgaagtcaagtgccattgaggtcatcatgttgcgctccaatgagtccttcaccatggacgacatgtcctggacctgtggcaaccaagactacaagtaccgcgtcagtgacgtgaccaaagccggacacagcctggagctgattgagcccctcatcaagttccaggtgggactgaagaagctgaacttgcatgaggaggagcatgtcctgctcatggccatctgcatcgtctccccagatcgtcctggggtgcaggacgccgcgctgattgaggccatccaggaccgcctgtccaacacactgcagacgtacatccgctgccgccacccgcccccgggcagccacctgctctatgccaagatgatccagaagctagccgacctgcgcagcctcaatgaggagcactccaagcagtaccgctgcctctccttccagcctgagtgcagcatgaagctaacgccccttgtgctcgaagtgtttggcaatgagatctcctgactaggacagcctgtggcggtgcctgggtggggctgctcctccagggccacgtgccaggcccggggctggcggctactcagcagccctcctcaccccgtctggggttcagcccctcctctgccacctcccctatccacccagcccattctctctcctgtccaacctaacccctttcctgcgggcttttccccggtcccttgagacctcagccatgaggagttgctgtttgtttgacaaagaaacccaagtgggggcagagggcagaggctggaggcagggccttgcccagagatgcctccaccgctgcctaagtggctgctgactgatgttgagggaacagacaggagaaatgcatccattcctcagggacagagacacctgcacctccccccactgcaggccccgcttgtccagcgcctagtggggtctccctctcctgcctactcacgataaataatcggcccacagctcccaccccacccccttcagtgcccaccaacatcccattgccctggttatattctcacgggcagtagctgtggtgaggtgggttttcttcccatcactggagcaccaggcacgaacccacctgctgagagacccaaggaggaaaaacagacaaaaacagcctcacagaagaatatgacagctgtccctgtcaccaagctcacagttcctcgccctgggtctaaggggttggttgaggtggaagccctccttccacggatccatgtagcaggactgaattgtccccagtttgcagaaaagcacctgccgacctcgtcctccccctgccagtgccttacctcctgcccaggagagccagccctccctgtcctcctcggatcaccgagagtagccgagagcctgctcccccaccccctccccaggggagagggtctggagaagcagtgagccgcatcttctccatctggcagggtgggatggaggagaagaattttcagaccccagcggctgagtcatgatctccctgccgcctcaatgtggttgcaaggccgctgttcacccacagggctaagagctagcgctgccgcaccccagagtgtgggaagggagagcggggcagtctcgggtggctagtcagagagagtgtttgggggttccgtgatgtagggtaaggtgccttcttattctcactccaccacccaaaagtcaaaaggtgcctgtgaggcaggggcggagtgatacaacttcaagtgcatgctctctgcagccagcccagcccagctggtgggaagcgtctgtccgtttactccaaggtggggtctttgtgagagtgagctgtaggtgtgcgggaccggtacagaaaggcgttcttcgaggtggatcacagaggcttcttcagatcagtgcttgagtttggggaatgcggccgcattccctgagtcaccaggaatgttaaagtcagtgggaacgtgactgccccaactcctggaagctgtgtccttgcacctgcatccgtagttccctgaaaacccagagaggaatcagacttcacactgcaagagccttggtgtccacctggccccatgtctctcagaattcttcaggtggaaaaacatctgaaagccacgttccttactgcagaatagcatatatatcgcttaatcttaaatttattagatatgagttgttttcagactcagactccatttgtattatagtctaatatacagggtagcaggtaccactgatttggagatatttatggggggagaacttacattgtgaaacttctgtacattaattattattgctgttgttattttacaagggtctagggagagacccttgtttgattttagctgcagaacgtattggtccagcttgctcttcagtgggagaaaacacttgtaagttgctaaacgagtcaatcccctcattcaggaaaactgacagaggagggcgtgactcacccaagcatatataactagctagaagtgggccaggacaggcccggcgcggtggctcacgcctgtaatcccagcagtttgggaggtcgaggtaggtggatcacctgaggtcgggagttcgagaccaacctgaccaacatggagaaaccctgtctctattaaaaatacaaaaaaaaaaaaaaaaaaaatagccgggcatggtggcgcaagcctgtaatcccagctactcaggaggctgaggcagaagaattgaacccaggaggtggaggttgcagtgagctgagatcgtgccgttactctccaacctggacaacaagagcgaaactccgtcttagaagtggaccaggacaggaccagattttggagtcatggtccggtgtccttttcactacaccatgtttgagctcagacccccactctcattccccaggtggctgacccagtccctgggggaagccctggatttcagaaagagcaagtctggatctgggaccctttccttccttccctggcttgtaactccaccaacccatcagaaggagaaggaaggagactcacctctgcctcaatgtgaatcagaccctaccccaccacgatgtggccctggcctgctgggctctccacctcagccttggataatgctgttgcctcatctataacatgcatttgtctttgtaatgtcaccaccttcccagctctccctctggccctgccttcttcggggaactcctggaaatatcagttactcagccctgggccccaccacctaggccactcctccaaaggaagtctaggagctgggaggaaaagaaaagaggggaaaatgagtttttatggggctgaacggggagaaaaggtcatcatcgattctactttagaatgagagtgtgaaatagacatttgtaaatgtaaaacttttaaggtatatcattataactgaaggagaaggtgccccaaaatgcaagattttccacaagattcccagagacaggaaaatcctctggctggctaactggaagcatgtaggagaatccaagcgaggtcaacagagaaggcaggaatgtgtggcagatttagtgaaagctagagatatggcagcgaaaggatgtaaacagtgcctgctgaatgatttccaaagagaaaaaaagtttgccagaagtttgtcaagtcaaccaatgtagaaagctttgcttatggtaataaaaatggctcatacttatatagcacttactttgttgcaagtactgctgtaaataaatgctttatgcaaaccaaaaaaaaaaaaaaaaaa

SEQ ID NO: 1141 - DNA, 2428 bp, Homo sapiens
acctggccgccatgcgcctctcctcctccccacctcgtggcccgcagcagctctccagctttggctccgtggactggctctcccagagcagctgctcagggccgacccacacccccaggcctgccgacttctccctggggagcctccctggcccaggccagacatccggcgcccgggagccccctcaggccgtcagcatcaaggaggccgccgggtcctcaaatctgcctgcgccggagaggaccatggccgggttgagtaaggagccaaataccttgcgggccccccgtgtccgcacagccttcaccatggagcaggtccgcaccttggagggcgtcttccagcaccaccagtacctgagccctctggagcggaagaggctggccagggagatgcagctctcagaggtccagataaaaacctggtttcagaatcgccgcatgaaacacaaacggcaaatgcaggacccccagctgcacagccccttctcggggtctctccatgcgcccccagctttctactcaacgtcttctggccttgccaatggcctgcagctgctgtgcccttgggcacccctgtccgggccccaggctctgatgctgccccctggctccttctggggtctctgccaagtggcacaagaggccctggcatctgcgggagcttcctgctgcgggcagcctctggcgtcccacccccctaccccaggccggccttcgctgggaccagccctgtccacggggccccggggcctgtgtgctatgccacagacgggggatgcattttgaggaggcacctctgactcccacactcgcggtcttgctgatcgcacctggctcctacctggaggactcagttgttctgtttacatcctggtggcacctctcaccctgacccacacaaaggttctggagattactggagaatatatataaatatatatatgtacgtatatatgtaaatacacatatacgtatatataaatatatatatacatatgtgtgtgtatatatatatatatttttttttttttttttttttttgagacggagtgttgctctgtcacccaggctggagtgcaatgacgcaatctcggctcactgcaacctccgcctcctgggttcaagcgattctccagcctcagcctcccgagtagctgggattacagacacccgccaccacgcccggctaattttttctatttttagtagaaatggggtttcaccatgttagccaggctggtctcaaactcctgaccctgtgatccgcccgcctcggcctcccaaagtgctgggattacaggcatgagccactgcacccggccctgagaatatatttattaaagccacctcttcactgaaagttaccgaaagagtcggtttaggaaggaaacgaagggtcagtgaacagagtcaaatgcagaagtgggcttgtcatgggtagggctttcggcgtacgataaaaggatcatttgttttttaaaaggggttggaaaaactggttttccagttggaaacagtaaaggttgtaagctttgtgtgtacaaaagaaaacagggaatgcaggtgtgtttatagcgttgtggttcaagtccctcttaacaagaactccaaagctggaaagcaggagggaacaaaggtgaacatgaaggcgaggatgctggggccctgcagtgcgctctaggctgtgcgtgagccgggactgtacccacagcttgctgagggctgctcttcttgggccagggaaagcagggcagccgggacctgcggctgtgcctggactgaagctgtcccgcaggtccccaccctccaacacgtgctcacctgtccccctcctcgcagcagcctcgggacaaaacaatgactcaaggacagcacttctcgcagaaggtctggaagtgcccagaatgggaggcacggaagcccctcccggggaggactcccgcgttgatggaccgttcttggtgcagactcctgactgcgtgcatgaaacctgagacaagtgcaattccttccatgtcgccccagagtgcccaggaggcaggcagtgcggggtgcccaggcagacgggttcagcctgcagaactggaggcgacctgtgaaacccacccgggcaccccaacaggaacagaagcgtggtcctgcggctgcgtccccagcgagtttcactttccccttgctcgtttctcccttgttgtaagtgtttacaactggcatgtgcttttaaacgtcaggtaagaggggaacagctgctgtacatcgtcctggcgagtgacaatgtgacagaagcctgggcgaggccctcggagggcagcagctggacaggggctactgggtttggcctggacagcactgatttgtggatgtggatgggggcacgttgtccgtgataaaagtacaagtgcccctcacaaaaaaaaaaaaaaaaa

SEQ ID NO: 1142 - DNA, 1608 bp, Homo sapiens
cagtgagttagcatggagggcagtgggaccggaaaaagacgtggaaaagctgcgaaaacgagccttcgaatcatggacgcgcgggcccagctcctcctccgagttcctcatccggggccgtcactcacatccggggccctcactcacatccgggaccctcatccggggctctcacccacatccgggaccctcatgcctgggcggaggagggggggccctcattcgggaccctgcactccgtcgccggaagtgccaccgagaagcgccggcctcggggctgtctacagcggcccgggagaggctgtggtggccccgagcgcgagtgtgtaggtgacaggacagcggccaggcccgcccctcccctcgtgatggtcattgtcctccagagcagtgatggaggaaataccagcccaggaagcagcagggtcaccaagggtccagtttcagtctttggagacccagtctgagtgtctgtccccagagcctcagtttgtgcaggacaccgacatggaacagggactcactggggctccacctgttcctcaggtgcctgctcttccccgtgagggaagcccaggagaccaggcagctgcgctcttgacagccaggtaccaggagtttgtgacattcgaggatgtggctgtgcaccttactcgagaggaatggggatacctggaccctgttcagagggacctctacagagaagtgatgttagagaattatgggaacgtggtctcactgggcatacttctccgccttcccaccacccggattcatagtgtgaattcctgcccggccctgagtcatacccaggcaagtgctttctctggagaaacacttgccgtccttacagcaggaatctccaagagatggcccaagtatcggcttcccatcgatattgctcgtccctgctcggaaactccttttccacgattgtgagatattaaaattgactgatggaatagaagctccccaggatgccaccactgtgtaaaatcgcagctcctcaaattacctctgtttaatttcaaatgttagggtccaaggaagccctctgttgcaaccagatatgttttgaacccagttcattcagaaaccatggttggtggtcatcatctacttgtattgtgaaaaaccagaaattccaaattcagctcttcagttatggtcttttcatattattttagaatgtgaaacttatgctgtgtgcccctccttttatgtggcgaacacaacctgccccgtatggtgcctaactctcctgtgaaccctgggcttccctcatgtttaacattctggtttcctccttccttgaagtccctgtggccctcttcaaggtcctaccttcctaccctttattctttgtggttctgtacagattgatgcaattatattgcctttcctgattaagtgttccttactctgtccttgatggaggggagaagggagggcaaagaagttaaatttatttcagggcatcaaattgaatatctacttaataactttgtaaactgtaaagtgacatacatataattgtaaagtactgttaattttatctaataattacagagtttccaacagttaaaaaaaaaaaaaaaaaaaaaaaaa

SEQ ID NO: 1143 - DNA, 4096 bp, Homo sapiens
attatcctccttattgacaaacagagcggtcgcggcggcgactctcggcgtgcggtgatagccaagccatgggagacaagaagagccccaccaggccgaagcggcagccgaagccgtcctcggatgagggttactgggactgtagcgtctgcaccttccggaacagcgccgaggccttcaagtgcatgatgtgcgatgtgcggaagggcacctccacccggaaacctcgacctgtctcccagttggttgcacagcaggttactcagcagtttgtgcctcctacacagtcaaagaaagagaaaaaagataaagtagaaaaagaaaaaagtgaaaaggaaacaactagcaaaaagaatagccataagaaaaccaggccaagattgaaaaatgtggatcggagtagtgctcagcatttggaagttactgttggagatctgacagtcattattacagactttaaggagaaaacaaagtcaccgcctgcatctagtgctgcttctgcagatcaacacagtcaaagcggctctagctctgataacacagagagaggaatgtccaggtcatcttcacccagaggagaagcctcatcattgaatggagaatctcattaaagtttattttctccaatttcttagtcacttctgtcctaccatgcaaatacacagattatgccaagaggtaccacattttcatgacagatacattcatgcacaatccataatttgagttttacataaaatagaaatttgttagaatttgttagattttattgcaatgatgcctaccaaacatttccagacttaacattttggtctctgcagttaagtgccatgaaaatgtggttgaattattcattatgcagtgttattggtaagtgtattttcacttttagtttagtgaattctaacacataattcttgaattctctactattggcatgtaacgaatttaaattttttataacatagtgcaagctgcctaaatatgtattatttgagaattgtgaaacagatagttatatgtatacaagtcaaagaacaacttaactattgctgcaacaggtttttcttaatggttatcctcttaaatacacctgctggtacttggtgtggttaaataggaaaattgttattaaataaagaatttgtatgaacctttgccaatgtttttgacacgttttactaattattgttcctgaattatgtttctggttttatctattttttgaggtttttttgtttgcttatttttcaaaacattcatttattgtaatgtttactagcggactagtaaacaataaaacattgattatttagctttataattcaggtttagtgctattgtcattgaacactggtattttctgtatcatataaaacattaaaattcaaataattataagcatttggcaaaaacaagagaaaagaaacttgccatattttacaagctgcaattttagaaaagctttaacttaatgatagttttatcattgttttcttgtcccaaacttatccagggccatagaagtatgaatctaattaaaacagaaatgggaattattgcacagaaatgggaaataactaattttaaatcagtcaaattggcttcttattaaatacaataattcttatgaaaatcatagtaccctattttcagacacagctgccagtttacacatttctcagtatcctgaaaggaaaaaagtatagccccacttatactatgtaaaattaccaataaaatatttttatgactacagattttgcatttttgtttacaactatttaaagagttttatgttgtatttagaatttcaacctagaaaccacacagtacttaaattctcctggggtctcctgctttctcttaaccatttgcttaatatatatctacctaaaggagacttctgaattgtaaatgaacttaaaaatagaatgtggatgcaaaatatcacataagacatcatgataacatttgaagaaaaaataaaactgtagaccctaacagttgtgatatttggtggtttcatgtggtaatgtaattttctgtttaattacagtactttttacaggcacagtggtactgtcttttttgtaagatgctagttgtgaaatacaattaattgcatacagtaaaagtctgtgattaaaacatttatatacctcattctttagtgttgttaaatgaaaaattaaaatttgtgtttattataagatactttcaatggaataccagctaaccagatatgttcctttaaaacatgaatttttttgtcttattctgtttttaacatgtttcaaatgttttatacatttttggagatagtaaaaatttaaaaatgtaatagggaaaatatttaatttttaagtcaaaaactatgctttaaaggaattacatcttatgatcaaataactttcaggatgtattttaaatgagctgcaagagagaaaaatctgacaggagatgggattttacctgaatggagcatactcatatttctacataggtgggaagatactcatctttctacatagacgggaacacggtgtagcatggagattaagcgtgctaactgacacctcatgtttgaatcctgttgtagaatggaaatgagcttaaattacccaagcttactttccatctataaaacagggctaataatggtaatcacatctaatttatagggtttttgggaggattaagtcaatccgtgtaaaattcttaattatctgacacatactggtcactcagtaaatgtgagcttttaccattgttataggtaaaatcccattacaaaaatacaaaaatattttttgtaacagttattttcctgccctcttggatgacctaaagtaatagtgttttatagatttcactaaattttcagtgtaatatcagatgttttctctggatgcagaaagaccatctttccataattaaagaacctggtgggtgtgcactatgagattggagaaatgaattaagttgacttgaaattattttacttttattaatcacaggtatctcaacctgcctttgtttcaccctacttcaagtacacttccacaccaggaaaacagacccaaattccataaacagaactgacgttaaaatatgcgaaagattcagaacctaggtttagggtacatgtttttctctgtttcatgaacttacagtgtggtttgagcactgggttcttttagccaaattccatacaaaaagaatttggatgttttccagcatttattaccttactttgctataagtaagagtgaagataggccgggtgtgatggctcatgccagtaatcccagcactttgggctgaagcaggcagatattttgagcccaggaccagcctgggcaacatggtgaaagctcatctctatgaaaaaatttgaatatacatatatatatatatgtatatttaaaaagtgaatataatttgaggcacagaagaatattcttaaaaccttttgtattatacaatagaaataaaggttttatttttattaaatgctttcctaaaatgatagtggataatagacaaagtgaaaacatttaaaaaggaagagaaacttcagcctttctaagttgatagcatgtttattaacttttagataaagatccttatagactgaaagaatgtagcctctgcattaatggtaaatggtctagaagttttcgtttccactgaggcttccgccactcgcttttttaaacttcctgctatggtttggatatggtttgtcctcaccaaaactcatgctgaggcctgagtccccagtttgattgtgttggtaggtggtgcctttaagaggtgattaggtcattgagatggattaaaggctttctcatgaggctcagttagttctggaatggattcgctcttgcaggaatggatgaattctcacaagagtgggttgttatgaagtgaggatgcttcttgtgttctgttctctttgccctcctcagttcaccatctgctttccaccatgagttgaagcagcatgaggccctcatcagatgggctccctgatcttggactcctcagcctttggactcataagccaaaataaatctgttttctttataaa

SEQ ID NO: 1144 - DNA, 1606 bp, Homo sapiens
gagccggggggaggggccggggcggtggcggctgtggccggtactggacccggcgggatgagcgaggtggaggcggcagcgggggctacagcggtccccgcggcgacggtgcccgcgacggcggcaggggtggtagcggtggtggtaccggtgcccgcaggggagccgcagaaaggcggcggggcgggcggcgggggcggagccgcctcgggccccgctgctgggaccccctcggcgccgggctcccgcacccctggcaatccggcgacggcggtctcgggaacccccgcccccccggcccggagtcaggcggacaagccggtgctggcaatccaagtcctgggcactgtcaaatggttcaacgtccggaatggttacggattcatcaacaggaatgacaccaaggaagatgtctttgttcaccagacagctattaaaagaaacaaccccaggaagtttctgcgcagcgttggagatggggagactgtggaatttgatgtcgtggaaggagagaagggcgcagaagccactaatgtaactgggcctgggggagtacccgtgaagggcagccgttatgcccccaaccgacgtaagtcccgccgattcatcccccggcctccctcagttgccccaccacccatggtggcagagatcccctcggcggggacaggacctggcagtaaaggggagcgggctgaagactctgggcaacggccccgacgatggtgccccccacccttcttctaccgacggcggtttgtgcgaggcccccggcctcccaaccagcagcagcctatagagggcactgacagggtagaacccaaagagacagccccattggaggggcaccaacagcagggagatgagcgagtccccccgcccagattccggcccaggtaccgaaggcctttccgccccaggccacgccagcagcctaccacagaaggtggggatggtgagaccaagcccagccaaggtcccgctgatggttcccggcctgagccccagcgcccacgaaaccgcccctacttccagcggagacggcagcaggcccctggcccccagcaggcccctggcccccggcagcccgcagcccctgagacctcagcccctgtcaacagtggggaccccaccaccaccatcctggagtgattccaactcaactcagaggacacccagagctgccatctggtatctgccagtttttccaaatgacctgtaccctacccagtaccctgctccccctttcccataattcatgacatcaaaacaccagcttttcaccttttccttgagactcaggaggaccaaagcagcagccttttgctttttcttttttcttccctccccttatcaagggttgaaggaagggagccatccttactgttcagagacagcaactccctcccgtaactcaggctgagaaggaaccagccagctcttacctcctcctggttgcttttcttgcccccaccccaagtttatttttgttttcccccggccccctacctctgaagccattttatgatctgtcatgtgccacctgagcctccagtaaaaacaaaaacaggctttcctgtggtaaaaaaaaaaaaaaaaaaaaaaa

SEQ ID NO: 1145 - DNA, 2592 bp, Homo sapiens
agggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgccccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcggcggctcgtcgtcgtcgggaggcggccgcgtcaagaagggcggcggcaagaagagcggcaagaagagttacctcagcggcggggccggcgcggcgggcggcggcggcgccgacccgggcaacaagaagtgggagcagaagcaggtgcagatcaagaccctggagggcgagttctcggtcaccatgtggtcctcagatgaaaaaaaagatattgaccatgagacagtggttgaagaacagatcattggagagaactcacctcctgattattcagaatatatgacaggaaagaaacttcctcctggaggaatacctggcattgacctctcagatcccaaacaactggcagaatttgctagaatgaagccaagaaaaattaaagaagatgatgctccaagaacaatagcttgccctcataaaggctgcacaaagatgttcagggataactcggccatgagaaaacatctgcacacccacggtcccagagtccacgtctgtgcagaatgtggcaaagcttttgttgagagttcaaaactaaaacgacaccaactggttcatactggagagaagccctttcagtgcacgttcgaaggctgtgggaaacgcttttcactggacttcaatttgcgcacacatgtgcgaatccataccggagacaggccctatgtgtgccccttcgatggttgtaataagaagtttgctcagtcaactaacctgaaatctcacatcttaacacatgctaaggccaaaaacaaccagtgaaaagaagagagaagacccttctcgaccacgggaagcatcttccagaagtgtgattgggaataaatatgcctctcctttgtatattatttctaggaagaattttaaaaatgaatcctacacacctaagggacatgttttgataaagtagtaaaaattaaaaaaaaaaaactttactaagatgacattgctaagatgctctatcttgctctgtaatctcgtttcaaaaacacagtgtttttgtaaagtgtggtcccaacaggaggacaattcatgaacttcgcatcaaaagacaattctttatacaacagtgctaaaaatgggacttcttttcacattcttataaatatgaagctcacctgttgcttacaatttttttaattttgtattttccaagtgtgcatattgtacacttttttggggatatgcttagtaatgctacgtgtgatttttctggaggttgataactttgcttgcagtagattttctttaaaagaatgggcagttacatgcatacttcaaaagtattttcctgtaaaaaaaaaaaagttatataggttttgtttgctatcttaattttggttgtattctttgatgttaacacattttgtataattgtatcgtatagctgtattgaatcatgtagtatcaaatattagatgtgatttaatagtgttaatcaatttaaacccattttagtcactttttttttccaaaaaaatactgccagatgctgatgttcagtgtaatttctttgcctgttcagttacagaaagtggtgctcagttgtagaatgtattgtaccttttaacacctgatgtgtacatcccatgtaacagaaagggcaacaataaaatagcaatcctaaag

SEQ ID NO: 1146 - DNA, 1438 bp, Homo sapiens
atggcggccctgggggacgaggtgctggacggttacgtgttcccggcgtgccccccctgctcgtaccggtacccataccccgcggccaccaagggcaagggcgcggcgggcggcagctggcagcagcgcggcaggggctgccttcccgcctcctccccctgctcggcgggcgcggcctcgttgtccttcccgggctgcgggcggctgacggccgccgagtacttcgacagctaccagcgggagcggctcatggctctcctggcgcaggtggggccgggtctcgggccgcgcgcccgcagggccggcagctgcgacgtggcggtgcaggtgagcccgcgcatcgacgccgcggtacagtgctcgctggggaggcgcacgctgcagcgccgggcccgcgaccccgagtccccggccggccccggggccgagggcaccacgggtggcggctctttctcccagcagccatcccgtcgaggcctggagcagggcagcccccagaacggcgccccgcggcccatgcgcttcccgcgcaccgtcgccgtgtactcgcccctggccttgcgccgtctcaccgccttcctggaggggcccgggcccgcggcgggcgagcagaggtccggggcgtcggacggagagagggggccgccgcccgcgcggcttcaaggcccagaggagggggaggtgtggacgaagaaggcgccccggcggccgcagtccgacgacgacggcgaggcccaggccgcagtccgagcgagctgggagcagccggccgacggtcccgagctgccgccgcgagaggcccaggagggcgaggcggctccgcggtcggcgctaaggagcccggggcaacctccgtcggcggggagggcccgagacggcggcgacggacgggaggcggccgtcgcgggagaggggccgtcgccacggagcccggagctgggcaaggagcggctgcgcttccagttcttagagcagaaatatggctattaccactgcaaggactgcaacatccgctgggagagtgcttatgtgtggtgtgtacagggaactaacaaggtttacttcaaacagttttgcagaacttgtcagaagtcttataacccttaccgagtggaggatatcacctgtcaaagttgtaaacaaacgagatgttcctgcccagtaaaacttcgccacgtggaccctaaacggccccaccgtcaagatttgtgcggtagatgcaaaggcaaacgcctgtcctgtgacagcactttcagcttcaaatacatcatttaggtgaaagtcagtgttgctgtgcatgcgctgatggagtagacgagtgagcttttccgtgcctctcctccacctctcccttctcaaaatacttcatgaaaggcagtgtattctgaaaaagccttcaaataaaggtattgcaacacgatttatacattgcataaaa

SEQ ID NO: 1147 - DNA, 2839 bp, Homo sapiens
tagggacaagcctgagcgtcacaggctccccacaaacaaccgcgtgacccggggactttccccagggtgtgcaaaagcacaggcaccccctcagttctggggtgaagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccgtgccctctggtggtcagaagatgctgtgctgtctcgttaggatgaatggattaaaatgtacttttcctcctctgcttctggagagggagagaggaatattccagaagccactgtgttccttctgctttctgtgtgggtctctaattaacagaagatggcaaagcccagccacagcagctatgtccttcagcagctaaacaaccaaagagaatggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccactatttgatgtatgtaaaaaaagttccgtgtccaaattatctactccaaaagaacgtgtgtcaagacgctttgggcggagttttacctgtgatagctgtggatttggctttagctgtgaaaaattattagatgagcatgtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatactcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccaggtatgtctgttccatttgtgatcaaggaaacttcagaaaacatgaccatgtacggcatatgatttctcatttatctgctggtgagactatatgccaggtctgctttcagatattcccaaataatgaacagttggagcagcacatggatgttcatctgtatacatgtggaatatgtggagcaaaatttaatttgaggaaagatatgagatcacattataatgccaagcatttgaaaagaacctgagtgattttctactgtactaatgtttagatgatagcagataaaacaccaaagcaaaggatatgagctatttaggaattgattatataagatgatttgttagaaacaaatttcaaggcccttttaactttaatatttttgtttaggattttaagtatctacatttaggtattaaatgtttatcatttttgttgtttcttaatagaattatttgtttttagtttttcttagctatgattaaaatttttaaatgtaaaaaaaaaaaaaaa

SEQ ID NO: 1148 - DNA, 3105 bp, Homo sapiens
cgcggcggcagcagcagcagcagcagcgagaggcagaggcggcggcggcggggaggacagcacggccgaggctgcccagcggcgcctcctccacaccccccgccgcagcagcaccggcgacagattttttaaaaaatggatttggccaaccatggacttattctactgcaacagttaaacgctcagcgagagtttggtttcctgtgtgactgcacggttgcaatcggcgatgtatacttcaaggcacacaaatcagttcttgcttcattctccaattactttaagatgttgtttgtccatcagaccagtgagtgtgtccgcttgaaaccaactgacatacagcccgacatcttcagctatctcttacacttgatgtacactgggaagatggcgcctcagctcatcgacccggttcgattagaacagggcatcaagtttctgcacgcctacccgctcattcaggaagccagcctcgccagccagggagccttttctcaccctgaccaagttttcccactggcttcttcattgtatggcattcagattgcagatcatcagttgagacaagccaccaagattgcttcagcacctgaaaaactcgggcgagatccacggccacagacctccaggataagccaggagcaggtccctgaggcctcacagctctcccagctgacttcaaatctggcccaggtgaatcggacaaatatgactccctcagaccccctgcagacctcgctgtctccagaacttgtttccactcctgttcctccccctcctcccggggaggagaccaatctggaagcatcttcctccgatgagcagcctgcgtccctcacaatagcccacgtcaagccaagcatcatgaagaggaatgggagctttccaaagtactatgcctgccacctgtgtggacggcgcttcactctccggagcagcttacgtgaacacctccagatccacacaggagtacctttcacatctagccaacagggagaaagtcgcgtccccctgactctctgtagcaatgcagctgacctcgggaaagatgccatggaagtgcctgaagccgggatgataagtgacagtgagctgcagcacatctctgattctcccatcatcgatgggcagcagcagtcggaaaccccacccccctcagacattgctgacattgacaacctggagcaggccgaccaggagagggaggtgaagaggcggaagtacgagtgcacaatatgtggacgcaaatttatccagaaaagccactggagggaacacatgtacatacacaccgggaagcctttcaagtgcagcacttgtgacaaaagcttttgcagggccaaccaggctgcccgccacgtgtgcctcaaccagagcatcgacacttacaccatggtggacaaacagactctggaactctgcacatttgaggaagggagtcagatggacaacatgctggtgcaaacaaacaaaccctacaaatgcaacttgtgtgacaaaacattctccactcccaatgaggttgttaaacattcatgccaaaaccagaactcggatgtttttgccctagacgaagggcgatccattctcctgggcagtggggactcggaagtaacggagcctgaccacccagtgttagcttccatcaaaaaggaacaagaaaccgtcttactagactgaatgtcacttatctttttaaaaaactctcatttttacaaagactatcttccctcccttccctgaattcagaactgtagttctccatggcatgatacaaacaggtccttgttctcttctcctcttccccttttccacatcccagccccacctctgtaaaggctttgtgcattataaacctggaatgtatcgactttctttcaggggatattggaaagataatggtcattatacttataaactcaaattttgagaggttttagattattcagaagcatacttggaactaatgaagggtatataataaaacaactggaatccaatttggtaagctaaaattatgactttccctgggtaaaaagtcttctcagaaaaacaatgtcagaaaataacagcgtgctgcttagaaatacggctgggctctgtactatgcaaaatctagaaagtgtggggaaactttaaacccaagaaaacgttcttagtattcatcctccaggtgtcttacttcagaatgcatcctttgagattatgtccacttaagagaaatcatcagttaagaaatctactttaacaaaacaaaaaggagaaaaagtaataatgtgatggcaatcttaatttttgggtacaacatgacaagctgtgagtttgtgtgtttgtaagagaaaaatgtgtgggtacttgctaataaacaggtgaattaatgcacatccttatctcattgctggcttctttccaagttgagcaacaacaaaatgctgtatttgagtttctgacaaatttgttttaaaaatcaaatttgaatgtactattctataaattgcctttctgaatagaacatgacatgccattttctagcagctgccagtgataatttgttttacactaacttttaaatcagtgtgtgtactgcagggaaaaggatataggaatactcatcttacaggggaatttgtgaccagaagatgtagtaacttcaatgactgaaagtcaatgctgatagtttactggcaacattaattgaagcatcaaaaataaatggcaaagagaaatcaggacaaaaaatctaattgctgtttgggaaaaaacttgattttgatgtttattctccaggtttttggttgtttttttttctttcttctttcttaatgcctgaaattttctccattggcccgaaagcagtaaaaattgttcattaatcttccgttaggccaataaaagaagggcctcacaagacaaaacaggagccagaagtaaggactgaaggagaaggggagaatagctaatagctatagtatatgtatatgttaaaaactgaatatcccatcatcctatttcatgtatagttgagttctcaaatttgtaagtttttatacatcctttcattgaataaacgtttaattaaatgagtaaaaaaaaaaaaaaaaaaaa

SEQ ID NO: 1149 - DNA, 5961 bp, Homo sapiens
agagtcgtgggtaaaccccccgctcgctggttgggcgaccttttgaagtgacagggagagaagaatttttttctttaatcccaccgcctctcctcgctgctcccttttgcactgaggcttaaggtttgaagactcgagggtaaaattgggccgctttcattctagtttggacaacggtttcatcttcagcaaaagcctctcattcgtagccccccccagctggaaaatggtctgctctgcgaatcgaaggaagaggcccagcagaagggactcgctgagccaccccccgccccactccatgttggctgtgctctcaggctggcaccatgcccccccctgcagaggtgacggacccgtcccatgcccccgccgtcctgcgccagctcaatgaacagcggctccgtggcctcttctgtgacgtcaccctcatagccggagacaccaagttccctgctcaccgcagcgtcctggctgcttcaagtcccttcttcagagaggccctgctcacttcagccccactaccccttccaccagctactgggggcgccgcacccaaccctgccaccaccacagctgcctcttcctcctcctcctcttcctcgtcttcttcctcttcttcctcctctgcttcttcttcttcttcctcttcctcttcctctccccctccagcctctccccctgcttcttccccaccccgggtcctggagttgccaggagtcccagcagctgcgttttctgatgtcctcaacttcatctacagcgcccggctcgcactgcctggtggtggaggggacggggcagctgtagcagagattggagctttggggcgccgtctgggcatctcccgccttcagggcctgggggagggaggtgatgcctgggtacctcctaccccagcccccatggccacctcgcagcctgaagaggacagctttgggcccgggcccaggccagctggggagtgggagggtgacagggctgaggcccaggcccctgacttgcagtgctccctgccccggcggcccctcccctgcccccagtgtggaaaaagcttcatccatcccaaacggctgcagacccatgaggcccagtgccgacgaggggccagcacgcgggggtctacagggctgggagctgggggcgctggccctggtggtcctgcaggggtggacgcctcagccctgcctccaccagtgggcttccgagggggccccgagcacgtggtgaaggtggtgggcggccacgtgctgtatgtgtgcgcggcctgcgagcgttcctacgtgaccctgtccagtctgaagagacacagcaatgtacactcgtggcggaggaagtacccctgccgctattgtgagaaagtgtttgctctggcggagtaccgcacgaagcatgaagtgtggcacacgggggagcgcaggtaccagtgcatcttctgttgggagacctttgtcacttactataacctgaagacccaccagcgagccttccacggcattagcccgggcctccttgccagtgagaagacacccaatggaggctacaagcccaagctcaatacactcaagctctaccgcctgctccccatgcgggcagccaagcggccctacaagacctacagccagggagccccggaggctcccctttctccaaccctcaacacaccggcccctgtggcaatgccagccagcccgccgcctgggcctccacctgccccagagcctggccctccaccctctgtcatcacttttgcccacccagccccctctgtcattgtccatgggggcagtagcagtggtggaggggggagtgggacggccagcacaggagggtcccaagctgcctcggttatcacttacactgctcccccgaggccacccaagaaacgagaatacccacctcctccccctgagcctgcagccacacccaccagcccagccacagcagtcagcccagccaccgctgcagggccagccatggccaccaccacggaggaggccaagggccggaatccacgggctggaaggactctgacttacacagccaagccagtgggcgggattggtggaggtgggggtccccccacaggggctggccggggcccctctcagctgcaggctccacctccactgtgtcagatcactgtgcgaataggggaggaggccatcgtcaagcgccgcatctcagagactgacctgcgtcctggggagctgagcggagaggagatggaggagagtgaggaggacgaagaggaggaggacgaagaggaggaggaggaggatgaggaggaatcaaaggctggtggggaggaccagctctggaggccctactactcctacaagcctaagcgcaaggctggagctgctggaggtgccagtgtggggggcagtgggctgccccgaggccgccggccaccacgttggaggcagaagctggaacggaggagctgggaggaaaccccagcggccgagagcccagcgggacgtgcccgcacagagcggaggcaccgatgcggggactgtgcccagaccttcaccaccctgagaaagctgcggaagcaccaagaggcccacggtgggggctcccacagctcccgggccggacggaggccctccacccgctttacctgcccccactgcgccaaggtgtgcaagaccgcagctgccctgagccgccacgggcagaggcatgctgctgagcggcccgggggcaccccaacccctgtcattgcctattccaagggcagcgctggcaccaggcccggggatgtcaaggaggaagccccccaagagatgcaagtctcctcatccagcggtgaggcaggtggcgggagcactgctgctgaggaagcttccgagaccgcctcactccaggaccctatcatttcagggggtgaggagcccccagtagtggcaagcgggggcagctatgtatacccacctgtgcaggaatttccactggccttgattgggggcggccgggaacctggcggtggcaggggaaaatctgggagtgaagggccagtgggggctggtgagggggaccggatggaggggataggggctgccaaagtcactttctaccctgagccctacccgctcgtctatggcccccagctccttgccgcctacccttacaacttcagtaacttggccgctctcccggttgctctcaacatggtcctacctgatgagaagggtgcgggggcccttcccttcctaccaggggtctttggctacgcagtgaatcctcaagcagcaccccctgccccaccaacaccacctcccccaactcttcctccaccaattccccctaagggagaaggggaaagggcaggggttgagagaacccagaagggcgatgtggggtgaaccctggggctcaatccccctttcaccagatgccaccctccctgaaccccccaccactaccagctccctggcctccctgccccttgggagccccttcacactcttgtgcagggacttgggggcccctggagctcaggggtcaggctgctttgtgtgagatgtagttttcccatctcctgggaagggatctttcgaggttcccctctcagtcttcctccagggaatggcctccatgaggggcagggccagcttccatcccttctccagcccttggggcaactgagcaatatacttaacctgaatctctactcacagcccccaccagctctgaatgtctaacctgctcccctgattcgtaaacctaggggaaaccatctctctcacctaatgacccgccttgttctgaagctttctctaagcccttcccagttgcttcctagcacattccattctttgtggcccagggcctggaccagaccattgtgatacctgaccccgcccacctgggagtgtggctttgggtttcatccttccccagcgtgggtctctacgtccctgtttcccttgtatcaagacaccttcctcagcttccatgcctttggatcttccatgttcctccccatattcctggacttcggagatggcctctcccaagccaggtcaaggaggtttgggggagggttgcccctctgcccctctgttctgtggctgagcactttcccagtccagggcagggaaatattggccctatcttgacccccaaatccagtgagctccagattcttccaaggcaaaagaggtaagcagatcacacctctttctgcctctacatatggcctattctgggctagaccagatttgggggccaggagggaagaactccatatgggatggagaagggaatctactttctccctgtttttttttcctgatggtttctcccagactagaccaaatagccagaaaaatgataggggtcggatgggtgggtaagcccaggatttgcacatgaccttccatccttacctgtattcccatctccccagtgtcactcccctcaccaatcactccagatggttttgggggaaccattctactcttctggtgggctttggggtatccccaccaactttcccttcaaaatagcaccttacaccccatctttgactcagttccccacacccaaagatcccagcctagggatggggtacagggactttaaatagtccctaatccctaatttgcactagttaaccctggtcagggtccctgtatttccttccagtgggggagataaatgtttgctcctaattctctttgaaaactgggcctccctgctctgtgattggataaatatttcccatcccacccacctccccccaaaaaatagctcacaaggggagagccagtatgggggagcaaatttgacaaatgggaattagaggagtgcagttttaaaaggaaaagttgctgtcatcaaaatggcagccttttccccagctactgtttttggggccaagatggctgccctagcagcaatcactgccaagggcaagatcatggcttttggagggaggtgagtttagggagggccaggaccatcctcctacccctcataccctcccagcatatacaaaaggggaggttttagacaggctccctgaatgttaaccacagaggagtcactccttcattcctcctctgtctctttgcacttttcttggtcttggccacagcctgagtgacgaatttcctactgaatgtaccaagttccaatttttaagggggggaaaggtttcaaatggggaaaaacacacaaaaaaaaaatcactaaaaattcccacaaatcttgtttctggcactttagaaaaactgcaaaaaaatacgtaataaagaatacatatatatatatctacacacaaattatatatctatctatctatacagcggaaccacaagagagactgaggaaggcctggaggcaggggcagaggtgacgacagtgcccctatatccttaacccatactcctctgaggcaaacaggcatgggaaaatggaagggttgaggatggaccggagaattggaacttcagaataggtcaaaattccaaaaccatggacatttttttttgggagaattgagattgtagacattttttttttcttaaatatgatcaaggaaaatagcttccagaatgtggtggttctgggcaacaaatgagattgtggcgacgtggagattaaaatatatgtatttgagctggggaatttgaatattgtgagtttcagatgttggaaatttgggattttgcagttttgtcttttgaaaatgatcaagtcttgtcagttcgtgccctctttccccatgttccctgggaagacgggtggtggcagagtgagaaggccactggttctgtgccgcagcacgcaaaatttagaattctacagactagctctatacgtagtgaggacccagatttagagaaactgaccaatatttatctccgcatttgtgtgtgtgtccaactctgtaggccaataaaccaacaagacaaatgaactgtgctccacaaaaaaaaaaaaaaaaaaaaa

SEQ ID NO: 1150 - DNA, 1184 bp, Homo sapiens
gcccctccagcctgctggagccggagccggagccggagccggagccggagccggagccagagccagagctcgaggactcaccggcccagtctccgtccgggatggggccccgctcccgggcgcgttgccgcccagtcccggggaccgtccctaccgcgagggtctgaggcgcggctgccccggggagggtggaaggccaggcgtggggcccgaacctctggctgactttggcagggcccatctggcacggcctccgcggcgcgcagctgttttcaagtcagcaaacatttactgaggatctactatgtacaagatgaacatctgcaacaagccctccaacaagacggcccctgagaagagtgtgtggacggcaccggcacagcccagcggaccctcccctgagctgcagggccagcgatcccgccggaatgggtggagctggccccctcacccgctccagattgtggcctggctgctgtacctcttctttgctgtgatcggctttgggatccttgttcccctcctgcctcaccactgggtgcccgctggctacgcttgcatgggcgccatctttgctggccaccttgtggtgcacctgaccgccgtctccatcgatccagcagatgccaacgtgcgggacaagagctatgcggggcccctgcccatcttcaaccgaagccagcacgcacatgtcattgaagacctgcactgcaacttgtgcaacgtggatgtgagcgctcgctccaagcactgcagcgcctgcaacaagtgcgtgtgcggtttcgaccaccactgcaagtggctcaacaactgtgtgggcgagcggaactaccggctctttctacacagtgttgcatccgctttactgggcgtcctgctcctggtgctggtggccacatatgtcttcgtggagttctttgtcaaccccatgcgtctgcgcaccaaccgacactttgaagtcctgaagaatcacacggatgtgtggttcgtgttcctgcctgccgcccccgtggagacccaggcccctgccatcctggccctggccgccctgctcatccttctgggcctcctgtccacagccctcctggggcacctgctctgcttccacatttatctcatgtggcacaagctcaccacctatgagtacatcgtgcagcaccgcccaccacaggaggccaaggggg

SEQ ID NO: 1151 - DNA, 2952 bp, Homo sapiens
ggcgcggtcgagtcatcgcagggcctcaccgcttcgttctcccgtccctccccgcgccttggctcgactagccaagtgaggcgggaggcgactcggacctttccctgcatttcgtttcggccagtgccggggctacccgccctggggcctgggatccttggggcccgtgagccactcttagcggccggggctaccgcggcccgccgtggccctcatgaggcatagctgaccaagctgctggcagcctcgggcagcaactccccaacccgcagtgagagcccggagccggctgcaacttgttcgctgccctctgacctgacccgggctgcagcgggggaggaggagacggcggcggcgatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccagtgggaaagcagaagcaggacctgctggaagaggacgactcggcgggaggagtctgtctccatgtggacaaggataaggtgtcggtggagttctgctcggcgtgcgcccggaaggcgtcgtcttctcttaaaatgtagggtcaagtaatctgctctttatccgcgtttacccctttcaactcccttacaccatgtcaaacttaccttagtgggacatcttcaccggacacatttcagaggagagaaaaaaagtaatattgaatcttaaagtgtttagctaaaagcatgaatgtgacacagtaaccaactcctaatgataacatgtgactattaaatctctctgacagtttcttttttaggtgatttccttcctgccaggctccgttgtaggggttacagaacagtcgttcccgcctcacaacctgtggatacagctgttggggcagaagagacgggaccagctgctggccacatttcctgctttattttaaaaggtagtataagaatgaggaaaaagaggtaatatcagggcttctgctgttttttatttttaacatgttcataattaaaaagtattttccagcagtccaaagatgtaagttatcttacacataatatgttttattttgttatttggttatgaaaatggaatccttgttcttgcacaactgtaaatgttttgttgctagataatacgatttgagacctgaattggtctttggtttccagtgcatcacagcatattttgtaaaatcatgtactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaactttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggccgtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaattaaaaaagttatgattaatgtg

SEQ ID NO: 1152 - DNA, 3000 bp, Homo sapiens
caggccacaccggtggtctgggctggggaccgcgggtcgggtccggtttccagggggttcctggtgctcgaggctggcggcgaggaaggaccagatggcctttgaggatgtggctgtgtacttctcccaggaggagtgggggctcctggacacagcccagagggccctgtaccgccgcgtgatgctagacaacttcgcacttgtggcctcgctgggactctccacctctcgacctcgtgtggtcatccaactggagcgtggcgaggagccctgggttcccagtggaacggacacaaccctgtccaggaccacctacaggaggcgcaaccctggttcctggagtttgacagaggatagagatgtttctggagaatggccacgagctttcccagataccccacctgggatgactactagcgtcttccctgttgccggtgcctgccacagtgtaaaaagcctgcagagacaacggggtgcctccccatctcgggagagaaaacccacgggggtgtcggtgatctactgggagaggctcctgctaggctcaggcagtgggcaagccagcgtcagcctgcgactgacctccccgcttaggcctcccgagggcgtccggcttagggaaaagacactcacagagcatgcgttgctggggaggcagcccaggacgcctgagcggcagaaaccatgtgcacaggaggtccctgggagaacctttgggagcgcccaggacctggaggctgccggcggtcggggacatcaccgaatgggtgcagtttggcaggagcctcatagactcctcggtggccaggagccctcgacctgggacgagctgggcgaggctcttcacgctggggagaagtccttcgaatgcagggcgtgcagcaaagtgttcgtgaagagctccgacctcctcaagcacctacgcacccacaccggggagcggccctacgagtgcgcccagtgcggcaaggccttcagccagacgtcgcacttgacgcagcaccagcgcatccacagcggcgagacgccctacgcgtgccccgtgtgcggcaaggccttccggcatagctcctcgctggtgcggcaccagcgcatccacacggccgagaagtccttccgctgctccgagtgcggcaaggccttcagccacggctccaacctcagccagcaccgcaagatccacgcgggtgggcgtccttatgcttgcgcacagtgtggccgccgcttctgccgcaactcgcacctgatccagcacgagcgtacgcacacaggcgagaagcccttcgtgtgcgcgctctgcggtgctgccttcagccagggctcctcgctctttaagcaccagcgcgtgcacacaggcgagaagcccttcgcctgcccacagtgcggccgcgcctttagccacagctccaacctcacccagcaccagctcctgcacacgggcgagcggcccttccgctgcgtggactgtggcaaggccttcgccaagggcgccgtgctgctcagccaccggcgcattcacacgggcgagaagcccttcgtgtgtacgcagtgtggccgcgccttccgtgagcgcccggccctcttccaccaccagaggatccataccggcgagaagaccgtccggcgatccagggccagcctgcacccccaggccaggtctgttgccggggcatcatcagaaggtgcgccagcgaaggaaaccgagcccactcccgcctcgggcccagccgccgtctcgcagccagcggaggtctgaggtcacaggttgcagccctggccttctgtgaatcccttccacagctaaagggcatatgtcctctgcagatccacagcagagaaaaagtcccgtgcttgctagtcagggacaagggaggccctttggctgtgatttcatttgcacgtggggacaggatttgccagttcacccacagatcacacctccatccccaaagaggtagcactgcagcaacatcagggggaggacgtggtggctgaactctagtggggccgagactattcagagccagtaggaggccgacagtcacagcactgcactgtggtgcggcttcatgtgatatgacagtggatgctaaggtgagagggatgcaggcatgggttgggggtggcccagagaaacttatgacagctgtacacaaactggccgctggagagatgcccgctgagggtattctcccctcaacccactgcctctgttcatccaagacttcctaggggccagcctagcagacaagagaccacaagggactggggatcagggtctgggctctgtcagccgccacctctgggaaagagaaaaggtttgggtccactgaacatcatgtttgtagacgctgacaggtggggtcctaatgagagccaacacatgctcactgccagctcctgtcctgagtactgggaagtttctcctgaagccctgtgagatggctctgtggctggtatcccgacttggaagatgaggaaactgaggcacacggcctggcctggcttcacacacatagccgactcaggagagggatgcccatgggggaacatgtgactctcagcattggaaggacagagctaggatgatggctttccggtggcactcgttcaggtttttgcccaagtctcagcttggccaaggcctgtcactgactggtttaccaaagtcgatgtgaggaggaggctttatacctgaggggatgatgttaacttcagacaagatggagctgctcacttttgccgggtttggtggccacttcacccccaaccctgtctcacccccattatccctcctcaattggaggctggacagagctgaataggaaagacttgctattgcctaaggctatgtgtgacaccctcctgaggacctccccaccccagtgtaatggcccttcatggcagggacagaaaggtggactgggggccatttgcttcctgtggccttcagcagaccaggccctgtccctacctggagcctcacctccaaggaaattc

SEQ ID NO: 1153 - DNA, 5508 bp, Homo sapiens
gcctttgtctctggctgcagccggagctcctgctctcctcctcactgctcagtgtcctctgctcctagaggcccagcctctgtgtccctgtgacctgcagatattgggagatccacagctaagacgccgggactccctggaaacctagaaatgatggagtctcgctctgttgctcaggctgaagggcagtggtgcgatctcggctcactgaaacctccgccttccgggctcaagcaattctcctgcctcaacctcgcaagtagctgggattacaggcatgcaccaccatgcccagactgtgccataacacacatttgatgctgaaatccgggataggggaactcctttgggagtcgtgtcccttaaccccttcccccgacttcttgaagagacccacccgcgacctcggtacctcggaccagctctgtaaaagccccgcctctgccttcggataggtctggccccaccctggagtcttgcctcacagaactgattagaagagatcagagttttggctggtgcctttccggagtggttgctaacaattcccgaattccacaaggagataaatgggaaaaaaaggaaccactgacatttaaagatgtcgccatagaattctctctggaggagtggcaatgcctggatactgcacagcgggatttatataggaatgtgttgttagagaactacagaaacctggtctttttgggtattgctgtctctaagccatatctgatcacctgtctggagcaaaaaaaagagccctggaatataaaaagacatgagatggtagccaaacccccagtaatgtcttttcattttgcccaagacctttggccagagcagaacataaaagattctttccagaaagtgacactgagaagatacggaaaatgtgaatatgagaatttacagttaagaaaaggctgtaaacatgtggatgagtgtacggggcacaaaggaggtcataatacagttaaccaatgtttgacagctaccccaagcaaaatattccagtgtaataaatatgtgaaagtctttgataaattttcaaattcaaatagatataagagaagacatacaggaaacaaacacttcaaatgtaaagaatgtagcaaatcattttgcgtgctttcacaactaactcagcatagaagaattcatactagagtgaattcctacaaatgtgaagaatgtggaaaagcctttaactggttctcaactcttactaaacataagagaattcatactggagaaaagccctacaaatgtgaagaatgtggcaaagcctttaaccagtcctcacaacttactaggcataagataattcatactgaagagaaacccaacaaatgtgaagaatgtggcaaggcctttaaacaggcctcacaccttactatacataaaataattcatactggagaaaaaccttacaaatatgaagaatgtggcaaagtctttagccagtcctcacaccttactacacaaaagatacttcacactggagagaacctctacaagtgtaaagaatgtggaaaagcttttaacctattctcaaatcttactaaccataagagaattcatgctggggagaaaccctacaaatgtaaagaatgtggcagagcttttaacatatcctcaaaccttaataaacaggagaaaattcatactggagggaaactcaacaaatgtgaagaatgtgacaaagcttttaaccgatccttaaaacttactgcacataagaaaattctaatggaagagaaaccctacaaatgtgaagaatgtggcaaagtctttaaccagttctcaactcttactagacataagataattcatactggagagaaaccctacaaatgtaaagaatgtggcaaagcttttaaccaatcttcaaaccttactgaacataagaaaattcatactgcagagaaatcctataaatgtgaagaatgtggcaaagcttttaaccaacactcaaacctaattaaccataggaaaatttattctggagagaaaccatacaaatgtgaagaatgtggaaaagcttttaatcgatcctcaacccttactagacataagaaaattcatactggagagaaaccctacaaatgtgaagaatgtgacagagcttttagccagtcttcaaaccttactgaacataagaaaattcatactggagagaaaccctataaatgtgaggaatgtggcaaagcttttaaccgattctcaacccttactaaacataagagaattcatactggagaaaaaccctataaatgtgaagaatgtggaaaagcctttaatcaatcctatcaacttactagacataagatagttcatactaaagagaaactcaacaaatgtgaagaatttggcaaggcctttaaacagtcctcacaccgtactatacataaaattattcatactggagagaaaccctacaaatgtgaagaacatggcaaagtttttaaccagtcctcaaaccttactacacaaaagataattcatactggagagaacctctacaaatttgaagaacatggaaaagcttttaacctattctcaaacattactaaccataagataatttatactggagagaaaccccacaaatgtgaagaatgtggaaaagcttataaccgattctcaaacctaactatacataagagaattcatacgggagagaaaccttaccaatgtgcagaatgtggcaaagcctttaactgctcctcaacccttaatagacataagataattcatactggagagaaaccttacaaatgtaaagaatgtggcaaagcttttaacctatcctcaacccttactgcacataagaaaattcatactggagagaaaccctataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgaatatggcaaaacttaattgatcctacaagcttactacacataagaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatactttaaaccaatcctcaaacctcactaaacataagataatactgaaaactttacaaacctgaatgatgtgacaataattttgacaacacctcgaactttctaacataaatcatactggtgaaaaatcctagaaatgtgaaaaatatcacaaagcctttaaatggttgtcacacttgattgtaggtaagaatccatactgaagaaaactcctggaagtgtaaaaaatgtggcaacacttttaataaatgctcaccccttattgcacaggaaagcatttatacttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaatgatgtaattcaactcaaattcatgctcttcattcctattgtattcacatgtgaaagcatgtgattaatttttcatgcatcaaagatatgagaaatcatttctgttaggtcggtattatttatgacactttctatgaaagaataaggacattaaaatgtaagatgcatgatgaaaacctgagtgaagaggctgtttgtgtttaacttataatattgagtgatccatgaagtaggttttcagagcaatattcttctgcattatagtaagagaaaaccatttttaatcttagttaaaattaaagtgaattagtagtatatcattttactatttgtacttttatgtaataaaatgcaatgtgtttaaaaa

SEQ ID NO: 1154 - DNA, 13975 bp, Homo sapiens
atttttttaaacagggctaaaacgataataattagcagaataaagacatatcggattttcatttcctttcctccttttcccaaccccttcacaaccaaacagcgagaccgcggtcggcacatgctttaactcctcccggacccccgaggaccgctccatgccccccactttctgctccagcgtttttattttcacccaataaagttcgaggattattttttattttttttgtttttttaatgaaccctctcgttttacttggatgtgatcagctgtaagtaaaataaaagcaaaacaaaaaagaggcgaagatcgagtaggaactgcaggggaaatggaaagtccctgacaggctggatgaaatgagatccccatgtagcaattgccatggaaacctgtgactcccctcctatctcaaggcaggaaaatgggcagagcacatcaaagctatgtggaacgacacaacttgataatgaggtgccagagaaagttgcagggatggagcctgacagggaaaacagctccacagatgacaacctgaaaacggatgagcgcaaaagtgaagccttgctgggtttcagcgttgagaatgcagctgccactcaggttacctcagcaaaggagataccctgcaacgaatgtgccacttcttttcccagtttacagaaatacatggaacaccactgccctaatgcccgccttcctgtcctgaaggatgacaacgagagcgagatcagcgagttagaggacagtgacgtggaaaatctaacaggggagatcgtttaccagcctgatgggtcagcatatataattgaggactccaaagaaagtgggcagaatgcacagactggggcaaatagcaaactcttttctacagcgatgttcctggactccctggcatctgctggagagaagagtgatcagtctgcttctgcacctatgtcgttctacccacagatcatcaacacttttcatatcgcttcatccctcgggaaaccatttacagccgatcaggctttcccaaatacctcagcattagcaggagttggtcctgtgttgcacagtttccgtgtctatgatctccgacacaagagagagaaagactatctaaccagtgatggctcagccaaaaactcctgtgtgtccaaagatgtccctaacaatgtggacttgtccaaattcgatggttgtgttagcgatgggaaaaggaaacctgttttaatgtgtttcttgtgcaagttgtcttttggttatatcaggtcatttgtaacccatgctgtgcatgatcatcggatgaccctcaatgacgaggagcagaagctcctcagtaataaatgcgtctccgccataatacaggggattggcaaagacaaagaacctcttataagctttctggaaccaaaaaaatccacttctgtttatccccatttttctactacaaacctcataggacccgatccaaccttccgcggtttatggagcgcttttcatgttgaaaatggtgactctttgccggctggctttgccttcttaaaaggaagcgcgagcacctcgagctcagcagagcagccgctggggattacccaaatgccaaaggctgaagtgaatctgggggggctgtctagtttagtagtgaacaccccaattacctctgtctccctcagccactcatcgtctgagtctagcaagatgtcagagagcaaagaccaagagaacaactgtgaaaggccaaaagaaagcaacgttttacacccaaacggggagtgccctgtcaaaagtgaacccactgaaccgggagatgaggatgaagaagatgcgtactccaatgaacttgatgacgaggaagtattaggtgaactcaccgatagtattggtaacaaagatttccctctcttaaaccaaagcatttctcctttatcatccagtgtgctaaaatttattgaaaagggtacctcgtcctcctcggcgactgtttctgatgacacagaaaagaaaaaacagactgctgctgttagggccagtggcagtgttgctagtaactatggcatcagtggcaaggactttgcagacgcaagtgccagtaaagacagtgccacagctgctcatccaagtgaaatagcccggggagacgaagacagttcagccactcctcaccagcatggctttaccccgagtactcctggcacaccagggcctggaggagacggctcaccgggcagtggcatcgagtgtccaaagtgcgacactgtgttggggtcttcgaggtctcttggtggtcatatgactatgatgcactcgaggaactcatgcaaaaccctcaaatgtcctaaatgtaactggcactacaaatatcagcagaccctggaggcccatatgaaggagaaacaccctgagccgggtggctcttgtgtttattgtaagactggacagcctcaccccaggcttgcccggggtgagagttacacgtgtggctataaacccttccgttgtgaggtttgtaactactctaccactaccaaaggcaacctcagtattcatatgcagtcggacaagcacctgaacaatgttcagaatctccaaaatggcaatggtgagcaggtgtttggccactctgccccagcccccaacaccagcctcagtggctgcggaacaccctctccgtccaaacccaaacagaaacccacctggcggtgtgaagtttgtgattatgaaaccaatgtcgccaggaacctccgaattcatatgaccagcgaaaagcacatgcataatatgatgcttttgcagcagaacatgaagcagatccagcataatctgcacttgggcctcgccccggcggaagcagagctttatcagtactacctagcccagaacataggcctgaccggaatgaagctggaaaaccctgccgaccctcagctgatgatcaatccattccagctggatccagcgacagcagcggctttggcaccagggctcgtaaataatgagctgccgcctgaaatccggcttgccagtggtcagctaatgggtgatgacctgtccctccttactgcaggagagctgtcaccttatatcagtgacccagcgctgaagctattccagtgtgctgtttgcaacaaattcacctctgacagcctggaggccctaagtgtgcatgtgagcagtgagcgctctctccctgaagaggaatggagggcagtaattggagatatctaccagtgcaagctctgcaactacaacactcagctcaaagccaacttccagctacactgcaagactgataaacatatgcagaaatatcaactggtggctcacattaaagaagggggcaaaagcaatgagtggaggttgaagtgtattgccattggcaaccctgttcacctaaaatgtaacgcctgtgactattacaccaacagtgtggataaattacgcttgcataccaccaatcacaggcacgaggcggccctgaagctctacaagcacttgcagaagcaagagggtgcagtgaatcccgaatcctgctattactactgtgccgtgtgtgattacaccaccaaggtcaagttgaatctggtacaacatgtccgttcggtgaagcatcagcagactgagggcctacggaagctccagctccaccagcaaggcctggcaccagaggaggacaacctcagtgagatcttttttgttaaagattgcccaccaaatgagcttgaaactgcctcattgggagccaggacttgtgatgatgatcttacagagcagcagttgagatcgacctcagaagaacaaagtgaggaggcagaaggagctattaagcctacagcagtggccgaggacgatgaaaaagacacaagtgagagagacaatagtgaaggcaaaaactctaataaagactctgggataatcacaccagagaaggaactaaaagttagtgtggcagggggtacccagccactcctgctggcaaaagaagaggatgttgcaacaaaaaggtcaaaacctacagaggacaataaattctgtcatgaacagttctatcaatgtccttattgtaactacaatagtagggaccaaagtcgtatccagatgcacgtcctatcacagcactcggtgcagccggtcatctgctgtcctctctgtcaggacgtcctcagcaacaaaatgcatctccaactgcatctgacgcatttgcacagtgtgtctccagactgtgtggagaagctgcttatgacagtgcctgtccctgatgtgatgatgccaaacagtatgctactgccagcagctgcctctgagaaatcagagcgggacacacctgcagccgtgacagctgaggggtctgggaaatattcaggtgaaagtccaatggatgacaaaagcatggcaggtctcgaggattcaaaggctaatgtggaagtaaagaatgaggagcagaaaccgactaaagaacccttggaagtctcagaatggaataaaaatagcagtaaggatgtgaaaatccccgacacactgcaagatcaattaaatgaacagcaaaaaaggcaaccgctctctgtttctgaccgtcatgtctacaagtatcgctgtaaccattgtagcttggctttcaaaactatgcagaagcttcagatacattcccagtatcatgcaattcgggctgcgacaatgtgtaacctctgccagcgcagtttccgtacattccaggctttaaaaaaacacttggaagcaggccaccctgaactgagtgaagctgaacttcaacagctatatgcctccttgcccgtgaatggagaactgtgggcagagagcgaaactatgtcccaggatgaccatggcctagagcaggaaatggagagagagtatgaggtggaccacgaagggaaagcaagtcctgtaggaagtgatagtagctctattccagatgacatgggctctgaaccaaagcggaccttaccttttagaaaagggcccaattttacgatggaaaaattccttgatccatctcgtccatataaatgtacagtgtgtaaagagtcattcacccaaaagaacattctcttggtccactataattcagtttctcacttgcataagctgaaaaaagttttgcaggaagcctccagtcctgtcccacaagaaaccaacagcaacacagataacaaaccctacaagtgcagcatctgcaatgttgcatacagccaaagctcaacattggaaatccacatgaggtctgtgctccaccagacaaaggctagggctgcaaagctggagcccagtggtcatgtggctggtgggcacagcattgcagcaaatgtcaacagccctggccaggggatgttagattccatgagtttagcagctgtaaacagcaaagatacccatttagatgccaaagaattaaataaaaagcaaactcctgatttaatctctgctcaacctgcacatcacccaccacagtcaccagcacaaattcagatgcaactacagcacgaattacaacagcaagccgcattctttcagcctcagtttctaaacccagcctttttgcctcattttcctatgaccccagaagcactgctgcagtttcagcagcctcagtttctctttccattttatatacctgggacggagttcagcttggggccagatttgggcttgccaggctctgccacatttgggatgcctggcatgacaggaatggctggctccttgcttgaagacctaaagcagcagattcaaacccaacatcacgttggtcaaactcaactccagatactacagcaacaagcacaacaataccaagccacacagccccagctgcagcctcaaaaacaacagcagcagccaccacctccacagcagcagcagcaacagcaggcaagcaaattattgaaacaagagcaaagtaacatagtgagtgcagactgccaaatcatgaaggatgtgccatcttataaggaggcagaagatatttctgaaaagccagaaaaaccaaagcaggaatttataagtgaaggtgaaggactcaaagaaggcaaagacacaaagaagcaaaaatccttggaaccatccatcccaccaccccgaatagcttcaggggccagaggaaatgctgccaaagcgttattggaaaactttggttttgaactggtcattcagtataacgaaaacaggcagaaggtacagaagaagggcaaaagtggtgaaggcgaaaacactgacaaactagaatgtggaacatgtggtaaattgttttccaatgttcttattttaaagagtcaccaagaacatgtacatgggcaattttttccatatgcagcgctagaaaaatttgctcgtcaatacagggaggcctatgacaagctttatccaatttctccatcttctccagaaacgccgcccccgccacctcctcctcctcccttgcctccggctcctccacagccttcttctatgggtcctgtaaagatccccaacacggtttctactcctctgcaagctccaccacccactcctcccccaccaccaccacctcctcctcctcctcctcctccccccccacctcctccaccttctgctcctccacaggtccaactgccggtttctctggacctgccgctctttccttccattatgatgcaacctgtgcaacaccctgcgcttcctccccagcttgccctgcagctgccacagatggacgcactctctgcagacctcacccaactttgccagcagcagctcggattagatcccaacttcttaagacattctcagttcaaacgcccacggacaagaattacagatgatcagctaaaaatcctgagggcttattttgacattaataattctccaagtgaagaacagatccaggaaatggcagagaaatctggcctctcccaaaaagttatcaaacactggtttagaaatacgctttttaaggaacgacagagaaataaagattcaccatacaacttcagtaaccctcctataacggttttagaagatatcagaattgatccacagcccacctctttagaacattacaaatctgatgcatcattcagtaaaaggtcttctagaacgagatttactgactaccagcttagggttctgcaagacttttttgacacaaacgcttacccaaaagatgatgaaatagaacaactctccactgttctcaatctgcctacccgggttattgttgtatggttccagaatgctcgtcagaaagcacgaaagagttatgagaatcaagcagaaacaaaagataatgaaaaaagagaactcactaatgaacggtacattcgaacaagcaacatgcagtaccagtgtaaaaagtgcaatgtggttttccccaggatctttgacttgattacgcatcagaaaaagcagtgttacaaggatgaagatgatgatgcccaagatgaaagccaaacagaagactccatggatgccactgatcaagtggtatacaagcattgcacagtgtctggccaaacggatgcagctaaaaacgctgctgcccctgcagcaagttctggctctgggaccagcacccccctgattccatcacccaaaccagaacctgagaagacttctccaaaacctgaatatcccgcagaaaagccaaagcagagtgacccctctcccccttctcaaggcaccaaaccagccctgccattagcatcgacttcctcggacccaccacaggcatccacagcccagccacagccacagccacagccaccaaaacaaccccaacttatcggaagacctccctcggcctctcaaacaccggtcccttccagtccactgcaaatttccatgacgtctctccagaacagtctacctccacagttactacaataccaatgtgatcagtgtacagttgccttcccaactctggaactctggcaggaacaccagcacatgcacttccttgctgctcaaaaccaattccttcactctccgttcttggaaaggcccatggacatgccctacatgatatttgaccccaacaatccgctgatgactggacaactgctgggcagttccctcactcaaatgccccctcaggccagttcctcccacaccacagcccccacaacggttgctgcttccctaaaaaggaaactagacgataaagaagataataattgcagtgaaaaagaaggagggaatagcggtgaagaccaacaccgagataaacgcttgagaaccacgatcaccccggaacagctggaaatactctatgaaaaatacttgctggattccaatcctaccagaaaaatgcttgatcatattgcccgcgaagtcgggctgaaaaaaagggtcgtgcaagtctggttccagaatacacgagcgcgggagaggaaaggccagttccgggcggtgggtccagcacagtctcataaacggtgtccgttttgccgagccctgtttaaagcaaagtcggccttagaaagccacattcgctctcggcactggaatgaaggaaagcaggcaggttacagcttgccaccaagccctttaatatccaccgaagatgggggagaaagcccacagaaatacatctattttgattacccatctttgccattaactaaaattgatctatcaagtgagaatgaattggcttctacagtgtcaacacctgttagtaaaacagcagagctgtcaccgaagaatcttttaagcccttcttcttttaaagcagagtgttctgaggatgtagagaatttaaatgcccctcctgctgaggctgggtatgatcaaaataaaaccgattttgatgagacttcatcgattaatacggcaatcagtgacgccaccaccggagacgagggaaacactgaaatggaaagcaccacaggaagttccggagatgtgaaaccggctttgtctcccaaagagccaaaaactctggatactctgccaaaacctgcaaccacacctaccacggaggtctgcgatgacaaatttctcttttctctcacaagcccatccatccatttcaatgacaaagatggcgaccacgaccaaagcttttacatcacagatgacccggatgacaacgccgaccgcagcgaaacgtccagcatagcggacccgagctccccaaatccattcggatccagcaatccctttaaatccaaaagtaatgatcggccgggtcacaagcgttttcgaacgcaaatgagcaatcttcaactcaaggttctcaaggcttgctttagtgactaccgaactccaaccatgcaagaatgtgaaatgttagggaatgagattggtctgcccaaacgcgtagtccaggtgtggttccaaaatgcaagggcaaaggaaaagaaatttaaaattaacatagggaagcctttcatgatcaatcaaggcggaacggaaggcaccaaaccagagtgtaccctctgcggggtgaagtactctgcccgcttgtccatcagagatcacattttctccaaacagcacatttcaaaagtgagggagaccgttggcagtcagctcgatcgggagaaagattacttggctccgaccacggttcggcagctgatggcacagcaagaacttgatcgtataaagaaagcttcagacgtgctgggcttgacggtacagcagccaggcatgatggacagcagttctctccacggcatcagcctgccaacagcctaccccggactccccggccttcctccagtccttctccccggaatgaacggtccatcctccttgccgggatttccacaaaattcaaacactttaacacctcccggtgcaggcatgcttgggtttcctacttcagctacttcgtctcctgccctgtctctcagcagtgcccccaccaaacctttgctgcagactccaccacctccaccacctcctcctcctcctcctccttcatcctctctgtcaggacagcagaccgagcaacagaacaaagaatctgagaaaaagcaaactaagccaaacaaggtgaaaaaaatcaaagaggaggaattagaggccaccaaacccgaaaaacaccccaaaaaagaggaaaaaatctcatctgctctttcagtgttgggcaaagttgtaggtgaaacacatgtcgatcctattcagttgcaggcattacagaatgcaattgctggtgacccagcttcctttataggcggacagttcttgccatactttatccctgggtttgcttcttattttacacctcagctccctggaacagtgcaggggggatacttcccacctgtctgtggcatggagagcctctttccttatggccctacaatgccccagacactggcaggtctgtccccaggtgcactgttgcagcagtaccaacagtatcagcagaacctgcaggagtccctgcaaaagcagcaaaagcaacagcaagaacagcagcagaaaccagttcaggcaaagacatccaaagtagaaagtgaccagccgcaaaactccaacgatgcttcagaaacaaaggaagacaaaagtactgctacagaaagcacaaaagaagaaccccagttagaatccaaaagtgcagacttttcagacacttacgttgttccattcgtcaagtatgagtttatatgcagaaagtgccagatgatgtttactgatgaagacgccgcagtaaatcatcaaaagtccttctgttatttcggtcagcctttgattgacccacaagagacagtgcttcgtgtcccagtcagcaaatatcagtgtcttgcctgtgatgtggctatcagtgggaatgaagcacttagccaacacctccagtcaagcttgcacaaagagaaaacaatcaaacaagcaatgagaaatgccaaagagcatgttagattattacctcactcagtctgctcccctaatcctaacaccacatctacctcgcagtctgcagcttcttctaataacacctatcctcatctttcttgcttctccatgaagtcctggcctaatatccttttccaagcgtctgccaggagagctgcttctcccccttcttctcctccttccctttccttgccttcaacggttacctcaagtttgtgcagcacctcaggggttcaaacctcactacccacagaaagttgttcagatgagtctgacagtgagctgagccagaagctagaagacttagataattctttggaagtgaaggctaagcctgcttctggcctagatggtaatttcaatagcatccgaatggatatgttcagtgtgtaggagtgaagacaggatcccgtgcttaaaaaaataaaaaataaaaaaataaaaaaaaaataagactttaactgcagttccaaagcttctctaacccaaaaattacagtaccaaatgattgactcaggattgtttttcccatattgatatgctggcaatataggatggtatgtaatggacagaactgatgcagatggttgaatgcgcttgtactatatgctaaaatatggaaaaggaaaaaaaaatctcacaagttcttttggaacttgtttcaagccaaaaactctcaagaaagcaaattgcacctcagctggattgatttccaaatgctagcatgtactgtatgggaggatgatccagatgtttcaaagagaatttctcttagtttagttaggtgtaattcagtagctttaaattctcaggtcagaacataacatttctcatttgttaaaagcagcaagaagcctggtaaaactgtgacttttccccaaacgtcaatctttattagaaagcattttctaggtgtgtttagtgtacaaagagactttataacccttactggacaacacacagatccttgagctcacgctgcaggatagtacagttttaccgcagagggaatctggaacagtggaatcatgtgtctgccctgtgtattgcagtttgtattgccacaagctatatttataccagtgtcacccttttcttgtagaatatactaataatctgtgccaactctaccttctcacttttacctctgacgtcattctttttttctgaaagaggtaataattctagttttgatagactctgaggattatgtgaacaggacatttttcatttgtgaatttaatgctatactgtcaaggtacttgcttgtgtctgaactctagtgcacttatgattttgtagaccatgtgaaatttaataagataccttttttttcctttctttgtgtgtagtgcagcaacagtttggtctgcatttgttagaagtttaactcctaacaacccaaagacctatttaacaattggtgcataaatgaaagtagtactgtatacttgaaactgtttaagtacaagttgaacaaaaattatgaaaaggtatatttgcttctcgggaaagcaaagaagctgctttaaaaaataaaaaggggactaaaaatttgttttgtataaagaggttagccctgcgcacgtaggactgaattcagtgatatccctatacactgccatttagtggataggttattgtacttccattcatactctgggcacttgtgttgtattgttctgttacatactttttttaacctgttttgttttatcatatatgcattaaaagtattatctttatcaacatttgctgctactgtgttaacatttttgttttgcttgccatgaatttcaacttccaccacccagtgaattgatttataaattgctatgctttgctgtttttctgttgctgtggaacttaaagaatgtgaaagctgtcaaagggtattttacgaatcacttttgtgtttgatatagtaaaacaatgtgattcattccaaagtaacagaaggttatttgtaagaaagttaaaggcttgtgaacaaagaaagctaagctgttgtacatatttgtagttggctgtgcatggtacaaatttattaatatgaagaaatgcaaaatgtattgcttttgatatttctcttccgagatgaacaagtagcatgtaatgcaactgtttgacagtttaactcaagtcatgcttcaaactgttttaatgatcaaatcaagacacatttcattttacattttattattgtacagtttttgtttcggatgatgatcacagcaatctttattctatacattttatgtgaacttttttaatgtctttaatttggattttttttttttttagtattttaacatttattttaatcctgaagacacttttttgattgtgtttcgtaagagacaacatggcctcctaaggtgcaatcctgccgctatagtgagctaatgtcctgaatccaaaggcttcagaaaattgcttttgcctttttcatgaatgttaagcagcagcattgtgagatcgatctgtcctggcagttaacacgatgtgcaacagtgtgttagcatggaacagaacgcttttcacaaaacaaaggactgttttacaaatgattattccgacagtgtgtcgacataaacttttacaactgcacagcagccaaaaaaagaaaaaaaaaagaaaaaaaactttaactggatggacgttgttagggtgagaaataaaaggacagcctccaaaggttgagaatgagaattgttttttcctggatatcaaagggattatcacagcgcaatcattgtctacacaacatgtactctcaacgcctgggttacataggaaatgcaccctgaggttttaataaaagcccctatggctataactttaaataaactaaaccaaaaatgttattgatgttttatatatagagagtagtctcattagtttttgttactgtaatgtttgaagtctcaaatgcaccgtattacggtaaataacatggttttgaaaacttttttttattttgtcacagacctgttgtcatagttgaaatgatgtttattgtagatggtatttgaacttattcttctggaaatagttcatcaagtatgtttgttgctcattgtgatacattaaaaactgtatctacatatttaaaaaaaaaaaaaaaaaa

SEQ ID NO: 1155 - DNA, 9243 bp, Homo sapiens
atttcatttcttccactaaagcgtttgcggagacttcaaggtataatctatcccagatcctttcccagagagaaacttggcgatcacgttttcacatgatgctcacgctcagggcgcttcaattatccctccccacaaagataggtggcgcgtgtttcagggtctctcgtctctctcctacagaaaagaaaaagaaaaaaatgtcattagaagaggcgtaacacgtcagtccgtccccaggtttgtgtttcctggagtggccgaaagagatcagttctaacctgctctgcaggaataacggtcctgcctcccgacactcttggcgaggtttttgtacagtttgctccgggagctgtttcttcgcttccacctttttctcccccacacttcgcggcttcttcatgctttttcttctcaccatttctggccaaaactacaaacaagacttcgcagatcgagcctgcgtgctgccgaagcagggcgccgagtccatgcgaactgccatctgatccgctcttatcaatgaagcagccgatcatggcggatggcccccggtgcaagaggcgcaaacaagccaatcccaggaggaaaaacgtggtgaactatgacaatgtagtggacacaggttctgaaacagatgaggaagacaagcttcatattgctgaggatgacggtattgccaaccctctggaccaggagacgagtccagctagtgtgcccaaccatgagtcctccccacacgtgagccaagctctgttgccaagagaggaagaggaagatgaaataagggagggtggagtggaacacccctggcacaacaacgagattctacaagcctctgtagatggtccagaagaaatgaaggaagactatgacactatggggccagaagccacgatccagaccgcaattaacaatggtacagtgaagaatgcaaattgcacatcagattttgaggaatactttgccaaaagaaaactggaggaacgcgatggtcatgcagtcagcatcgaggagtaccttcagcgcagtgacacagccattatttacccagaagcccctgaggagctgtctcgccttggcacgccagaggccaatgggcaagaagaaaatgacctgccacctggaactccagatgcttttgcccaactgctgacctgcccctactgcgaccggggctacaagcgcttgacatcactgaaggagcacatcaagtaccgccacgagaagaatgaagagaacttttcctgccctctctgtagctacacgtttgcctaccgcacccagctcgagcggcatatggtgacacacaagccagggacagatcagcaccaaatgctaacccaaggagcaggtaatcgcaagttcaaatgcacagagtgtggcaaggccttcaaatataaacaccatctgaaagaacacctgcgaattcacagtggtgaaaaaccttacgagtgcccaaactgcaagaaacgtttctcccattctggttcctacagttcgcacatcagcagcaagaaatgtattggtttaatctctgtaaatggccgaatgagaaacaatatcaagacgggttcttcccctaattctgtttcttcttctcctactaattcagccattacccagttaagaaacaagttggagaatggaaaaccacttagtatgtctgaacagacaggcttacttaaaattaaaacagaaccactagacttcaatgactataaagttcttatggctacacacgggtttagtggcactagtccctttatgaatggtgggcttggagccaccagccctttaggagttcatccatctgctcagagtccaatgcagcacttaggtgtagggatggaagcccctttacttgggtttcccaccatgaatagtaatttaagtgaggtacaaaaggttctacagattgtggacaatactgtttccaggcaaaaaatggactgcaaggctgaagaaatttcaaagttgaaaggttatcacatgaaggatccatgctctcaacctgaggaacaaggagttacttctcctaatattccgcctgtcggtcttccggtagtgagtcataatggtgccactaaaagtattattgactatacgttggaaaaagtcaatgaagccaaagcttgcctccagagcttgactactgactcaaggagacagatcagtaatataaagaaagagaagctacgtactttaatagatttggtcactgatgacaaaatgattgagaaccacaacatatccactccattttcatgccagttctgtaaagaaagttttcctggccccatccctttgcatcagcatgaacgttacctttgtaagatgaatgaagagatcaaggcggtcctgcagcctcatgaaaacatagtccccaacaaagccggagtttttgttgataataaagccctcctcttgtcatctgtactttctgagaaaggaatgacaagccccatcaacccatacaaggaccacatgtctgtactcaaagcatactatgctatgaacatggagcccaactccgatgaactgctgaaaatttccattgctgtgggccttcctcaggaatttgtgaaggaatggtttgaacaacgaaaagtctaccagtactcaaattccaggtccccatccctggaaagaagctccaagccgttagctcccaacagtaaccctcccacaaaagactctttattacccaggtctcctgtaaaacctatggactccataacatcaccatctatagcagaactccacaacagtgttacgaattgtgatcctcctctcaggctaacaaaaccttcccattttaccaatattaaaccagttgaaaaattggaccactccaggagtaatactccttctcccttaaatctttcctccacatcttctaaaaactcccacagtagttcatacactccaaacagcttctcttctgaggagctccaggctgagcctttagacttgtcattaccaaaacaaatgaaagaacccaaaagtattatagccacaaagaacaaaacaaaagctagtagcatcagtttagatcataacagtgtttcttcctcatctgaaaactcagatgagcctctgaacttgacttttatcaagaaggaattttcaaattcaaataatctggacaacaaaagcactaacccagtgttcagcatgaacccatttagtgccaaacctttatacacagctcttccacctcaaagcgcatttccccctgctactttcatgccaccagtccagaccagtattcctgggctacgaccatacccaggactggatcagatgagcttcctaccacatatggcctacacctacccaactggagcagctacttttgctgatatgcagcaaaggagaaagtaccagcggaaacaaggatttcagggagaattgcttgatggagcacaagactacatgtcaggcctagatgatatgacagactccgactcctgtctgtctcgcaaaaagatcaagaagacagagagtggcatgtatgcatgtgacttatgtgacaagacattccagaaaagcagttcccttctgcgacataaatacgaacacacaggaaaaagaccacatcagtgtcagatttgtaagaaagcgtttaaacacaagcaccaccttatcgagcactcaaggcttcactcgggcgagaagccctatcagtgtgataaatgtggcaagcgcttctcacactcgggctcgtactcgcagcacatgaatcacaggtattcctactgcaagcgggaggcggaggagcgggaagcggcggagcgcgaggcgcgcgagaaagggcacttggaacccaccgagctgctgatgaaccgggcttacttgcagagcattacccctcaggggtactctgactcggaggagagggagagtatgccgagggatggcgagagcgagaaggagcacgagaaagaaggcgaggatggctacgggaagctgggcagacaggatggcgacgaggagttcgaggaggaagaggaagaaagtgaaaataaaagtatggatacggatcccgaaacgatacgagatgaagaagagactggagatcactccatggacgatagttcggaggatgggaaaatggaaaccaaatcagaccacgaggaagacaatatggaagatggcatgtaataaactactgcattttaagcttcctatttttttttccagtagtattgttacctgcttgaaaacactgctgtgttaagctgttcatgcacgtgcctgacgcttccaggaagctgtagagagggacagaaggggcggttcagccaagacagatgtagacggagttggagctgggtattgttaaaaactgcattatgcaaaaattttgtacagtgttaaggcctaaaaactgtgtggttcagagactaattcctgtgtttaatagcatttatactttaagcacaactagaaaattgtaagaattgcactctacttatgtatcactacaaactttaaaaaactatgtctaatttatattaatacattttaaaaaggtgcccgcactaccatacatcagtatttttattattattattgttattcctttttaatttaatgtgctcgcactacaatgcatcagtattatgattcctctgtactttcctttcgctattcatcaatttcccattttttttttcagcttaagtaaccacacaattttaggcctcaatttttttttttttctgtgaaggaacttgaagtgatgcatgtgtgaatttaagataccgaagtcttaaagtgacctggacgtgaaggaaaaagtaagatgagaaataaagaaagcctttgtaaggtggttttaaaagccttatatgcaaaccttttaatctgtgtttctgcaagtgccatccttgtacagtgttaagagggtaacatgggttacctttgcaccagcttcagtgttaagctcaccctgttctttgaagcacccatgtcagtattagaagaataggcagcagttccttagtttacatatgtttgtgcaattattttctgtacttttttgttcattaattttgtcagtattacaccaaactgtttttgcaacaaaaaaattttttttgcattcatttaattttaggtcaaataacattttatttatgtggctcattttatatttcctaattttatttatttcatactgtagtgtacagtattatagttcttcaatatatagatatattttagtaaaaaaggaacatgacgttgatcatttgggcaaattttacgtaaagagaagagcatttattgtgttttggaacattaattgtgagatgggatttttcaattttattattttatttttgtttttttccaattactggaaattccaaatttgggaacttttgatacgatcttgtgaaaacactgtattttcgactgaaaattccactttcttcatcttgttttttagctaaaaagagggactgttaaatacaatgtatgataccatgacaaaaatctttcctgaattgtctttgtaaaagtattattgaattttcaatttgtaatttcttttgaaaatgaccatgctcgaataaaaatgtagccaaactaagaatgtagttaatgagttctgtacttttagagagttttccttcaatgaccattaacatgtaacatgctttatgcttataataatgctaattatgtttttttcatataattttagtttagcaataattttgactggtaccaataactgttttttaaaattccatacctatgtacagcaattttacagcttttctcaactgatcctgattccagattgtgtatttttatgtgaggttatattattcaaatttagtctatttactttacagacatttctacttttgcattacgagtatttagagattatgtgttaaaaattcacttctctgtccaaggggtctttgtgatttattcaaaaaaaagtctaatttcaaaaagacagctattattcagtgttatttataatatgtaaccttttttaaaggattgggatagtttatctcactttttgaaatgcagacagtagtttaccgtttatctgaaactagaaggcgtgggtgggagaggaaaagctaaaagcaaatgctaacaaaaataaccgtgattttctaagacagtttttcagtttttacaagatgaccctaatattcagaatatgaatgtattcgtaggttttacataatgacttttatcaagaaactagattctgcttcttaaatctaattgccaagtgaagaataacagaaaaaacagattaccttatcaaatttacagctcttgaatatacagaactataatatagtagctgtccatgtattttttctactttagaatcaaagaagaaaagcatcattttgctattaaatttgctaaaattttgagtatgatatttccagttggcaagaacaacatatttatatttattccttagccataataccactttcctaaatttcacaaaagtcattctttgcaacttgaaactcaatagaaagtgtgtatgtgtgtgtgtgtatatatatatatatatacacacacacacatacacagaaaggatgtaatgaagatacagtaatagttgagcagacctttttagaaaaacatgtttttagctctatcttcaaactttctggcagagggggtggggggggcagggggaggagtggcatcaaaatgctatgcctcctgttatccacagcctagagtttttatatttggaaagtttagaaaattctatcctcgtttctccttctttgaatggcacaaataaatacactacataaatttttctggtttgaaaggctctaggcgataactttattaattcaacctgaaaatatcaagccattaaattttgtccgggtagaataaatccctgtggcctcttttaaagcaatgtaggtctctgttgcccatggggcatatctgtgtcccaatccacaagagataggaccaacaaacaatgaatgtgcaacctaactctttctccttggaaagaagaaagtgtgcacgaagtagaggagggtgggcagaccctgccttgcccctcctgttacccccttctctgtcatttgttcctaactccatttcataggcaggctcagaatacctgagtctgaaaatatcaggataacacttgtgaattgtgacaatcactacaatgtcccatatctgaggagttttttttaatgctatttatccgctggacacgattgcacattagggctgcataatcctctaactctagggaaaaataaaaacttttgatttgtcttaagattcttctccaaggtcgcaaacaagaaattcccctccacaaccaagagatgtgcattttagtaacatcagatgtgttcttctgttttatcaactacttactcttcccacacgcttagttctaaatctaacctttcccccctcgaatagggggcaggggaggatgaggaaacactggaacaactgaacacccctgcccattttctccaagagccttttgtattctagcatatctgtgcaatcttttcttttttcttcacatgacactgtaagcttaggcctgaaataactgggaagagagatgcgtatcagaatttctccgcaagagctaaacaaaacatacatcttccttagcatgaattggactgggggcggagtgggagggcttggaggaaaggggaaagaagggactatatttgaataaatatgaataaatgtattagatacttttcacaatcagataacttttaaaaaggtcattttttatctttctaataatgtaagccttaataaaagcaaatcttagtcacaaatttgaggagactgcccaataataagtttacatgtatttgaactgaaaaattgttaaccatgcttttgctccaagatgtgtgaggccattcaggggctgtagggccctggatatacacacaaacaagtgtgtgtatatctggagccccacacattgtaataaacacagctgcatttatttgactatgtgatcccatgtacatgtaaaaacattcaaacaaacacactcagcggatttatttattgtgcaatggggcaattattcaaataaacatgctcaatgcaattatttgaatctcacattgcatgttcatcaatcatagcactaaaaaaagagggggaaaaaacaccaaagaattcacatggggaaaaaatatatatatgaaaaccaccttattatagattttatagggcagctgaggttatggctcccttcttaactgtaactcaactattctgtattcaatgacatttgtttctaatgattaattggttcactcacttgatcatataatagcaaactttataaacctgtattgtgtagagatgtgaaatctctatatttcaagagcagaagagttctttctagacaccttacatcaagggacactggtccaattattatcgcttatataagcactcctataaattctgaaaaattttatacatgcaacaaaacattcctacatttgaagacattaagaaaaatcacaggtgactcatctgatcattctatatattaataaatattatgacatatatgtgaacacatcacaaatcatattggtgtaccaagaggcaatttatgcctctcttaagtatgtactgacataacctaatatactaaaatgggaaggggcttttagtcactgaaatatgcatcgtgtaacaaagatgaagaaaatacatggcttgtgcccatcataaaaaaagattcagactgaaggcttagctttggttttttcaattaaattgttaaactgtgcacagtgatttttttttagaacttgagacatttgtgatgttggctgtttaaatctttgttaccttcgctgtgaattgaaattgtacatatttagtaaatcatgcagacaaaacaaactttttagacaatatttttattggagagttttcttttcctgtatccatgttaaaaaaaaaaaagacctcctttcccaaaataaaaatgtcaatactaaatttaaagaagtataaaggaatgattgcttcctttagagcaaaatatttaaataaacatggagataattggcaacatgttctttttgggctagtaggctgtgtccaattttttgggtctgatgtttcagagggcctctgtttcagggttgaagatgatatattaatctcggaattaaacaaatgctattaaataac

SEQ ID NO: 1156 - DNA, 5455 bp, Homo sapiens
gacaaaccctcaggaagccctggccaacccccttctccagccccatctccagtccctgaacctgatgcccaagctgaagacgtagctcctccgcccaccatggctgaggaggaagaggggaccactggggagctccgctctgcagagccagctccagctgactctcgccaccctctgacctatcggaaaaccaccaactttgccctggacaagtttctcgaccctgcccggccctataagtgcactgtgtgtaaggagtccttcacccagaagaatattctgttggttcattataattctgtctcccaccttcacaagatgaagaaggctgccattgacccctctgcccctgcacggggagaggccggtgccccacccaccaccactgctgccacagacaagccctttaagtgcacagtctgcagagtctcctacaaccagagctccaccctggagatccacatgcggtcagttctgcatcagactcgctctcggggaaccaagactgattccaagattgaagggccagaacgcagccaagaagagcccaaggaaggcgagacagagggggaggtgggcactgagaagaagggccctgacaccagtggcttcatatctggattgcctttcctgtcccctcccccacctcccttggacctgcaccgattcccagcccctctcttcaccccaccagtcctgccccccttccctctggtgcccgaatcactgcttaagctccagcagcagcagctgctcctgcccttctacctccacgatctcaaggtggggcccaagctgacactagctgggcctgcacctgtgctgtccctgccagctgccacccctcctcctccaccccaacctcccaaggctgagctggctgagcgggagtgggagcggccccccatggccaaagagggtaatgaggcagggccttcctcaccccccgacccattgcccaacgaggctgcccgcactgcagccaaagcccttctagaaaactttggctttgagctggtgatccagtacaatgaagggaagcaagctgtgccccctccccctaccccacccccacctgaggccctcgggggtggggacaagctggcctgtggggcctgtgggaaactcttctccaatatgcttatcctcaagacacacgaggaacatgtccaccgccgctttctgccctttgaagccctgagccgttatgctgctcagtttcgaaagagctatgacagcctatacccgccccttgcagagcctcccaaacctcctgatgggtctctggattcacctgttccccatctgggcccacccttcctggtcccagagcctgaggcaggggggacccgtgcccctgaagagcgaagtcgagcagggggacactggcccatagaagaggaagaaagctccagagggaatcttcctcccctggtgcctgccggccgccggttctccagaaccaagttcacagagttccagacccaagccctgcagtctttctttgagactagcgcctaccccaaagacggagaggtggagcgactcgcaagtctgttgggtctggctagccgtgtggtggtggtgtggttccagaatgcccgccagaaagcacgcaaaaatgcctgtgagggtgggtccatgccaaccggaggaggcactgggggagcctccggctgcaggcgttgccacgccactttctcctgtgtttttgagttggtgcgccacctcaagaagtgctatgatgaccagacccttgaagaggaggaggaagaggcagagagaggggaagaggaggaagaggtggaagaagaagaagtagaggaggaacagggccttgaacctccagcagggcctgagggcccattaccagagcctccagatggggaggagctgagccaagcagaggcaacaaaggcaggaggcaaagagcctgaagagaaggctactccatcaccttccccagcccatacctgtgaccagtgtgccatttctttctccagccaggacctcctgaccagtcaccgccgactacatttcctgccatctctgcagcccagtgctcccccccaactcctagatctgcccttgctggtgtttggggagagaaaccccctggtggcagccacctcaccaatgccaggtccacctctcaaacggaagcatgaggacggcagcttgtctcccacaggcagtgaagcagggggaggaggggagggcgagccccccagggacaagcgcctgcgcaccaccatcttgcctgagcagctagagatcctgtaccgttggtacatgcaggattccaacccaacacgcaagatgctcgactgcatctccgaggaggtggggctcaaaaagcgagtggtacaggtctggttccagaataccagggcccgggagaggaaaggccagtttcgaagcacccctgggggggtgcctagtccagcagtgaaaccgcctgccacagccacccctgcatccttgcccaagttcaacctcttattaggcaaggtagatgatggcactgggagggaagccccaaagagggaagcacctgcttttccctaccccactgccacgcttgcttctgggccccagcctttcctaccacctgggaaagaggccaccaccccaacaccagagccacctctacctctcctacctccccctccacccagtgaggaagagggcccagaggaaccacctaaagcttctccagagagtgaggcttgcagtctctctgcaggagatctgagtgattcatctgcttccagcctagctgaaccagaatcccctggggctggagggaccagtgggggacctggaggtgggactggggttccagatggaatggggcagcggcgctacaggacccagatgagcagcctgcagctgaagatcatgaaagcctgctatgaagcttaccgcacccccaccatgcaggagtgtgaggtgctgggagaggagattgggctgcccaagagagtcatccaggtctggttccagaatgctcgtgccaaggaaaagaaggccaaactacaggggacagccgctgggagcactgggggcagcagtgagggcctcttagcagcccagcgcactgactgcccctattgtgatgtcaagtatgatttctatgtctcctgccgaggccatctcttttcccgtcagcacctggccaagctcaaggaggcggttcgagcccagctgaagagtgaaagcaagtgctacgacttggccccagcacctgaggctcccccagctctcaaggccccacctgccaccacacctgcctccatgcccctcggggctgccccaaccttgcctcgcctggcgccggtcctcttatctggcccagctctggctcagcccccgctgggcaacttagctcctttcaattcaggcccggcagcctcctcaggcctcctcggcctcgccacttcggtcctgcctaccaccacagtggtccagactgctggcccaggccgccccttacctcagagacccatgcccgaccaaaccaacacctccacagcaggcaccactgaccctgtcccaggccctcctactgagcccttgggggacaaggtctccagtgagcgaaagccagttgcaggccccaccagctcctccaatgatgccctcaagaacctcaaagcattgaagaccactgtcccagccctgttggggggccagttcctgccctttccattgccccctgctgggggaacagcaccgccagctgtctttggcccccagctacagggggcctacttccaacagctctatggcatgaagaaggggctatttcccatgaaccccatgatacctcagaccctcattgggctgctccccaatgccctcctccagccgccaccccagccccctgagcccacagccacagcacctccaaagcctcctgaactgcctgctccaggggagggggaagctggtgaggttgatgagctgctgacaggcagcactggcatctccaccgtggatgtaacccatcgctacctgtgccgccagtgcaagatggcatttgacggggaggccccggctactgcccaccagagatccttctgcttctttgggcggggctctgggggctccatgccacccccattgcgggtgcccatctgcacctaccactgcctggcatgtgaggtgctgctgagtgggcgtgaagccctagcctcccacctgcgctcctcggcccacaggcgcaaggcagccccacctcaagggggcccacccatctccatcaccaacgccgccactgctgcctcggctgctgtggcttttgccaaagaggaagcaagattacctcacacggactccaacccaaaaactacgactacctctacacttctagctttataaacagattaaccaagatggggagaggggagggcctcagggctccctcttttaccccaaggggtgtttggtgggagctcaaatccctcaccccaccccctggccccgcccacctcacaggaactgttcagttcccaccctcagtgggcaccacacaccccacttccagcagagtcctgcctcctcccaatccccacagacacacacattgatcctcctcctcagctccttgcagatgtagcccttgcccatcttcacagacacatacacccatcttggcaccctgattattcatacatgtctgcctaccacacacaaaatatatccttggttctatcttccttttcctcactgaattcccagctccccatccccataaatgcatacacatacatgcacacacacacgttatcccatgatgttccactgagaaaacaccaaaaaattttgaaaaagaagataaaaagaagaaacgaaaaagaaagcccaaggcaaagaagggggaaggaaaacaaacttcgccactctctcttctccttcctaaccctttgtctagagcaccacaccgctcacaaactctttccaaatgctcagttggctcccaaagttggagcctggcatgggcagggagcccacaaaactctaaccaaactggaggctggcatgggagaagtgcttctggttcactcttcctaccctctccctcctaaccctctccttgcctgacaggggagcccctgtggcctggactctaggggatgccgccaccagaaacccctctgccaatccctaccttgcaccctgggaactgcagtaacttattctcaaaggctttaaacacagagatcctctcagcggccgtgggcctgccccttgtcctagccctgccacgtgagggtccagcctccagggacaggcactgcccaccaacggcaaatccaaagttctttcaaaaaaaaaaactgaaacacaaccaaaaaagcaagagcgagagagagtacgtgcacacgcgcacaaaagagagaaacggacaccagaggaatgaactaaagaaaaacgtaaacttggaaaatac

SEQ ID NO: 1157 - DNA, 3483 bp, Homo sapiens
taacgggcagtagagtgtccggcttcggtgccgagtgccaccgcgagtgggccgagacgcggagggaggcgcggccggagctcgggtcgccgacgctggccaggaccgcgcttcttcccggcggcaggcggcgcggtccccgtgactctcagaagccgcccgatgtagagccgcttctttgtctcatacccctgaccattcgtgcgtggcacggagccgggtatctgcgggtacagcgatgaacagggcagacgtggccaggtgagcggcgctgctgaagcctggtttaacacgaaaggccacactaccatcacccctttctccaaccctgaaaaacagttcctgagacctgaactattgaccatcattttaatcggaccaactgcagctgtaacaagcttctctttggggtcacaatgaccactgcaggcaggggaaatttaggcctcatccccaggagcactgctttccagaagcaagaggggcgcctgactgtgaagcaggagccagcaaaccagacctgggggcagggcagcagtctccagaagaactatcctcctgtctgcgaaatcttccggctacacttcaggcaattgtgttaccacgagatgtctgggccgcaggaagcattgagccggcttcgggagctctgccgctggtggctcatgccagaggtgcacaccaaggagcagatcctggagctgctggtgcttgagcagttcctgagcatcctccctggggagctccggacctgggtgcagctgcatcaccctgagagtggtgaggaggctgtggctgtggtggaggatttccagagacacctcagtggatcagaggaggtttcagccccagcacagaaacaggaaatgcattttgaggagacaacagctctgggtacaacaaaggaatctcctcctacctcacccctcagtgggggctcagcccctggagcccacctggagcctccttatgacccagggacacaccacctccccagtggggacttcgctcaatgtacttctccagttcctacccttcctcaagtggggaactcaggagaccaagcaggggcaactgtacttcggatggtcaggccccaggatactgtggcatatgaggacctatctgtagactacactcagaagaaatggaaaagtctcacactcagtcagagagccctgcagtggaacatgatgccagaaaatcaccatagcatggcctccttggcaggtgagaacatgatgaagggttcagagttgactccaaagcaggaattttttaaaggatcagagtcatctaacaggacatcagggggactctttggggtggttcctggggcagcagagactggagatgtttgtgaagatactttcaaggagttagaaggacaaacctcagatgaagaagggagcagactagaaaatgatttcttggaaataacagatgaagataagaaaaaatccacaaaagacagatatgacaaatataaggaagttggggaacatccacctctgtcttccagtcctgttgaacatgaaggagttttaaagggacagaaatcctatcgatgtgatgaatgtggcaaagctttcaatcggagttctcaccttattggccatcagagaatccacactggagagaaaccctatgagtgtaatgagtgtgggaagaccttcaggcaaacctcccagctcattgttcatctcagaacccacacaggggaaaaaccctatgaatgcagtgagtgtggaaaggcctataggcacagctcccatctcattcaacaccagagactccataatggggagaaaccctataaatgtaatgaatgtgcaaaagcctttactcagagttcccgactcactgaccaccagagaacccatactggggagaaaccttatgaatgcaatgagtgtggagaggcattcattcgaagcaaaagtcttgctcgacatcaggtcctgcacactggtaagaaaccttacaaatgcaatgagtgtgggagagcattctgttccaatagaaatctcattgaccatcagagaatccacactggggagaagccttatgagtgtagtgaatgtggcaaagccttcagtcggagtaaatgtcttattcgacatcagagcctccatactggggaaaagccatacaaatgtagtgaatgtgggaaagccttcaatcagaactctcaactcattgagcatgagcgaattcatactggagaaaaaccttttgaatgtagcgagtgtggtaaggcatttggtctgagtaaatgtcttattcggcaccagagacttcacacgggtgaaaagccctataaatgcaatgagtgtggaaaatccttcaatcaaaactcacaccttattatacaccagagaattcacactggtgagaaaccctatgaatgtaatgagtgtgggaaggtattcagttatagctccagccttatggtacatcagagaacccatactggggaaaaaccctataaatgcaatgattgtgggaaagcttttagtgacagctcacagcttattgtacaccagagagtccacaccggagagaaaccttatgaatgtagtgaatgtgggaaagcctttagtcagcgttccacttttaatcaccaccagcgaactcacactggagagaagtcctcaggtctggcttggtcagtttcttaaggtatggttctctgagacagagagcaacgacctttgagttaagctgtctttataagcaggatgctcatagtggtttcccggagccagtagtcacggtggaccattccctacttgcttttccttggatcactaaggtgggagagtaggagtaacttattccagttcttacccattattaggaaggtaaggactacacatgtcattgaattgtaggtttcctttttttttctttacttttaaattttaacttttaaaatctatttcatttcttagttatgcatctcataatcagactccatgctttttaaagacagagataatatcttctctattctattctacttcctccatttcaccatttatacaaagtcattcaaaaaggctgattcatgccttcctgcctcttggctatggccctccccatctactctttaaactttaatctataacttttcatcagttttgttccctatctagaaaacattttcttctgtttgctaatctttgtccctcacaatttttgaaatccatctcatcactgaaatactttcttcttcaagtacttttttatttttcttcaacttctcttgatttgacctcagtgctttgaattcactggtgctacaatatgtaactgtggttaattgccttgtaaattttgcgtgtctgtatacttttataccaacttattgtaggctctttgaggtcaggtatgtatttctttcccatatagatagtattttgtacataccagttgttaaataaataatttttaaaatctcaaaaaaaaaaaaaaaaaaaa

SEQ ID NO: 1158 - DNA, 3307 bp, Homo sapiens
cgcccttcccccaccaccagcggcgagtgggtgacagagcccccgtctccgcgcgtcttcgccgccctgcgccgtgacccgctgtggcactgggccacgagtggaggctgcgcccctccagttctgccttcatagttctctgcctttgcccaaaactgcagaaaatgaacaaatcccagggatcagtttcattcacggatgtgactgtggactttacccaggaggaatgggaacaactggacccctctcagaggatcctatacatggatgtgatgctggagaattatagcaacttactttcagtggaagtgtggaaggctgatgaccagatggagagagaccacagaaacccagacgagcaggcgaggcaatttttaattcttaagaaccaaaccccaattgaggaaagaggcgatctctttggaaaagcacttaatctgaacacagactttgtttctttaagacaagtaccttataaatatgacttatatgaaaaaactttgaaatataattcagacttgcttaatagtaatagaagctatgcaggaaagcagactgatgagtgtaatgaatttggaaaagcacttctctacctgaagcaagagaaaacccacagtggagtagaatattctgaatacaataaaagtggaaaagccctcagccataaagcagccatttttaaacatcagaaaataaaaaacttggttcaacctttcatttgtacttactgtgacaaggctttctcctttaagtcactcctcattagtcataagagaatacatactggagaaaagccatatgaatgcaatgtatgtaagaaaaccttctcccataaggccaacctcatcaaacatcagagaattcacactggggagaaacctttcgagtgtccggaatgtggaaaagctttcacccaccagtcaaacctcattgtacaccagagagcacatatggagaagaagccctatgagtgcagtgaatgtggaaagacatttgcccaaaagtttgaactcaccacacaccagagaattcatacaggagagcgaccctatgagtgtaacgaatgtgcaaaaaccttctttaagaagtcaaaccttatcatacatcagaagattcacacgggggagaaacgctatgagtgcagtgaatgtggaaaatcctttatccagaactcacagctcatcatacacatgagaactcatacaggagagaaaccctatgaatgtactgagtgcggcaaaactttcagccagaggtcaactcttagattacacttgcgaatccacacaggagagaaaccatatgagtgttccgaatgtgggaaggcctttagcaggaagtcccgactcagtgtccatcagagagttcacatcggggagaaaccctgaaactccagccaggtcttactgtggaaaactcctgccagaactcttcaagcgggtgaaaaacctcatgacagtattgagggaacatgggaattcatactgagatgcaatctctcaactcaaaaatgtattaaaaataggatcccatgagaacattatactggaagttacatgtgatacccagctaaagaatacatatcagaatatatccagttgtaaatagccatacccagttgtactacaatgagctttttaaaatcttgaatgaattgagtattctagacagcagcataagaaatatacaaacagtatcctatgaatttagtggttttatgtggatatgccacaaaacacaagtggtatgctttagatctgcacatgtgaatttagcataatcactgggaatttgaaattcttgtcctctgtgataattaggacataacaagattttccatactaaacatcacatgtgtttttcagtatctctgcaatccagtatgcattccaaatgaaatgtgtaacatttaaagtagcatggaacctacgtctttccctactgcttgctggcatatatcagttggtatgaacattgttcttgagctgcctcttaggaaacagaagacagtgttgaagttttccctgcttctggtttgctgaagattttctagaagcactatttacacaaatatgcaaatgtgaaataaccgatctataacgtgaaggaggcagacatgagctgtactactcagtatgcaccacagaataagagtttgccgtgtaaagacaatatccccattcgtcatgctcttattttcccgtgggatatttgcatacaaatgcatgtctgttaccaaaatattgtgtaacacagacagaaaccacctgtttttgtctttccttgtttcccttaatatttcatgaattgtctagcaaaaatggtaggatgcttctgtagttcacaaatgttacatttcagagactttagaggaaaaattattttaaataactgtcaactgtttcattgctttttaaatttttcacgtgcataaccccctttagaagtaaatttttacactattttgttgtttaaaggaggcatttctacttccttgagttttgctgttgccaacctaaaacatttccctttggaacatgagttataagttattacttttcctttacatgtttacacttttataaaaatcagatttttcagtggtctctccagatattaacaagaattgttgtgtaactcaaagatttgcttttatagacttgatttcaaattcttaagttcagcctttccctatcaatcacaaatcatgtattggaaattataaatggcaaccaaaaactggcttttaaaaaatatttttggatatcattgatgtgctgtcacactatatattgagtgactttctgaacaaatttatccagaacatccatagcccaataagcttttgtctaagttgtcatcttacttactcacaaaggaggggaaaacgttattttcatagctgcttttagaaatgtaaattgtaacagcctccttggacaacattgtgagtctgttttaacattaatatactcttacaacctaggaatctcctgggaatctatccctaaggaataaaaagcgccagcacttaagattatatgtttactaatgtatattgtattttttggtaaggaccaaaaaaacaaacaaaaaaaagaccatcagtaagggaatggatgaataaattgtggtaaaaacataccatggctgaatggtatttccttgaaaagaatgtgtgggaacaaactccaaacttctctaggtcaaatgaggaaagcaagaggggagagagagagtgtatgtgtgtgtgtagcagtttttataaaataaagataaacccttataaaaaaaaaaaaaaaaaaaa

SEQ ID NO: 1159 - DNA, 2898 bp, Homo sapiens
gcctatagctgtgctgaatgcaaggagactttcagcgataacaatcgccttgtgcaacaccagaaaatgcacactgtcaaaaccccatatgaatgtcaggagtgcggagaacgcttcatttgcggctcaaccctgaagtgccacgagagtgttcacgccagagaaaaacaaggattttttgtgagtgggaagatcttggatcagaacccagaacagaaagagaagtgctttaagtgtaacaaatgtgagaaaacctttagctgcagcaaatacctaactcagcacgagaggattcacaccaggggagtgaagccctttgaatgtgaccagtgtgggaaagcctttggccaaagtactcggctcattcaccatcaaagaatccactctagagtgaggctgtataaatggggtgagcaagggaaagccatcagcagtgcctcccttatcaaacttcagtccttccacacaaaggagcacccttttaaatgtaacgaatgcggaaagaccttcagccacagtgcacacctctcaaaacatcagttaattcacgctggagagaatccctttaaatgtagtaagtgtgacagagtcttcacccagagaaactaccttgttcagcatgagcgaactcatgccagaaagaagccgttggtgtgtaacgaatgcgggaaaacgttccgtcagagctcatgcctttctaagcatcagagaattcactcaggtgagaagccctatgtatgtgattactgcgggaaggccttcggcctgagtgctgagcttgtccgccaccagagaattcacactggagaaaagccttatgtttgtcaggaatgcgggaaagccttcacccagagctcatgcctttctattcaccggagagttcacactggggagaagccctacagatgtggtgaatgtgggaaagcctttgcccagaaagcaaatctaacacagcaccagagaattcacacaggggagaagccttactcctgtaatgtgtgtggcaaagcttttgtcctcagtgcccatctcaaccagcacctgagagttcacacccaggagacactttatcagtgtcaacgttgccagaaagcctttcggtgccactcgagcctcagccgccatcagcgtgtacacaacaagcagcaatactgcctgtagccattgggtggcagcagagtcccagaatatgagaccgttactcggatgttgaaagttggaaactatcccattgcaagtttctctccaaataaatgcatctaaagattgattagaaagtttgtgcgcatgtttttcattataacaatgaaaacacaaaagtggagaagctgtacaacgtcaggattcagaggtaggctctggagccagtctaccttgagttaaatcccacctctgccatctactacctaagtgaccttgggaaggtcagaaaaatctctcagggcctcggtgtccttatctgtaaaatgggcatcacctacctcagagggcttttctgaggattaaataaataaatgtgaagcacttagaactgatggccagcacatgagggctcaccaagtgtaagccacaaatacacatcagctatagcacaaatatacttgtgttacaagaaaggaattagtaatctgtgtttactgtagttaatgttcttacaatgtatcgcttttaatttaagttttccttttttacagtttttctccagcactttactcttcttaagtgcctggcctttttttgtccctttatctctcctggtttttttcttaagccccagaaagccaaaaagaacatgtaaactcttcacctcaactagctacaaccttccactcctaacctcccaagcttctcacttaaagaggactccctatcccacaaacacatgctccctcttcctatgaccttcctccatttaacagtgttggttatgcaataagacacccaatttttcatgggagttgacaccaaaacacagctggattccatcaggaaagctgcattgatcagggtgttaaccgcatatgaaacaacccatatggaagacatacttaggggtcaaacctgtggtgtgtggaagtgaccactgggatgtcatcattcaccatttatccaggatggccgctcaccaggcaatttgctaggctcgggggcgggtagtatccatacactatgcactactgctctgaagcttctggaatcagaaatgaacccattttcatcgacgattgctgttagttgacaagtgacatcttgaaaatgccacattccctcatgtcacaggaagttctgggatcaccaaggattgttggagagtccagtgagatggaaccacacaaccagttccctaccagtgtcttgtcagctctgggtgtttgttccctgccactaagtggctcagtcacacctttgctgaaacacagtagtcttatgaaaagcactggacacatactttgaatacctttcatattttaggtgctgaaaatggtgagggagtgagtgctctgcacccttgggcttttcaactcttgcacctggagttctgctggttaagtttgttaaacttagttgaaactgggaacctgttggctaaccattggggccttacactgtttttcaaatggttgcaacatttaacttctcgcacatggttcccgtcctctggagctctgtcttgtcggggagatgggcatgttgtataccaaaagagtgtacaaagtgttgcagggctgtgacacaatagggactctatggaaaactggcagccattgggtgtgggggcagtctgtaaatcagtcacctgtgttgctgcaggccaaggtagaaacgccctccgtgtgtgcatatttgttggttctctgattaaagttttgagtctaaaaaaaaaaaaaaaaaaaaaaa

SEQ ID NO: 1160 - DNA, 3007 bp, Homo sapiens
cacacgcacacacacacacacaaacacacgcgcacgcaaacagcagtgaggaagagaaaagcagagataagcaaggctccgcagcagcctcctttctaacttgaccctcgccagaccctggccagcatggttgtcctgaatccaatgactttgggaatttatcttcagcttttcttcctctctatcgtgtctcagccgactttcatcaacagcgttcttccaatctcagcagcccttcccagcctggatcagaagaagcgtggtggccacaaagcatgctgcctgctgacgcctcctccaccaccactgttcccaccaccattcttcagaggtggccgaagtccgcttctctccccagacatgaagaatctcatgctggaactggagacctcgcagtccccgtgcatgcaaggctcgctaggctcccctgggcctcccggcccccagggtccaccggggcttcctggcaagacaggaccaaagggagaaaagggggagcttggccgaccaggaaggaagggtagacctggccccccaggtgttcctggcatgcctgggcccatcggttggccaggccctgaaggacccaggggtgaaaaaggtgacctgggtatgatgggcttgccagggtcaagaggaccaatgggctccaagggctaccctggatccagaggggaaaagggatccagaggtgaaaagggtgacctgggtcccaaaggagaaaagggtttcccaggatttcctggaatgttggggcagaaaggtgaaatgggtccaaaaggtgaacctgggatagcaggacaccgaggacccacaggaagaccaggaaaacgaggcaagcagggacagaaaggggatagtggagttatgggcccaccaggcaagcctgggccttctggtcaacctggccgtccggggcccccaggccccccacctgcaggacaacttataatgggacccaaaggggaaagaggatttcccgggcctccaggaagatgtctttgtggacccactatgaatgtgaataacccttcctacggggaatctgtgtatgggcccagttccccgcgagttcctgtgatttttgtggtcaacaaccaggaggagcttgagaggctgaacacccaaaacgccattgccttccgcagagaccagagatctctgtacttcaaggacagccttggctggctccccatccagctgacccctttctaccctgtggattacactgcagaccagcacggcacctgtggggatgggctcctgcagcctggggaggagtgtgacgacggtaacagcgatgtgggtgacgactgcatccgctgtcaccgtgcctactgtggagatggtcaccggcatgagggtgtggaggactgtgacggctctgactttggctacctgacatgcgagacctatctccctgggtcatatggagacctgcaatgcacccagtactgctacatcgactccacgccctgccgctacttcacctgagggccgtgaggagaaggtgggctgcgccccacagaactggcagcagcttctccactgtcatcaaactggccatgtcctggccccgtctccaccaacctttgtgtgacaaaaacaaggacaaattcctgctactaagacatgctgttaactcagtctgactggaagaatttaggaccactgcatcctgtcttaatccaaggtactggaaaaccttccacatgcccaacctgagacctgttccccatcgctaccatttggccaaacaaccggctacaatgctcttcctcttctggaatgttgctgacccaggccgtggacttggctgagcactgttagacacacacagacctgcaggctgttttagaatgttttgatctctttggggaatctggagtacaggcctctccgcccctgaccaccgaaacgtgcaggcattctcactcacactgggcagcccgctgtcgggtctctctaggcctatgaaccacaaagcagggaagtgggcacgttctctcggggtggctcacagctttgaacctgccaaaggacccctcgactggccacagcccagcccagcctgacgtggatgtggctgcccaggaaaagacttaactgtgaaaaagtactgagaacccacctgacccaggcttgccccaagcagaggctagagaagaggctcctcttctcagtgtttcccaaaggggcggctcttgtggtttcaaaatctctggcaccatcttgacctcttggctctctctgcactttgccccctgtctcaaaaatgtccctcatgtccatttcctgtccaggagactcatgaggactgtgtgacctgcacaagcccacacctgggcaggctgttggtgtctccttggtccttaggcagatactcccctgagtccccgatctagggccagctgcagagggctctctctaggcagagcgttcctggccagagctctacctctttgcctcctgctgacccctgacagcgtcccgtggcatttctttcatgtctgcatattgcatagccttgtcctcctgtgtgcctgagctcctcccttttcaataagattattagtcgtgcatgtctgtgagctgcctttcatcaccatttttcctgagtagggcttagttttattctggaaagacatctccaaggtgaggtccacccccacagcagacctcaagtagaaattgcccaatttttaccagctggagggacacccttgggtttttgtacgaagctatttaatgagcctgtgtcttggggactcagcaggctggagcttggggcctggtggaccatcacctggtgtctgtaggtggacccggtctcccacaggtgacatcaacctgagggtggcgtctttagagacaggcacatgggcagccctgttcccttcgcctctactgcgaggcctggggagatgttgttttcatgctgcttccaccatcacactggggtttctggatgggaaataaaaaaataaaggcagttcatttccccaaa

SEQ ID NO: 1161 - DNA, 10487 bp, Homo sapiens
acgcgggggagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaacttattaaaagtgatgaaaggagcattgaaattaattagcactaatttttcactgtgccaaagtgtgcagtgtccttcagaggaaacaataacagatctggtgagtgtgccatgccagtggggagaattgaatgtccctcatctccctctttccctagggacattagtcatgagtgccgagtgtgcggggtcacagaagtgggtctttctgcatatgcaaagcacatttctggccagttgcacaaagataacgttgatgcccaggaaagagaagatgatggaaaaggagaggaagaggaagaagattattttgacaaggaactcattcagttaataaaacaaaggaaagaacaaagtcgacaagatgaaccttccaatagcaaccaagaaataaactctgatgacagacgaccccaatggagacgagaagaccgaattccttaccaagacagagagagttacagtcagcctgcatggcatcatcgtggacctccacagcgggattggaaatgggaaaaagatggctttaataatactaggaaaaacagctttccacattctttgaggaatggtggtggaccaagaggacgttccgggtggcataagggtgttgcaggaggctcctcgacttggtttcacaaccatagtaattctggaggtggttggctttcaaatagtggagcagtagattggaatcataatggtacaggaaggaattccagttggctttctgaaggaacaggtggcttttccagttggcatatgaacaacagtaacggaaactggaaatccagtgtacgtagtacaaataattggaattacagtggccctggagacaaatttcaaccaggcagaaacagaaattctaactgtcaaatggaagacatgactatgctatggaacaagaaatctaataagtcaaacaaatacagtcacgacagatataattggcagcggcaagaaaatgacaaacttggtacagttgccacatatagaggtccttctgaaggatttacaagtgataaatttccttcagaaggcttactcgacttcaattttgagcagctggaaagccaaaccactaaacaagcagacactgctacttccaaagttagtggaaagaatggcagtgcggcaagggaaaagcctcgtcgctggacgccttacccttctcagaagactctggatttacagtcgggattgaaagacatcactggtaacaagtcagaaatgatagagaaacctctctttgattttagcttgataactacaggaatacaggagccccaaactgatgaaacacgtaattccccaacacagaaaacacaaaaagaaatacatactggatctcttaatcacaaggcctcttctgattccgctgcttccttcgaggtggtgagacagtgccccactgcagaaaaacctgaacaagagcatacaccaaataaaatgccatcattgaaatccccactccttccatgtccagccactaaatcattgtctcaaaagcaagatccaaagaatatctcaaaaaacaccaaaacaaattttttttcccctggagaacactcaaatccctcgaacaagcccactgtggaagataaccatggtccttacatatccaaactgcgtagttcatgtcctcatgttttaaaagggaataaaagtacatttggctctcaaaagcaatctggtgataatttaaatgatactttacgaaaggccaaagaggtgctacagtgtcatgagtcattgcaaaatccacttcttagcacttctaaaagtaccaggaactatgcaaaagcaagtagaaatgtagaagaatctgaaaaagggtctttgaaaattgagtttcaagtgcacgcactagaagatgaaagtgatggagagacatctgacacggaaaagcatggaacaaaaattggaaccctaggttctgcaactacagaattgttatctggcagcactcgaactgctgatgagaaagaggaggatgaccgcatcctgaagacttctagagagctatccacttccccatgtaatcccatagttcgccagaaagaatctgaattacaaatgacatctgcagccagtccacaccctggcttattgctagacttgaaaacctctctagaagatgcacaggttgatgactctattaaatctcatgtatcttatgaaacagaaggctttgagagtgctagcttggatgcagagcttcaaaaaagtgacatcagtcagccctcgggccctctcctgcctgaactaagtaagcttggctttcctgcctcacttcagagggatctaacccggcacattagtttgaagagcaaaactggagtacaccttcctgagccaaacctcaatagtgcccgccgcattcgcaatattagcggtcaccgaaagagtgagacagagaaggagtctgggctcaagccaaccctacggcagattctaaatgcatctcggagaaatgtcaactgggaacaggtcattcagcaagtaaccaagaaaaagcaagagctgggcaaaggcttacccaggtttggcatagaaatggtaccccttgttcaaaatgaacaagaagccttagatttggatggggaacctgatctgtccagtctagaaggattccagtgggaaggtgtttccatttcctcgtcccctggcttggcaagaaagcgaagcctttctgagagcagcgtgatcatggacagagctccttctgtgtatagcttcttcagtgaggaaggtacaggcaaagaaaatgagccccagcagatggtttcacctagtaactcattgagggctggacagagccagaaagcaaccatgcacctcaaacaagaagtgacacctcgggctgcctccctccgaacaggtgaaagggctgaaaatgttgctacccaaaggcgacatagtgcacaattatcctctgaccatataatacctttgatgcatttggcaaaagacttgaacagccaggagaggtctataccaccgtcagagaatcagaattcccaggagagtaatggagagggaaactgtctgtcatcaagcgcatcctcagcccttgcgatctccagtttagcggatgcagccacagatagtagctgtacctctggtgctgaacaaaatgatggccaaagtattagaaagaaacgaagagccactggagatggatcttctcctgaactcccaagtcttgagagaaaaaataaaagaaggaaaattaaaggaaaaaaagaacgttctcaggttgaccagctgctgaatatttctttaagggaggaagaacttagtaagtcattgcagtgcatggataacaatcttctgcaagcccgtgcagcccttcagacagcttatgtggaagttcagaggctacttatgctcaagcagcagataactatggagatgagtgcactgaggacccatagaatacagattctacagggattacaagaaacatatgaaccttctgagcacccagaccaggttccctgtagcctcacacgagaacgaaggaacagtagatctcaaacatccattgatgccgcactgctgcccactccctttttcccactttttctggagcctccatcttcccatgtgtctccatcacccaccggagcctctcttcaaataaccacgtctcctactttccaaacccatggcagtgtccctgctccagactcatcagttcagattaaacaagagcccatgtctcctgaacaagatgagaatgtgaatgctgtgccaccaagctctgcctgcaatgtgtccaaggaattactggaagctaatagagagatcagtgacagttgtccagtttatccagtcatcactgctagattgtccttaccagagtcaacagaaagtttccatgagcctagccaagaactgaagttttctgtggagcaaagaaataccagaaacagagaaaactctccctcttcccaatcagctggtctttctagcataaataaagaaggggaagagccaaccaaaggcaatagtgggtctgaagcctgtaccagttcttttctaagattgtcttttgcttcagaaacccctttggagaaggaaccccactctccagctgaccagcctgaacaacaggcagaatccactttgacatcagctgagactaggggaagcaagaaaaagaagaaactccggaagaagaaaagtctacgggctgcccatgttcctgagaatagtgacactgaacaggatgttttgactgttaaacctgtaaggaaagtaaaagctggaaagttaattaaaggggggaaagtaacaacctccacttgggaagacagcaggactggtcgggagcaggagagtgtcagagatgagccagatagtgactcgtctctggaagtcctagaaattcctaatcctcagttagaagtagtagccattgattcttcagaatcaggagaagagaaaccagacagcccatctaaaaaggatatttggaactctacagagcaaaacccactagaaacgtctcgttctgggtgtgatgaagttagctctaccagtgaaattggcactcgctataaagatggcatccctgtaagtgtggcagaaactcagactgtgatctcctccataaaaggatcaaagaattcttcagaaatatcttcagagccaggagatgatgatgaacccacagaaggaagctttgagggacaccaagctgccgtaaatgcaattcagatatttgggaacttgctatatacctgttcagcagataaaactgttcgggtttataatctggtgagtcggaaatgtattggtgtctttgagggtcatacctccaaagttaactgcctcctggttactcagacctccgggaagaatgctgccctttacaccgggtccagtgaccataccatccgctgctataatgttaagagccgagagtgtgtggagcagttacagctggaagaccgggtcctctgcctccacagtagatggcgaatcctctatgcgggactggcaaatggcactgtggtcaccttcaacataaagaacaacaaacgacttgagatctttgaatgccatggccctcgggcagtcagctgtcttgctacagctcaggaaggtgcccgaaaactgctggtcgtggggtcttatgactgcacaattagtgtacgcgatgcccggaatggactgctcctcagaactctggagggccatagcaaaaccattctttgcatgaaggtggtgaatgatctcgtgttcagtggctccagtgatcagtcagtccatgctcacaacattcacactggtgagctcgtgcggatctataaaggtcacaatcatgcagtgactgtggtgaatatcctaggaaaagtgatggtgactgcttgcctggataaatttgttcgtgtctatgaattacagtctcatgatcgattacaagtttatggaggacacaaagacatgattatgtgtatgaccatccataaaagcatgatttacactggctgttatgatggcagtattcaggccgtgaggcttaatctgatgcagaattaccgctgttggtggcatggttgctctctgatatttggcgttgtagatcatttaaaacaacacttgctgaccgaccacactaatcccaacttccagactctgaaatgtcgctggaagaactgcgatgcttttttcactgctaggaaaggatccaaacaggatgctgcaggacatattgaacgacatgctgaagatgacagcaaaattgattcatgaagttttttgcctcccacgttgggaagtcattagttgaactattttcacattggccccccacacaggccactctcttccctttcttggtgaagtaaggaaggagaaagtggttactagccaggcatacccctagcataagtctgggcagctctatgggatgataaattacacttttaagttcttgctggaggttttaaatagatttagacaaatgttaaggaaccatacttctctgggacagcatggcatatagtgatatatgctatttgcgttctccagatgtttattgaagatacagatcctaattggttacccagtttgaccctaatcatatgtatattttattgatttcagtttgcaatttttaatttatgttcttatgatggtttaaacctatagtcaggcttttaagtacaagtttgtttaagtgccagactttgaggatcagttttaatttctccatttgtaatagctgggtatttaaactggaagcaaatagttttctttcttaacaattatgtgcagtgtgtgtcactgttttcttgctttatagatagagctggctttaagtgctaaaggacacagtagatttttgacaaacagtggctgctctgctgactatcttttaggaattcaggaagcaaatcacatagtgacaagtccttacagacaccacttctagtaaatctctgtaaatgtggatagaaagctcagtgtgaggcagtgcgtagacctaacgtctacctttacatctgctgttgaacctgggcactacctgttacagatcctgtcaggctgttgaactggaggtgtacctttatcttcctttctagtgtctgaccctgcaagcctaatgttggtttgaacccttttggtttgttcagttgccagcctccatctctcccactgtatggccgtgcctagaccgatggcagccatcgaatattcctctgggctcacggggtgttttccacccccctgcagcaactaagatggtgggggagagggggttagaataaagcatctgaatacagttttcaggacctcaagcagacttcctagagacttgtttctgagacagttctttgccttcacttccctgctagctgggaaagaagagtggagcagagactctgcctggccactgagaacagccaaattcacaaaccctcagtggggctttgtttttggattttctccggactcatcagtaaacctgtagaagtgtcgctttccagccttttgtttctggatcctcaaaactcagaacgtggccgggcgtggtggctcacgcctgtaatcccagcactttgggaggctgaggcaggcagatcacctgaggctaggagttgcagaccagcctggccaacatggcaaaaccccgtctctactaaaaatacaaaaagccgggcgtggtgggcgcctgtaatcccagctgctcaggaggctgaggcaggagaatcgcttgaacccgggaggcagagattgcagtaagctgagatcgtgccactgcactccagcctggtgacagagtgagactccgtctcaaaaaaaaaaaaaaaaactcagcttcttcagagagataaaattgggggaggagcccagggccacataccaagctttgggacatggtgcctcatgctctctgggattgcagaccatccaggtctgtcttcgcccctgttagtgcacatatatccactcacatgtcttccctcaggctatcgggcagggggacttcaccagggggtttatggataggcttcaagagggtctgtgagcccccagaaattgtgtgtgagactgagtatgtgttcttttttccaggaaaggctccagtggttcttacttgatccaaaaaatgtcaagaattaatctaggaggccgggcctggtggctcacacctgtaatcccagctctttgggaggccgaggcgggtggatcactcaaggtcaggcatttgagaccagcctggccaacatagtgaaaccccgtctctattaaaaatacaaaaattagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaaatggcagttcgttgtgataaagtatcagtcacttcaagttttctgtgaaagtttttaattaggttaaaaataattttggcatacgtctctactcagtttataaagcagttccacaccatgcaaacaaaactctaacagcaaaggttatcttgacctgatgttacttgaatctgagagaaagtcattacttactactgcactcctgcttttgtgggaaaaattttcttcttccccagaagagttaacagttgagtgttcagctcctgacttacctttaatttagaggcaatattattactgtttaagtgattatttgcttaacacaggttttattttgtctttttgctggtagattatacaagggacaactttagtgatgaggcatgtggatgatttggtgggagtaggtatatacttagtggaatggtttattttatggaagagaattcattggaggtgagattgaagtatattgtgaagtgggatttgaacagcacatatgctctggtttgctcaaataactgcagtttatgcttacatctaaattttgtttctgttacctaaacgggagcttctagaattacgaaggccatacctgccacatttataaaataatggttttatccctgcccccaaatcatcaggttcctcgggtttaagagaagtggtctaatagacaggaatagaagttgtggtggaggtgatttgggatagactaggtttccttatgcaagtggatatgagctcctcatagaaaccagacctactgtattagacagtaacctctaacctcacctccaagcccaagtatatggccctgctgggttacctggtgactacatttcccagattcactctaaattcaaggtagtgacccaaataaattgggaaaggagggggtcaaggaggaaaagctgttgaaaatctttctcctatttaagagaaatatatgccctagagctgctccagcacccttggtttctgatttttttaatattgaatatggattagaagaatgaaatcagatgacacctgactgcaaaaatgtttataagcaaatagccttcttacattttggtataaagctgtgaacttcgtaactttgtaaagcaagatataaagcaaatacaagaggaaaataaagtacttttactaattgaaaaaaaaaaaaaaaaaaaa

SEQ ID NO: 1162 - DNA, 3510 bp, Homo sapiens
gtgttcacggccggctagacattctgtgctcgtgcaggaggagggctgctaccatcagggacgtgcacgatttcccccaccccgccccctccccaaactccaaaaaaaaatccaaaacacactgccacccaccgtgcccccgcgccccgagcccctccggtcccggcctgcgtttgctagcgagcgcggggaacccacggcagtgtctgtgcctgtgccaggctgcaggtctggcgtgctcctgatcagagttactctgatctgaagattttggcgttcaaggcattaagataatagcctgagttgttcatggagtttttcatcagtatgtctgaaaccattaaatataatgacgatgatcataaaactctgtttctgaaaacactaaatgaacaacgcctggaaggagaattttgtgatattgctattgtggttgaggatgtgaaattcagagcacacagatgtgttcttgctgcctgcagcacttactttaaaaagcttttcaagaagcttgaggttgatagttcttcggtcatagaaatagattttcttcgttctgatatatttgaagaggtcctgaactacatgtacacagcaaagatttccgtgaaaaaagaagatgttaacttaatgatgtcatcgggtcagattcttggtatccgatttttggataaactgtgttctcagaagcgtgatgtgtccagtcccgatgaaaacaatggtcagtccaaaagtaagtattgccttaaaataaatcgccccattggagatgctgctgacacccaggatgatgatgtagaggaaatcggggatcaggatgacagtccttctgatgacacagtagaaggcacacccccgagtcaggaggacggcaagtcgcccaccacaacgctcagggttcaggaagcgatcctgaaagagctggggagtgaggaagttcggaaggtcaattgctacggccaggaagtagaatccatggagaccccagaatcaaaagacttggggtcccagacccctcaagccttaacatttaatgatgggatgagtgaagtgaaagatgaacagacaccaggctggacaacagccgccagtgacatgaagtttgagtatttgctttatggtcaccatcgggagcagattgcctgccaggcgtgtgggaagacgttttctgatgaaggcagattgaggaagcatgagaaactccacacggcggacaggccatttgtttgtgaaatgtgcacaaaaggtttcaccacacaggcccacctgaaagaacacctaaaaatccacacaggatataagccctatagctgtgaggtgtgtggaaaatcatttatccgtgccccagacttaaagaagcatgagagagttcacagtaatgaaagaccgtttgcgtgccacatgtgtgacaaagccttcaaacacaagtctcacctcaaggatcatgaaagaagacacagaggggaaaagccttttgtgtgtggctcctgcaccaaggcatttgccaaggcatctgatctgaaaaggcacgagaacaatatgcacagtgaaaggaagcaggttacccccagtgccatccagagcgagacagaacagttgcaggcggcagcgatggctgcggaagcagaacagcagctggagacgatagcctgtagctagaggcggtgggacagggacactttgcctggaaagtggagactgagatgacgtggatcataatgagtgaatgccagttacaatatttttgtggaaacgtatggaacattgtactcactggacttaaggcagtgcttggttagctatttttaagacttttcaaggaaatggtgttcctcagttctgaccaaaccgtttcactgtcttgtctggtgtctagtattaatgttgcccagtaagcacctctctcccttttttttttttattattttaatttgagaactcctgtgtccagtttagaagtgagagacttccatttttagttcctttacactcaccaccctagcaagtgccctgcacagagtaataagtaaattgatttcctaatcacaattctatgtgacttatggtcaaaagagcagttttaataactttaaaagtacttcagatagacgcagaaaattggtgagtggttgaccaagaacactgcacaaatataaaaaaagttctggaaatgcagaatggcgttagatttatatttggtttgttaattttatatcactgtttttcactgtttttgtggacaaataatggttgctttgctgaagtgttcttcctcaatcttgattgccctgtacctacccaaaagctgtagtcacacatcctaaaggccaagcaaacccaccgggatggtggggggtcttggagccaagctcttaggttcctcttatttggggcagtaccagtccataccagctgcgatttgtgagtggacctgtggtaagaagaatagaaaaggctctcagagataaggttttttacatgtgtaacaatcccaagatttcctagattaaaatcttaattgattttgaaattggatttttatttagaatcaaaattaggacaagaacagataacttcttcagatacatttgtgtaactttacagaatgtcatcaagctttggggctctgtggggcacatgatttatccataaaggagatgcagtatgcttacttaaattaataaatttaaaatcttttaagtgtgtaaatagtagtgttggtcttacgtatttcaagtaaaaagtagacagctgcactttttttgcacattggattaaaataacttccatcagcaacaaacatcagactgtttttaacaaatattaaagattgtcagaccaaatgtttatgttttcgaaatatatttcatcactggttacagttttaaatagaagttgattgccttttcatagccgtaaatgagaattataaactctattccagttttggtatactaaatgttcttttaaccatctttaggaatatattgaaatgccaacaatagtttgaattgtgttctgtaaaaaagtattagtcaattatttttcaaaatgtagaattgtagaaaatgtcaatttttcaaactcatttttcattgctaggatttcttttaaaaaaattaaagtaatttcacttcatagcttgttgcattaacacctgtaattctattgtgaaagaaatttgattttttaattggtgtgtgttatgcccaagatgttaggatgaagatgctacctttttaaaaattttagttattggtaaaatgtttaattttacttaaaattaatttcttttcttgaaagttgtttattctgttctaaaagtagtcctgtcactgtgtttttatgctacttatagaaggggaactgattgccgttcctaggctgttttaaccaaagcaaaggaaaaataattttaacatcttgtcaatagctacttcaacaaaccatattttgggacttcattttttgtatataaaagaaaatatacttctatcaaaaaaaaaaaaa

SEQ ID NO: 1163 - DNA, 4084 bp, Homo sapiens
gaggtgcgaccgggtcccggcctgagtcgcggccacccgcaggtctgagctgtgggctgaggcagcgcagccgctgccgcagggtgcgcgatgccttgaacctgggaaactatgtgaagcaacactctggattttgaaagacatcttttcatcatgggacagcaaatttcggatcagacacagttggttattaacaagttaccagaaaaagtagcaaaacatgttacgttggttcgagagagtggctccttaacttatgaagaatttcttgggagagtagctgagcttaatgatgtaacggctaaagtggcttctggccaggaaaaacatcttctctttgaggtacaacctgggtctgattcctctgctttttggaaagtggttgtacgggtggtctgtaccaagattaacaaaagcagtggcattgtggaggcatcacggatcatgaatttataccagtttattcaactttataaagatatcacaagtcaagcagcaggagtattggcacagagctccacctctgaagaacctgatgaaaactcatcctctgtaacatcttgtcaggctagtctttggatgggaagggtgaagcagctgaccgatgaggaggagtgttgtatctgtatggatgggcgggctgacctcatcctgccttgtgctcacagcttttgtcagaagtgtattgataaatggagtgatcgacacaggaattgccctatttgtcgcctacagatgactggagcaaatgaatcttgggtggtatcagatgcacccactgaagatgatatggctaactatattcttaacatggctgatgaggcaggccagccccacaggccatgaccttgaagtgaaagtcttctgttgctattgtgggctcaaatatttggtcatgggggaagaatgtagggttgtggcactggcacagacacaggaaaatccattttccccactcttttatttttgctattctgatcatttgtcccccttttaaaaataaacttcccatgtcttccatttgtggtactaaaatttgctactgttttagaccatattttcctattatttatctgttcaaatttgtattattacaactaatagctcttgaattctttgctaaaggtaacagcaacacttccagaggcttctaaaacactactgttttgcagggcaggagtattctggaatctttttacttagatataaaataaacctcgaatattaaaaagttgtagccatctgagagaggaaagtttaagtgactgaaaatgtagaatacttcaacgtgcatgttactacttaaaactagtctttctgctggaatctaaggagtatatatatatatgcccccttgtggttaattattgctcctttaataatttttacttgaaatgatccacaattatttcataactttagcagtgtgttttggaactactgtacttaaaggtttgtttgtttgtttttgccatactgtataatttgggtgaggtctacaaaattgggtgtgactttcctttgcaaatggatttctcctggggaattttcttggctgttctggaaatgctttcccacagctgggtaactgttctaaatggctttgataatgctcacacatcttggagtttcagaaggaaattattctgcatcacaaatactaaattttatatttctaaattactataggtcatttaatattggtttatggtgcttttatttccttaacttgaaaacatctttctgagatttcagagtcctcaaatttcttagattaagagacaagaggccagtgcagtggttcacacctgtaatcccagcactttgggaggccgaggtgggtggatcatttgaggttaggagtttgagaccagcctggccaacatggcgaaatcctctctctactaaaatacaaaaattagctgggcatggtggcaggtgcctgtaatctcagctactcgggaggctgaggcagaattgcttgaacccaggaggtggaggttgcagtgagccgagatcacaccactgcactccagcctgggagacagaacgagactcctaatcaaaaaaaaaacacaagaaaatagagtgaggcttttttaccgtatatacataaaatacttatgaaaattagaagataatttggcattcctactgtttcactgtacttccattgaaatactctttccattaaaatattctgaaacaatatagtaataatggaattgtgatcttcagttgcacctcaaccattttttttgcttatgaactaaaatttctaacattaacatttcggcatgtaataaaacaagggcctatctcctttaaaatttaacattccatgtaacttttctgacttatcattcataagttgcaaatattactattttcctaaaccagggtacacaatttaagttgccacttattgatgacagaatttctggatagtaggattttaataggcgagcaaataaaattcaaatcaatttcaaggaaaaacatctggccaggggtagcttgatttcgcccccaaaaatactgaagactaatccattgacattcataatgggacagctaagtaccaaatagctaactactccctatggaggtttatgcaagcagagtaccaggggttccatcatatcaacctggcaatgcacttggtggttgtgtgaccttgagaaagtctcttactcttgtttatgtgttcttactttagaaactgagactttatttgtggttttcacactatttcagcagcaaaaactttttcaaggaaaatcttacagaacctttaaacacgtgtgcatacacacataccctataccccactatataaaagtcatattattataaatttccttattatataaactttatatactataaatgtgattaagtcaatgaataaaaacattaatgcattggtgatatccagcatgtttgaatttggtgagtaacacacatatagtgggagtcgttttttttaaaaaaattttttaattaaattcaagtcaaatttgcagaaccctgtatctcctccatagattcttagtattccatggaacatattttgaaaaccttgggatagatgatccactgaaatcttttccagctctaagattttaaattgtccttttagattagacttgctgagtttaattcagattacctaattttaaaatgtttctgaaaagtgaacagagttaccttacagagttttggatctttccagggatagccaatgattttatcccccagaatccttcacctttcaaggagttatttaacaatgagcccagtgactcaatagggcccaaacctttttattttacaatatgagctccaagacacttactgatctactgtgaatataaaatgttattagccttatcaaataaataaatgagcacagctctttgttcgctctattgaactgggtgataattatttagatgtgaatgttaggtcagttctactgtaataactaatcgtaaaagttgtaaatttgtttaatggatgaaatgtacactttttgtattctgtacagctttgtcttttttaaatatgaagtacttaaatgtacttactatgataggaaatataatgtgtgccttctaggatttgtgaagtggtttcatgaactctaaggaatttgttttccctatcctaactcagtaacagagggtttactccgattatgtatagaaccttagtttgagaaaatgaattttactatgtactgaatttagaggttgagaataataggatctgtgttattcttagtacccactgataaattgtgcaataaataatctttcgcaagtgattttagctaattgaagagattattttcctatgtaatttcacattctaatatactaaatgtttatattccttagagaactattttatattgtgcgctgggggcttgtgatgtttgtgtgctgttttaaaattcatttcaaattggactcgatttccttatatctaatatatatctgggagaaaaggctgcttgaaaatatcttttgattcagtgatttttaacattgggaagttgagtttattaaaaggtagtctg

SEQ ID NO: 1164 - DNA, 4611 bp, Homo sapiens
gcacttccggcgacgggccccctccgcgcgtactgcgggccccacgggtgttagtggcgggggcggcagagtccgggtgggttgtcgcgacggagccgggcctcttcgccgtcttgagacggggctggcgagaagggcccctcacggagttgccatgggcgtctaaccgcggcagccaggcccctctctacgtgagaccccggcccccctcccctttctgcagcccgcccgccacctgcgcgccgcgtggcctccgccggcgcctgcccgccccgcgcctccgtctcccacggagcaggccgggctctcgccatgggtcactgtcgcctctgccacgggaagttttcctcgagaagcctgcgcagcatctccgagagggcgcctggagcgagcatggagaggccatccgcagaggagcgcgtgctcgtacgggacttccagcgcctgcttggtgtggctgtccgccaggaccccaccttgtctccgtttgtctgcaagagctgccacgcccagttctaccagtgccacagccttctcaagtccttcctgcagagggtcaacgcctccccggctggtcgccggaagccttgtgcaaaggtcggtgcccagcccccaacaggggcagaggagggagcgtgtctggtggatctgatcacatccagcccccagtgcctgcacggcttggtggggtgggtgcatggacatgcggccagctgcggggccctgccccaccttcagaggacactgtcctccgagtactgcggcgtcatccaggtcgtgtggggctgcgaccagggccacgactacaccatggataccagctccagctgcaaggccttcttgctggacagtgcgctggcagtcaagtggccatgggacaaagagacggcgccacggctgccccagcaccgagggtggaaccctggggatgcccctcagacctcccagggtagagggacagggaccccagttggggctgagaccaagaccctgcccagcacggatgtggcccagcctccttcggacagcgacgcggtggggcccaggtcgggcttcccacctcagccaagcctgcccctttgcagggccccagggcagttgggtgagaagcagcttccatcttcaacctcggatgatcgggtaaaagacgagttcagtgacctttctgagggagacgtcttgagtgaagatgaaaatgacaagaagcaaaatgcccagtcttcggacgagtcctttgagccttacccagaaaggaaagtctctggtaagaagagtgaaagcaaagaagccaagaagtctgaagaaccaagaattcggaagaagccgggacccaagcccggatggaagaagaagcttcgttgtgagagggaggagcttcccaccatctacaagtgtccttaccagggctgcacggccgtgtaccgaggcgctgacggcatgaagaagcacatcaaggagcaccacgaggaggtccgggagcggccctgcccccaccctggctgcaacaaggttttcatgatcgaccgctacctgcagcgccacgtgaagctcatccacacagaggtgcggaactatatctgtgacgaatgtggacaaaccttcaagcagcggaagcaccttctcgtccaccaaatgcgacattcgggagccaagcctttgcagtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctggtgtgcagtggcaggtcccgtcagaagagatgaggctcctgggacaggtcagcgtcaggggcagcctgctgtctgctctggagggcggcgctcacctctgggtcgcagtccccacgatcagccagcagctgtgagagaggagcaggtcctcagcccatgccgcccactaggcctcagaccacaggggaggggctctggcagaaatagtcgagttgtattgccagccaggcaggcacatggcccaggcagctgtcaattctcatgtcccccacatggcccaaggtgggcatcttgacgttacctctgccacgtgtgagaagctctttttcgggcaccgaggtattaactgcagcagaaaaagacgagcttttgttatcagttccacggggttgccctagagagaaaacaggcaaactcacaggttagaagacatacagaaacagggctggtgtgtcccccatagtctgcatgctgtgccggaacattctttggcagaaggagcctccggctggggggagctcccctggaggtgggactggcccttgcacctgcctgacccttgagctccaggctcctgccagctggaggtgaaactgtgcttgtatccccagccacgaagagctggaccagcttcaagtacatgtccacagcaacatgcaggaaggcctcttccctgatggccgcgtcttcatggaagtaggagagaagactagaggtaaagacatagtgacaaatggctacagactgctggaaaggtagcaggtgatgccaagggatactgctcatctgtggagcagaggcacagacaacccttcccatctggcgggacccagaggtgctgagatgggggtctgggaaacactgcccagccctgaccagccctgtgggtggaggtacctgtaaaaagcgaaaggcagcagcctggtgtgctgatccggggccacacggaggaggagccgccccagcctgaggtctgcaacaccaagaagtggctcaggcaactctggacatctctgcctattatcagtgctggggacacccctgggggtcgggacgtgtaccctgggaggcctggctgtggggatagtgtggggcgaacagcctgagctgaggatacccaggtacctgtcagcagctgggagaggatgggggggtcgacctcttgcaggagggtgggtgtggtgcagagagaggcagtccccatgataggcccattggtcctggggttgaccagtgagccagtaaattatcttattgctttaaacaagtttgtgcttaatctgtcccaactaaaatggagcttataaacttacttagcaaggaacctcaaggagggctcgttcttaaccatttgcaagatgcctctgaaaagagcggccctccgcatttgtgcctcagcagcgtgtttcttaccactctctgtcaactgaaagagtgccagccaggatatcttcctcttctctaaacactcgaggattgctgcacaaacgtggaaagcctttggcaggtctgtggtgctctgtaaaccgcaggagaccaaccctgagaatggccgacctggtgctcccatgggtaggagggtacagccctcagcacagaagagggcatttcctctttgcttattgtaagtcttaaaactggtgacagttttacctatagaaggtaatactgggcctctggacagaagaggctcaggtaggaggccagggacttcgagcacccacaccaaggctgctgcaccacgtcctcaaataagacattaaaagaaaggcccacaggccggatgcagtggctcatgcctgtaatcccaacactttgggaggccgaggtcggcggatcactgaggccagttcaagaccagcctggcaatatggtgaaaccccgtctctactaaaaatacaaaaattagccgggtgtgacagactcacgcctgtaatcccagctactcgggaggctgatgcaggagaattgcttgaacccaggaggctgaggttgcagtgagctgagatcacaccactgcactccagcctgggtgacagagtgagacccccatctcaaaaaaaaaaaaaaaaaacccacggcctgggagttctcactcacacttccgcaaacacaaggagctcctgagctagtctggaaaccctgacttggaagctggctgcctggtgcccctgcctggcccacagtgggagaggacaccttggctggtaaggtctgacttacatttgaggtcagatgtgacgacagcaggcccatcaaggagaagaagaaaaggaaaaccaatagctgtaaataaaaacgtgcacttattattacattaaaattacctgtgctgtcattctaaa

SEQ ID NO: 1165 - DNA, 4076 bp, Homo sapiens
cgggcgggtgtggccaggggtgtgggtctgtgagggaccggtcggaagggcgtcgcgcggcctcgggtgacatgcggggggcggcgagcgcgagtgtccgcgagccgacgccgctcccgggtagaggcgccccccgcacaaagccccgggcgggccgaggcccgactgtagggactccagccaccttggccctccctgcccggggaaggccgcgctcaaggaatggcctcgcatccaaaggccagcgaggagcggcccctacggggcctgggcacagagctctgccttccagggacactgctcttccccaggagagaaacaagaagctggaggctgtggggacaggaattgaacctaaagccatgtcccagggcttggtgacatttggggatgtggctgtagatttctcccaagaggagtgggagtggctgaaccccattcagaggaacttgtacaggaaggtgatgttggagaactacaggaacctggcatcgctgggactttgtgtttctaagcccgatgtgatctcctcgttggaacaaggaaaagagccttggacagtgaagcgaaagatgacaagagcctggtgcccagacttgaaggctgtgtggaagatcaaggagttacctctcaagaaggacttctgcgaaggaaagctatcccaggcagtgataacagagagactcacaagctataatctggagtactctctgttaggggaacactgggattatgatgctctgtttgagacacagccgggcttggtgactatcaaaaacctggctgttgacttccgccagcagctacacccagctcagaagaatttctgtaagaatgggatatgggagaacaacagtgacctgggatcagcaggacattgtgtggctaagccagatttagtctctttactagagcaagagaaggagccctggatggtgaagcgagagctgacaggaagcctgttctcaggccagcgatctgtacatgagacccaggaattatttccaaagcaagattcatatgctgaaggggtaacagacagaacctcaaacactaaacttgattgttccagtttcagagaaaattgggattctgactatgtgttcggaaggaagcttgcagtaggtcaagagacacaattcaggcaagagccaattactcataacaaaaccctctctaaggaaagagaacgtacatataacaaatctggaagatggtcctatttggacgattcagaagagaaagttcataatcgtgattcaattaaaaattttcaaaaaagttcagtggtaataaaacaaacaggcatctatgcaggaaaaaagcttttcaagtgtaatgaatgtaagaaaacttttacccagagctcatctcttactgttcatcagagaattcacactggagagaaaccttataaatgtaatgaatgtgggaaggcctttagtgacggctcatcctttgcccgacaccagagatgtcacactggcaagaagccctatgagtgcattgagtgtgggaaagctttcatacagaacacatcccttatccgtcactggagatactatcatactggggagaaaccctttgattgcatcgattgtgggaaagccttcagtgaccacatagggcttaatcaacacaggagaattcatactggagagaaaccttacaaatgtgatgtatgtcacaaatccttcaggtatggttcctcccttactgtacatcaaaggattcataccggagaaaaaccatatgaatgtgatgtttgcagaaaagccttcagccatcatgcatcactcactcaacatcaaagagtacattctggagaaaagccttttaagtgtaaagagtgcggaaaagcttttaggcagaatatacaccttgccagtcatttaaggattcatactggggagaagccttttgaatgtgcggagtgtggaaaatccttcagcatcagttctcagcttgccactcatcagagaatccatactggagagaagccctatgaatgtaaggtttgtagtaaagcgttcacccagaaggctcaccttgcacagcatcagaaaacccatacaggagagaaaccatatgagtgcaaggaatgcggtaaagccttcagccagaccacacacctcattcaacatcagagagttcacactggtgagaaaccctataaatgtatggaatgtgggaaggcctttggtgataactcatcctgtactcaacatcaaagactgcacactggccaaagaccttatgaatgtattgagtgtggaaaggcattcaagacaaaatcctcccttatttgtcatcgcagaagtcatactggagaaaaaccttatgaatgcagtgtgtgtggcaaagcctttagtcatcgtcaatcccttagtgtacatcagagaatccattctggaaagaaaccatatgaatgtaaggaatgtaggaaaaccttcatccaaattggacaccttaatcaacataagagagttcatactggagagagatcttataactataagaaaagcagaaaagtcttcaggcaaactgctcacttagctcatcatcagcgaattcatactggagagtcgtcaacatgcccctctttaccttccacgtcaaatcctgtggatctgtttcccaaatttctctggaatccatcctccctcccatcaccatagcctcgagacgtcatttctgtttgactactccagcagtttaaaaccccatctccctgcccttttgttttctttttgtcccttattagttagttcttcacataagtgtaaatgtaacttattcactcctcttgtaaaacttatagtttctttaaattggttaatgtgtgagatgtgctcagcacagtgcctggtccatagtaagtgctcagtaaacttagctgttttaaaaactttgtatttgaacattgaaaagttacagtagtcagctctgataaaaaaatgatgcagtagggtgagggtaggaaaaagcacattttctatcaggaacagaattctccagtagtgggtgaggttttgcctttgttggttttaaaacttgattctataatgccaagttagttttgtggctttccatctgaccctatgtgaatgtaaggtgatgtgaccttgttggtgagaaaattaaactttacatttgacttgatttgttttagaaagtctagggaccatgaatgaataggccagctgggacaaatgaatttaaaaaatcagaaaaatgcaagatttatatgcatgaagttaaaacaactgacgttactcaagaattagaaaactttgcaagatttgacttgtttaaaaatcacatttataagtgaaccgtattaaaacttttaaggaaccattcattgtgaggtaaactgatccagaataggggtcagcaaactatgactcatggccacagtctcactgactgtttttgtatggtccatgatctagaatttaaaaaaattttaaagggttgaaaaaagtgaaaagaatattttcaacatgaaaattatatgaaatttaagttttggtgtctgtaaataaagttttgttggcttcagccacacagtgatttacaccttgattgtgctgcttccaggctgtagcagcagagttgagcagttgtgacaggagaccatgtggcctgcagagcccaaatatctactgtctgatcctacacagaaaatgtgtgtgatccctgctatggagcagaggttatcaaactaaagcccatggaccaaatcctatctgctgcttgtttttgtaaatagagttttatcaaaccacagccatgcttacttgtttagctattgactatggctgctttagacaactgtgacagactatatggctcgcaaaactgcaaatatttcctatcctttaacagaaagtttgccaacctctgctctagagtagagaaaaatgtataaaagattttaattttatgagggcaatacaactgtcacatcagaaacaagaaaacaaatgataaaggaactcatttatcaatagaggtgaaaggaaattattaaactatattgaaaaataaagatgtcaataaaaggagaaatg

SEQ ID NO: 1166 - DNA, 2803 bp, Homo sapiens
tgggaaggagagaaaatggcggcggagccgaacaagaccgaaatccagactctttttaagaggcttcgcgcagttccaaccaacaaggcctgtttcgactgcggcgccaagaatccgagttgggccagcatcacgtacggtgttttcttgtgcattgactgttccggggtgcaccgctccctgggcgtccatctgagcttcatcaggtccacagagttggattccaactggaactggttccagctgaggtgtatgcaggtcggcgggaatgccaatgcgacggctttttttcgccaacatggatgcacagccaatgatgccaacaccaaatataatagccgagctgcccagatgtaccgggagaagatccggcagctggggagtgcggccctggctaggcatggcactgatctttggatagacaacatgagtagtgccgttcctaatcactccccagagaagaaggactctgatttcttcacagaacacactcaaccccctgcctgggatgcgccagccactgagccttcagggacccagcagccagccccgtctacagagagcagtggcctggcacagccggagcatggccccaacacagacctgcttggcacctcacccaaagcctcactggaactgaaaagctccatcattggcaagaagaagccagcagcagctaagaaagggctgggtgccaagaaaggcctaggggcccagaaggtgagcagccagagcttcagtgagattgagcggcaggctcaggtggcagagaagctccgtgagcagcaggcagccgatgccaagaagcaggcggaggagtccatggtcgcctccatgcgtctggcctaccaggagctccagattgatcgtaagaaagaggaaaagaagctacagaatctggaagggaagaagcgagagcaggcagaaaggttgggcatgggcttggtatcccgaagctctgtctcccactccgtgctgtctgagatgcaggtgattgagcaggaaaccccagtgagtgcaaaatcctctcgctcgcagctggacttgtttgacgatgttggtactttcgcctctggacccccaaagtacaaggacaatcccttttccttaggggaaagctttggctcccgctgggatacagatgctgcctggggtatggacagggtagaggagaaggagccagaagtgaccatctcaagcatccggcctatttcagaaagagccacaaaccggagggaagtggagagccggagctcaggcctcgagtctagtgaggcgcgtcagaaattcgcaggagccaaagccatctcatctgacatgttctttgggcgggaggtggatgcggagtatgaggccaggtctcggctgcagcagctctcaggcagcagtgccatcagctcttcagacctctttggggacatggatggagctcacggagcaggaagtgtatctctggggaacgtgctgcctacagcggacattgcccagtttaagcagggtgtcaagtctgtggctgggaaaatggctgtgctggccaatggtgtgatgaattccttgcaggatcgctacggttcctactgatccgagctctgtgactcaggcttacgatggtgacggcaacaagaactccacagttcccaggctggggatgctttgccttgtggaagctggggaggatttgttacttcgtatgtgtggtgtgtgtgtggggtggcctttgaggcgctcactcctgtgaggggaatggtcagtaccagcccttgtcctctgcctgtggactgagccctttattccctctcacaccaccctccgtgtgttagactcttgtccttctgtcctgcccccacagctgctgctcacttatcctgccatactgggaaagggggttcccccacgatggcttattctgggtccagactttccccaggtagggaaagcggaaggtagaaggctttttttgctggctctagggttcttctagttcgaggccttgggtccccatcctctggaaccagggggaggcctggaaggagttcactgtagacccgtcccatggggaaagaggctgcggacttgctgctgctgctgctgccagtggcctcttctgggtgccaggagaggggaaggacctttgtctgggcgttaccaagggctggaaactttacctggtacctaaaggtttcatttgggatcagaccggagacccttgggttctcccgtctcaccacccctttctacagtaagcacttggaagattgtttcagggtgtctcagggtccctctgtaccatctgctgtggaatgcaggaccctctgtgacattctttatcccttcttccccgggttggtggccatggagggtcttgtctgctgtgattcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaagtggtgtcaaaataaagcccctgcagggcctggctccctgttggtctgagtgaaaaaaaaaaaaaaaaaaaaaaaaaaaaaaaaaaaaaaaaaaa

SEQ ID NO: 1167 - DNA, 1010 bp, Homo sapiens
ccattgttctcggtgccccacgggcttgagccggggtgaatctggaggggccgggccgagcccgggggcgctttcgcacgcgaagcaaccgctagagcaggacctggtctcccgagagcgggactacttgttgatatttgaggagggaagtgtcttacctgagagcctggctggagaagactgaggtccaaggcttgaagcctaagtgattgccccaggactgtggatgatggctgcagacatcccgagagtgaccactccgctgagctccttggtccaggtgcctcaagaggaagatagacaggaggaggaggtcaccaccatgatcctggaggatgactcctgggtgcaagaagctgtgctgcaggaggatggccctgagtctgagccctttccccagagtgctggcaagggcggcccccaggaggaggtgaccaggggaccacagggtgcactcggccgcctccgagagctctgccggcgctggctgagaccagaggtacacaccaaggagcagatgttaaccatgctgccaaaggaaattcaggcttggctgcaagagcatcggcctgaaagcagtgaggaggcagcggccctggtggaagacttgacccagacccttcaggacagtgctgtagctgtcgttgcttcccttccggtggaggtgaccagtttgtaatgaacttctggatctccagtcagatactatggaggagagagtgatggagggctgaggagaggcctcaggttgttatttggttggggaggcacagagcagaggttcaggtctcagcaggtgtcagaggtgattacagcccttcccatccaccttgcagcaggggctttgtgcctttcatctttaactgggcacctgagatgggaaccaatggggaccatcccagacacatgggtttgtctgtccctgacttctgcctctgagattgtctttgttggtctttgtttaataaacgccccgaccttcctcatgaaaaaaaaaaaaaaaaaaaaaa

SEQ ID NO: 1168 - DNA, 8021 bp, Homo sapiens
ctgcggcggcgcgctccgagcctgcgtctagggcgcccccgggtcagagctgtcgccgtggccgccgctgcaagaaccatgtaccgcagcagcgctcgctcctccgtctcttcccaccggcctaaagacgacggcgggggcggcccgcgcagcggccgcagctctggctcctcctcaggcccggctcgccgcagctcaccgccgcctccgccctccggctcctcgtcgcggaccccggctcgccgaccccgctcgccctcagggcaccgcggccgccgggcctcgccgtccccgccacggggtcgtcgcgtctccccgtccccgcctcgggcccgtcgcggctccccgtcgccaccgcggggccgacgactcttcccgccgggcccggccggcttcagaggcagcagccggggggagtcccgcgccgactatgcccgggacggccgcggagaccatccaggcgacagcggcagccggagacgctctcctggtctgtgttctgactctttggaaaagagcttaaggatcactgttggcaatgaccacttctgtgttagcacaccagaacggcgacggcttagtgatcggctggggtcaccagtggataatctggaagacatggacagggatgacctgactgatgattctgtcttcactcgaagctcccagtgctctcggggtcttgagcgatatatttcccaggaggaagggcctctcagtcccttcttgggacaacttgatgaggactaccgaacaaaagaaactttcctgcatcgatctgattatagtccccatatcagttgtcatgatgagctgttgcggggaacagaacggaatcgagaaaaactcaaaggctactccatacgatctgaagaaaggagccgggaggccaaaagaccccgttatgatgacacagtgaagataaacagcatgggaggggatcacccaagttttacatcaggaactcgcaactatcgacagcgtagaagaagcccaagtcctaggtttctcgaccctgagtttcgagaactggatcttgccagacgaaagcgagaggaagaggaggagcgaagtaggagcttgagtcaggagctggttggagttgatggtggtggtactggctgttccatccctggattgtcaggtgtcctaacagcatcggagccaggatattctttgcatcggcctgaggaagtatctgtgatgcccaagaaatccattttgaagaagcggattgaggtggacataatggagccctccatgcagcttgagagtttttccagcagtaccagctccagccaggatcaccctctctactctgggcacccatcccttccactaagtggtgctattgctgcttttgcctcagagattgaaaacaaggggactatggtagagactgccttgaaggaacctcagggcaacctctaccaatggggtccccttcctgggattcccaaagacaacagtcctctcagagaaaaatttggaagttttctatgccacaaggataatttggatttgaaggctgagggacctgagcgacacacagacttcctgctgccccatgagagagctagccaggatggcagtggtttttcccgcattctgagcatgttggctgattctaccagtacacaggaaaaaaggcgacgtagctttcccgacattgaagatgaggagaaatttctctatggggatgaagaagaggatttaaaggcagaatccgtaccaaagccccttgggagctctgagagtgaagttatgaggcagaaggcaagctccctgccgtcttcagctccagctgtaaagctagaatcactagaagagaccaatccagaatatgcgaagatccatgacttgctcaagacaatagggctggatattggagtagcagagattagtcaattggctgcacgcacccaggaacgacttcatggcaagaagccatcattacgctcctcagctgaccgccgttcctcagttgaccgatacttttcagctgaccactgttcctcagttgaccaccgcttctcagctgaccgctgttcctcagttgaccactgcttctcagctgatcgacgttcctcagatccccacagactagagagcagggaggcacatcatagcaatacccactctccagaggtgtcccatccacacccaccttctcctgtggatccttacctgctcacaaaaaacagccctccattcctaaagtctgaccatccagtgggtcatatttcaggaccagaggtggttggtagtgggtttcagtcatctgttgcagtcaggtgcatgttgccatcagccccatctgccccaattagacttccacacactgctgctttatctcagtttcacatgccaagggcctctcagtttgctgcagctcggatacctccgaactaccagggacctgccattccccctgcctcttttgatgcctataggcactacatggcatatgcagcctccagatggcccatgtatcccacctctcaaccgtcaaaccaccctgtacctgaaccacacaggataatgccaataaccaaacaagctactcgtagccgtcccaatcttcgtgtgatccccactgtgactcctgataagcctaagcagaaagagtctctgcgaggctcaattcctgcggcccaagtgcctgtccaggtgtccattccatcactcataagatataatccagagaagatctctgatgagaagaaccgtgcttcccagaagcaaaaggttattgaagagagggaaaaactaaagaatgaccgggaagcccgccagaagaagatgtactatcttaggaccgagttagagcggcttcataaacaacaaggagaaatgctgcgcaagaaacgaagggagaaggatggccacaaagatcctctcttggtggaggtgagtcggcttcaggataacattatgaaggacattgcagagctacggcaagaggcagaagaggcagaaaagaagcaatctgaactggacaaagtggctcagatcttgggaattaacatcttcgataaatcccagaagtctttaagtgacagtagagagcctacagagaagcctgggaaagcagaaaaatctaagagcccagaaaaagtgtcatcgttctcaaactcctcctccaacaaggaatcaaaagtaaacaatgagaagtttcgtactaagagccccaagcctgccgaaagcccccagtcagccactaagcagttggatcagcccactgctgcttatgagtattatgatgctggcaatcactggtgcaaagactgcaacaccatctgtgggaccatgtttgatttcttcactcatatgcacaataagaagcacacacagacactggatccctacaacagaccttgggcttcaaagacccagagtgaggccaagcaagatgccataaagcgcactgacaagataactgttcctgcaaaaggctctgagtttctggttcccatcagtggattttattgccagctctgtgaggaatttttgggggatccaatttctggggagcaacatgtgaagggtcaccaacacaatgagaaatacaagaaatatgtggatgaaaacccattatatgaggagcggcggaatctggaccgccaagctggcttggctgtggtcctagagacagaacggcgacggcagagtgagctaaagcgcaaacttagtgagaaaccaaaggaggagaagaaagaaaaaaaggcaaaggctgtgaaagaagtaaaggaggatgacaaggtctctgagaaattagaagaccaactctctgagggtaggaactcccctgaaaaagctgaaaataaaaggaacactggcatcaaactccagttaaaagaagaggtaaagaaggaatcaccaacatcatcttcttttgggaaattcagctggaagaagccagaaaaagaagaggagaaaagttcattggtgaccccaagtatctctaaagaagagattctagaaagtagtaaggacaaagaggatggcaaaactgaagctgggaaggcaaagcctatcaaaatcaagctctctgggaaaactgttgttgcacataccagcccttggatgcctgttgtgacaacttccacacagactaagatccgacccaacctgcctattccatccacagtactccgcaagtcatgttcagccacaatgagcaagccagctcctcttaacacctttctgtctattaagtcctctggaaccactgctaaacctctgccagtggttaaagagtcttcagctgatctcctcttacctccagacatcatctccaaagcatttggaggggaagaggtgattctaaaagggtctccagaggaaaaagtggtgttggctgaaaagagtgagccatctcatttacctgaacaaatactaccacctcctccaccacccccacctccaccacctccaccaccccccgttatacctcatccagctgccccgtctgctgctcaagcaaatgctatcttggctccagtaaaatcaaacccagttgtatctcagactctcagccctggcttcgtgggtcctaacattttgaacccagtgttgcctgtagccatcatggcctcagcacagccagctgccattccttctgatgagacagctcctggggtgagtgagagtgaccgagaccagaccctgttctctgtgttagtacgtcctccaccacccctctcaagtgtgttcagtgaacaagccaaaaaattagagaagcgaaattcatgcttagccacagccaatgctaaggacctgtatgacatattctatagtagtggtggaaagggggcccctgagactaagggggcccctgagactaagctaagtggtggtccattggccaatggggaaaatagcaacctctctagaaccaaaagttcagacacctcttctacttctcctttgaacagcagtgcatcccaagaggagttgcatcaagatgagggtttggtcgctgctcctatagttagcaactctgaaaagcccattgcaaaaactctggtggccctagggaaatggtcagttgtagaacatgtaggcccaaaaagcacaggcagcacctatggcttcctacagcctctgacaaggttgtgccaaagcaggccttatgaaacaattaccccaaagacagacactttggccatatggacctctagttccttccagagtgacactagtagggatatatctccagagaagagtgagcttgacctgggagagccaggaccacctggtgtagaaccacctcctcaactgttagatatacagtgcaaagaatctcagaagttggtagaaatccacctcagagaatctgttaaccaggataaggaaagccaagagctccgtaaatctgaggattgtagagaaagtgagatagagacaaacactgaactaaaagaaagggtaaaggagctgtctgaggggatagttgatgagggagtaagtaccagcattggaccccacagcatagatgattctaatttgaaccatggaaacagatacatgtgggagggagaagtaaaacagcccaacttgctaatgattgacaaagaggctgaacagtccaataaattgatgacaggaagtgaaactccaagtaaagtagtgatcaaattgagtccacaggcttgctctttcacaaaggcaaaattagactcatttttatcagaagctaggtctttactcaacccacaagatacacctgtgaaaatttctgccccagagttgctgcttcattccccagccagatcagctatgtgtttaacaggtagtccacaagagcaaggagtttcagttgttagtgaggaggggctagagaattcagctccagaatcagcttctagaacttctaggtacagaagtctcaaactcaagagagaaagatcaaaagactttcaagttaaaaagatctatgagttggctgtttgggatgaaaacaagaagaggccagagacctgggagagcccagagaaaccaaaaacagaagcactggagctacaagatgtccatccagagttaacagtgacaatagaaagcaaggccctagaagactttgaagctacagacttaaaggtagaggagcttactgccctggggaatctgggggatatgcctgttgatttctgcactactcgggtaagcccagcacatagatccccaactgtcttgtgtcagaaagtgtgtgaagaaaattctgtatcacctatagggtgtaattcctccgatcccgctgacttcgaaccaatcccatctttttctgggtttccgttagattctcccaaaaccttggtgcttgactttgagacagagggtgaacgaaactcacctaatcccaggagtgttaggatcccttctcctaacattttgaaaactggacttacagaaaatgttgaccgtggcttggggggcctagagggaacacaccaggcccttgacctgttagcaggaggaatgatgcctgaggaagtaaaagaatcttcccaattagacaaacaagagtcactcggattggaattaaaaacaattaattctgcaggccttgggccatctccttgccttccagaccttgttgactttgtcacacggacctctggagttcaaaaagataaactgtgttctccactctctgagccaggtgacccttctaaatgtagttccctggagttggggccattacagctagaaatatcgaatgcatccaccacagaggtggcaattctgcaagtagatgatgacagtggcgaccctctgaatttggttaaagctccagtgtcaaggtcccctccaagggagcaggtaattgaagacaatatggtccctcagggaatgcctgaacaggaaactacagttggtgccatccaggaccacacagaatccagtgttcacaactaagaataaatacctagagctacttgtgagtgaatcattggcttctagaaatcagatgcccagatgatccaagactagtttgttatctcatctggaacctacaccaagagatgcagtcagcatcttaaagtaaatgttcatggaagctaaaaaatttacctcctttccttttccctttccccttaaaacaccagacaaatcgataacaacttatatatatatatatatatctgtaaaaatgtattttgttaatttttttggccaatttattttctcccactttgtcattaaaatcacatgtctaactggctcaccacatagtgtgctttgattgtattttggctttgactctgccatttctgaaatgtgggggaggatggaggcagctgacctctccagttgctgtgttgtattcctacccaatttcctgggcagttgatgcatctctgggaaaaacaccagaaagcttgctgaaatggaaaacttggaagaattgttcatctcttaggcttccatttggatgggcctgccttaacattgtttgaaatgcagcgtgagtagctcttttgtttactgtttacaccccttattggcatgtcaactcctgtacttcccttactctgttgcctttcttgagatgcattgtcctgctaacccacaaacctgtttggaaataaacatggaagaatatctggcaggcttacttttagaagacgacaaatcggtaaggcttattcatggttcattgccaggagcagatatgcttttgagatcacttttatttttgaaatggcctttgttcattgtattgtgatccaataacactttgtattaaattgtttagcagccatttgtgttgtgaaggggtagaagatctctgaaacttgtcttgagattgaactcattccctgttccacaaacccatatgtatcctttcctctacctcctcctttcccaattaatttcaaccatagtacgatgtttggggttgtatattttgttaaaaagattaaagaatttatgagttggcttggacaagtttaactttatttttaatgtgttaattacttggaataaatgcattaatctcaaaaaaaaaaaaaaaa

SEQ ID NO: 1169 - DNA, 1745 bp, Homo sapiens
agcctgacttcagcgctcccactctcggccgacacccctcatggccaaccgttacaccatggatctgactgccatctacgagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctccaccagcctagtggagggccgcagctgtggctgggtgcccccaccccctggcttcgcaccgctggctccccgcctgggccctgagctgtcaccctcacccacttcgcccactgcaacctccaccaccccctcgcgctacaagactgagctatgtcggaccttctcagagagtgggcgctgccgctacggggccaagtgccagtttgcccatggcctgggcgagctgcgccaggccaatcgccaccccaaatacaagacggaactctgtcacaagttctacctccagggccgctgcccctacggctctcgctgccacttcatccacaaccctagcgaagacctggcggccccgggccaccctcctgtgcttcgccagagcatcagcttctccggcctgccctctggccgccggacctcaccaccaccaccaggcctggccggcccttccctgtcctccagctccttctcgccctccagctccccaccaccacctggggaccttccactgtcaccctctgccttctctgctgcccctggcacccccctggctcgaagagaccccaccccagtctgttgcccctcctgccgaagggccactcctatcagcgtctgggggcccttgggtggcctggttcggaccccctctgtacagtccctgggatccgaccctgatgaatatgccagcagcggcagcagcctggggggctctgactctcccgtcttcgaggcgggagtttttgcaccaccccagcccgtggcagccccccggcgactccccatcttcaatcgcatctctgtttctgagtgacaaagtgactgcccggtcagatcagctggatctcagcggggagccacgtctcttgcactgtggtctctgcatggaccccagggctgtggggacttgggggacagtaatcaagtaatccccttttccagaatgcattaacccactcccctgacctcacgctggggcaggtccccaagtgtgcaagctcagtattcatgatggtgggggatggagtgtcttccgaggttcttgggggaaaaaaaattgtagcatatttaagggaggcaatgaaccctctcccccacctcttccctgcccaaatctgtctcctagaatcttatgtgctgtgaataataggccttcactgcccctccagtttttatagacctgaggttccagtgtctcctggtaactggaacctctcctgagggggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgtatttttcttcctttttttgtaatattgaaaacgacgatataattattataagtagactataatatatttagtaatatatattattaccttaaaagtctatttttgtgttttgggcatttttaaataaacaatctgagtgt

SEQ ID NO: 1170 - DNA, 2752 bp, Homo sapiens
cgctaaggccgccctccgggtagccgccatgtcggtctccagcggcgtccagattctgacaaagccagagaccgtggaccggaggagaagtgcggaaacgaccaaagaggccgggcgaccactggagatggctgtgtccgagcccgaggccagcgccgcggaatggaagcaactggatcctgctcagagcaacctgtataatgatgtgatgctggagaactactgcaaccaagcctcaatggggtgtcaagctcccaaaccagacatgatctccaagttggaaaaaggagaagcaccatggttggggaaggggaaaagacccagtcaaggttgtccaagtaaaatagcaagacccaagcaaaaagaaactgatggaaaagtccagaaagatgatgaccagcttgaaaatatccagaaatctcaaaacaaactcctcagggaagttgcagtcaagaagaaaactcaagctaagaagaatggcagtgactgtggttcactggggaaaaaaaataatttgcataaaaaacatgttccttcaaagaaaaggcttcttaaatttgagtcatgtggaaaaattttgaaacagaatttagatttacctgatcactcaagaaactgtgtaaaaaggaaatctgatgcagctaaagaacacaagaagtcattcaaccatagcttatctgatacaaggaaaggcaaaaagcaaactggaaagaaacatgagaaattatccagccatagctcatctgataagtgtaacaaaactggcaaaaaacatgacaaattatgctgtcatagttcatcccatattaaacaggacaaaattcaaactggagagaaacatgagaaatcacccagccttagctcatctactaagcatgaaaaacctcaagcttgtgtgaaaccctatgaatgtaatcaatgtggaaaggttctcagccataaacaaggactcattgaccatcagagagttcatactggggagaaaccatatgaatgtaatgaatgtgggatagcctttagccaaaagtcacaccttgttgtacatcagagaactcacaccggagaaaaaccatatgaatgtattcagtgtggcaaagcccatggtcataaacatgcactcactgaccatctaagaattcatactggagaaaagccctatgaatgtgctgaatgtgggaaaaccttcagacacagctcaaaccttattcaacatgtgagatctcacacaggtgagaagccatatgaatgtaaggaatgtgggaagtcttttaggtataactcatctcttaccgaacatgtgagaacacatacaggtgaaataccatatgaatgcaatgaatgtggaaaagcctttaagtatagctcatcccttactaaacacatgagaattcatacaggtgagaaaccctttgaatgtaatgaatgtgggaaagctttcagcaagaagtcacacctcattatacatcaaagaactcatactaaggagaaaccttataaatgtaatgagtgtggaaaagcctttggacatagctcatctcttacttaccatatgagaactcatacaggtgaaagtccctttgaatgtaatcaatgtgggaaaggctttaaacaaattgaaggccttactcaacatcagagagttcatactggagagaaaccgtatgagtgtaatgaatgtgggaaagcctttagccaaaagtctcacctcattgtacatcagagaactcatactggggagaaaccttatgaatgtaacgaatgtgaaaaagcctttaatgcaaaatcacagcttgttatacatcagcgatcccacactggagaaaaaccctatgaatgtaatgaatgtgggaaaactttcaaacaaaatgcatccctaaccaaacatgtgaaaactcattcagaagataaatctcatgagtgaagttaatgtgggaaatttgttaactaaatttaaggttttgttgaaccttggaaatatgctgattttaaagagtgttagaaagcctttagcaagatgtcacaccttgttgtacatgagaaactttgaaaatggatcttcatatagaatcagtggatggaaacaagggtttaaacttgatacaaaaccttttataaaaaatattgttttaactactcaattattataaatgatctacatgttcagattgaaattgaaagctttaaaaattgtgaattatttgaatattcaaagcaatggagaaacaagttatatatgctgacagttcctgtgtttcttcttgttttgtacttaagcaccatatattagagttgaatttgcatatctgtttattgccttatgtaaatgagtgtggccatctgtataagcctctttgacattttcacccagctctttcttaatgtctgtgttggcttctgcatcagcagaaatctttttaaaagggttgttatatatgtaaaaaatgttaacaggaaaatgagagaaaataaagcagctgaggatacaaatgtgctggtagggagcgatattcaagatatattgtgaagtgtgaaaaagtaggttgctgaaccatgtatatagtatgttcccctttgtgtacaaaagggtatgtttgtttaacctctgtctcttatctctgtatgtgtatgtatctttgtatgcatatatacatgtatctgtatgtgaatagactttgaaaaaatacagaataaacttcatggtggttgccattgggcagaggagtataggactggggtctaggataggagcaag

SEQ ID NO: 1171 - DNA, 2646 bp, Homo sapiens
agtttctcctttgttttacgtttgggaggaggtggcattggaaatagcagagtgcttcgcggtaacaggggttggagtgcaatggtgtgatctcagctcactgcaacccctgcctcccaggctccagcgatcctcccacctcagcctcctgaatagctgaccaccagcacactaggcaaacccaccccactcaccgcctcccttgggaattcagacctaaccatcgctgagctgaaacaaatgtactgaggctggagcctgtgtgaacagaacagaagaggccttcactctagtagtgctcacagtccagcaggtgtttgctgaagacagcttactcagatcactactgcctggaggtggttgatatatcctggtgtaaaccttcaagaagggcacaggcaggaaaacatgagccagcaactgaagaaacgggcaaagacaagacaccagaaaggcctgggtggaagagcccccagtggggctaagcccaggcaaggcaagtcaagccaagacctgcaggcggaaatagaacctgtcagcgcggtgtgggccttatgtgatggctatgtgtgctatgagcctggccctcaggctctcggaggggatgatttctcagactgttacatagaatgcgtcataaggggtgagttttctcaacccatcctggaagaggactcactttttgagtccttggaatacctaaagaaaggatcagaacaacagctttctcaaaaggttttcgaagcaagctcccttgaatgttctttggaatacatgaaaaaaggggtaaagaaagagcttccacaaaagatagttggagagaattcgcttgagtattctgagtacatgacaggcaagaagcttccgcctggaggaatacctggcattgacctatcagatcctaaacagctcgcagaatttgctagaaagaagccccccataaataaagaatatgacagtctgagcgcaatcgcttgtcctcagagtggatgcactaggaagttgaggaatagagctgccctgagaaagcatctcctcattcatggtccccgagaccacgtctgtgcggaatgtgggaaagcgttcgttgagagctcaaaactaaagagacatttcctggttcatactggagagaagccgtttcggtgcacttttgaagggtgcggaaagcgcttctctctggactttaatttgcgtacgcacgtgcgcatccacacgggggagaaacgtttcgtgtgtccctttcaaggctgcaacaggaggtttattcagtcaaataacctgaaagcccacatcctaacgcatgcaaatacgaacaagaatgaacaagagggaaagtagtcctccaacaggatgaagcagattaacagaagagtgatcagtgacaaacatgcctcattgattattgtttctaggaaggaatttctaaatcaatattgcaaccccaaaagcggttataatttggtgttactaagatgctcctacactttgtgataccgttttaaggacatggtgcatttttttttcttttatttgttttatttagaactttttttatttgttttatttagaactttgtgtgttcttaaagtgtgcttccaacaggaaggtcagtgataaattttcaaaagcataaccttcaatatattatctgttggattattggatataagacttattttcatgtactataaatatgaaaataactttgatttttaattgtgtagtttccatttcttagcttttgccttttaaatttatacttcagccaggcatagtgactgatgcctgtaatcccaacactttgttgggaggccaaagcaggaggatagcttgaggccaggagttccagaccagcctgggcaacatagtgagatcctgtctctacaaaaaaaattgtttttatttgtatttatatatttttatttttgtttttgttggtaggcgtctcgctctgtcacccaggctggagtctagtgtcgtgatcttggctcactgcaacctccacctcccgggttcaagtgattctctggcctcagcctcccaagtagctgggactacaggtgtgtgtcaccacgcccggctaatttttgtatttttagtagagatggggtttcaccatgttggccaggctagtctcaaactcctgacctccagtgatctgcccacctcggcctcccaaagtgctgggattacaggtgtgagccactgtgcctggccccccacaacatgtttaaacttagctaggcctggttgcatacgcctgtgttcccagctactcaggaggctgaagcaggaggatagcttgagcccaggagtttgaggctacagtgagctgtgattgcaccactgtactccagactggataacagcaagagcccatcttttaaaaaaagtaaaaattaaaaatatacttcatggttcatgtcatagccctagagaatgaaaaatttgcagtagatagtcaataaatgaatcagtagttaaatattccttaaagtcaactgtatttcattgtgatttttgttttctttttatcattgtatcaaactatatggaaatcatatggttagatgtgattatttgataatgttagtccatttgaatccattttagatatttcacaattaaagaatatgaaacttc

SEQ ID NO: 1172 - DNA, 3281 bp, Homo sapiens
ggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtggggggtgtggaaaaataaaaggaaaagtccttgcaccatgtagatcagcgtcccccactttggcatcccggccggccggggacctcccagtctgcggccatgaacgcgagcagcgagggcgagagcttcgcgggctcggtgcaaattccaggtggcacaacggtgctggtggagctgactcccgacatccatatctgcggcatctgcaagcagcagtttaacaacctggatgcctttgtagctcacaagcaaagtggctgccagctgacaggcacatccgcagcagcccccagcacggtccagtttgtatcggaggaaacagtgcctgccacccagactcagaccaccaccagaaccatcacctcggagacccagacaatcacagtttcagctccagaatttgtttttgaacatggctatcaaacttacctgcccacggaaagtaatgaaaaccagacagccactgtcatctctctccctgccaagtcacgcaccaaaaagcccacaacaccacctgctcagaaaaggcttaactgttgctatccaggttgccaattcaagactgcttatggcatgaaggacatggagcggcatttaaaaattcacacgggagacaaaccccataagtgtgaagtctgtggcaagtgctttagccggaaagacaagctgaaaactcacatgcggtgccacacgggcgtgaagccctacaagtgtaagacgtgtgactacgccgctgccgacagcagcagcctcaacaagcacctgaggatccactcggacgagcggcccttcaaatgccagatctgcccctacgccagccgcaactccagccagctcactgtccacctgcgatcccacacgggggacgcccccttccagtgctggctctgtagcgccaagttcaaaatcagctcggacttgaaaaggcacatgcgggtgcactcgggggagaagcctttcaagtgcgagttctgcaatgtccgctgcaccatgaaggggaacctcaagtcgcacatccgtatcaagcacagcgggaataacttcaagtgtcctcattgcgacttcctgggtgacagcaaagccaccctccggaagcacagccgcgtgcaccagtcggagcatcctgagaagtgctcggaatgcagctactcctgctccagcaaggccgccctgcgcatccacgagcgtatccactgcaccgaccgccctttcaagtgcaactactgcagcttcgacaccaaacagcccagcaacctgagcaagcacatgaagaagttccatggggacatggttaagactgaggctctagagaggaaggacaccggcaggcagagcagccggcaggtggccaagctggatgccaagaagagtttccactgcgatatatgcgatgcctccttcatgcgggaggactcgctccgcagccacaagagacagcacagtgagtacagtgagagtaagaactcggacgtgaccgttctccagtttcagatcgaccccagcaagcagcccgccacgcccctcactgtgggacacctccaggtgcccctccagcccagccaagtgccccagttcagcgagggaagagtcaaaatcatcgttgggcatcaggtgccccaggcgaacaccatcgtccaggctgccgccgctgcagtgaacatcgtcccgcctgccttggtggcccagaacccagaggaactcccagggaacagccggctgcagatcctgcgccaggtcagtctgatcgccccccctcagtcctcgcggtgtccgagcgaggcgggcgcaatgacccagccggctgtcctgctgaccacccacgagcagacggacggagccactctgcaccagactctcatccccacggcctcaggtggcccccaggaaggctctggcaatcaaactttcattaccagttcgggtattacttgcactgactttgaaggcctaaacgccttgattcaggaggggacagcagaagtgacagtggtgagcgatggaggccagaacatcgcagtggccaccacagcgccaccggtcttctcctcctcttcccagcaagaactacccaagcagacctactccatcattcaaggggcagcccatccagctttgctctgtcccgccgactccattccagattagtgcttaaaaaaacaaaaggagtgggggaaaggaattgagaaaaagaaatcttaagtagaattctctaaaaggtttgctcttaatgttttctttgttttgttttgtttttgagacggagtctcgctctgtttcccaggctggagtgcagtggcgctatcttggctcactgcaacgtccgcctcccaggttcaagcgattctcatgcctcagccctccgagtagctgggaccacaggtgtacgacatcatgactggctaatttttgtatatttagtagagacggggtttcatcatgttgaactcctgacctcaagtgatctgcccacctcagcctcccaaagtgctgggattacaggtgtgagccaccatgcctggccgtggtttgctcttaatgtttttaaggatggttgtgaatccccctggccccataataaattgtaattttatactgcttactataatttttttaacactgtaacaactttgagaccacctctgaatcgtcgcattataactgttgtagaatcttaaatgttaccaagatgattccaatgaggggttggaattaaatgcattaagtagtgaattcatgtgtttgtttccaacttgattttccaactctaataaaggtttctgtccatcttattacatttgtgtagtaaatggtacttcccagcctctcttttgccccattctggaatactccccagagtttgggggtgttcatgttttatacatgtaagtctgttggcatgaaggaccattttctacataatatgacatggatacttgacccaaaaaaaaatgtttagtgctaatgagcagaaaatgaatggttccataataaattgatatctgattaaaatataaaaaaaaaaaaaaaaaaa

SEQ ID NO: 1173 - DNA, 3630 bp, Homo sapiens
gggagggatggggggaaagcaagctggaggacaggtgagacagcaggacaggaccggagcagggccccaagcccccgggcctggtgggggacgcgcttcttcccacactgtgagcctcagcagctccagccagcggacccgacggctgagaggagaagatggggagccccgaggatgacctgattgggattccattcccggaccacagcagtgagctcctgagctgcctcaatgagcagcgccagctgggccacctatgtgacctcaccatccggacgcagggccttgaataccgcacccacagggctgtgctagctgcctgtagccactacttcaagaagcttttcactgagggcggtggcggagctgtcatgggggccgggggtagcgggacggccactgggggagcaggggccggtgtgtgtgagctggactttgtagggccagaggcactaggcgccctccttgaatttgcctatacagccacactgaccaccagcagcgccaacatgccagctgtgctccaggctgcccgcctgctggagatcccgtgtgtcatcgctgcttgcatggagattctgcagggcagtgggctagaagctcccagcccggacgaggatgactgtgagcgagcccgccagtatctggaggcctttgccacagccacggcctctggagttcccaatggtgaagacagtcctccacaggtgcccctcccaccacctccgccaccgccacctcggcctgttgcccgccgcagccgcaagccccggaaagctttcctgcaaaccaagggggccagagcaaaccacctagtccctgaggtgcccacagtgcccgcccatcccttgacctatgaggaggaggaggtggcgggcagagtgggcagcagtgggggcagtgggccgggggacagctacagccctcccacaggaactgcctcccctcctgagggtccccagagctacgaaccctatgagggtgaggaagaagaagaggagctggtatatcccccagcctatgggctggcgcagggtggcgggcccccgctgtccccagaggagctgggctcagatgaggatgccatcgatcctgacctgatggcctacctaagctccctgcaccaggacaacctggcaccaggcctggacagccaagacaagctggtgcgcaaacgccgctcccagatgcctcaggagtgccctgtctgccacaagatcatccatggggcaggcaaactgcctcgccacatgaggacccacacaggcgagaagccctttgcctgcgaggtctgcggtgttcgattcaccaggaacgacaagctgaagatccacatgcggaagcacacgggagagcgcccctactcatgcccgcactgcccagcccgcttcctgcacagctacgacctcaagaaccacatgcacctgcacacaggggaccggccctatgagtgccacctgtgccacaaggctttcgccaaggaggaccacctgcagcgccacctcaaaggccagaactgcctggaggtgcgcacccgacggcgccgcaaggacgatgcaccaccccactacccaccaccctctaccgctgctgcatcccccgctggcctcgacctctccaatggccacctggacaccttccgcctctctctagctcgattctgggagcagtcagcccccactgggcccccggtctctaccccagggccccctgatgacgatgaggaggaaggggcacccaccacaccccaggctgaaggtgccatggagtcctcttaaagagggacgagggccagactgaagcagcacaaggccggggacacccatgccaagcagtgggagcacgcaggacagacacagcaggggtctggggcacggagccttgctggcatcagcatcagcccttcctcccagagccctcattccaattccaagctaagaaggtattggggcagaggctccccaaattggggtgatcccccaaggagtgatacatatattgtgtatatatttacagctgtattgtaaaagtggggtccctgtccccagctgctcctggggagtagaagcaataatgtatttctaatttgtgggtcccacttcggctatgcgggtttctagggggtgggggcttgggaccaaagccttgccccgcccctatgccccttgggggttttggctgtgtaagggggtgaaggactgcccctccctttcgagacccctccttcctggtttctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattggctcgcctgcccctgggggcagtagaggggccccgcccagctaggggagccgctccgttccactcccctccctagccctccctccccacggccctgggcagggaatgtcttgttcccgccgctccctccccggggccagagggcagggcgggccgggcggcgtcctaccctcttctcctcctccccatctcctccccgcccaggtgcgagccggagccgccgccaccgctgccgcccctgactcacgccgcccccgggctggcgcagcgaagggtgtgggacagggtaaggggttggaagagccttgtggagagcgggcgagccggcgccatctggcggccatgctctgagtgggcgagcgccccccgcggccactggagcgagctgtcttcacgctcctcatccaccccagctggtgagcggcgcccccttgccaaggcagtgggcacagaacttctcgcttggccgcaggggaaggggctgcggacctgtgggaaagtgatccccttcccagatccttgccagccgggcttcctgtcaggcaggggagaataatccccactctgctcttaggattgaatccacccccattctgtacatagcctcttctgttggtcttgttgaaatctagtttcagatttttaactacccaattctgctgggggtgggggacacccccccttcctcgctgggtgctggaccccttttgcagcctgggctctgccttgcactatttccccttcctggcctgacggctcctccccctccttaaaaggggcaggttcaggggcccggtgctcttcctcccttccatgcacccccatgcccatttgcacagctgcccaggtacccctaacagtggggaggggtcacagggagggggtagcgggaccagtccctgttatctatttaaaaagtgatgatgtaatatattggggtggcggggagatcgggttgtcctgggcctcatcttagcatttcaggtgatggggggagcccagggctggggagacctggggcccagccccagaaagtggggacaatgtggcctcccttctccctactttcggctttcccagtcagtgccttagggggagaggcactccccccctcctattcccttccccccaccccaactcccccacctcgggtgtaagcgacaggaagaaataataataatttaagattcaaaaaaaaaaaaaaa

SEQ ID NO: 1174 - DNA, 5180 bp, Homo sapiens
ggcacgaggtgagccgcaggcttcgggaggcgagggggcggggggagcagcgccgaggccgccgcctccgcctccgccgcctaggactagggggtgggggacggacaagccccgatgccgggggagacggaagagccgagacccccggagcagcaggaccaggaagggggagaggcggccaaggcggctccggaggagccccaacaacggccccctgaggcggtcgcggcggcgcctgcagggaccactagcagccgcgtgctgaggggaggtcgggaccgaggccgggccgctgcggccgccgccgccgcagctgtgtcccgccggaggaaggccgagtatccccgccggcggaggagcagccccagcgccaggcctcccgacgtccccgggcagcagccccaggccgcgaagtccccgtctccagttcagggcaagaagagtccgcgactcctatgcatagaaaaagtaacaactgataaagatcccaaggaagaaaaagaggaagaagacgattctgccctccctcaggaagtttccattgctgcatctagacctagccggggctggcgtagtagtaggacatctgtttctcgccatcgtgatacagagaacacccgaagctctcggtccaagaccggttcattgcagctcatttgcaagtcagaaccaaatacagaccaacttgattatgatgttggagaagagcatcagtctccaggtggcattagtagtgaagaggaagaggaggaggaagaagagatgttaatcagtgaagaggagataccattcaaagatgatccaagagatgagacctacaaaccccacttagaaagggaaaccccaaagccacggagaaaatcagggaaggtaaaagaagagaaggagaagaaggaaattaaagtggaagtagaggtggaggtgaaagaagaggagaatgaaattagagaggatgaggaacctccaaggaagagaggaagaagacgaaaagatgacaaaagtccacgtttacccaaaaggagaaaaaagcctccaatccagtatgtccgttgtgagatggaaggatgtggaactgtccttgcccatcctcgctatttgcagcaccacattaaataccagcatttgctgaagaagaaatatgtatgtccccatccctcctgtggacgactcttcaggcttcagaagcaacttctgcgacatgccaaacatcatacagatcaaagggattatatctgtgaatattgtgctcgggccttcaagagttcccacaatctggcagtgcaccggatgattcacactggcgagaagccattacaatgtgagatctgtggatttacttgtcgacaaaaggcatctcttaattggcacatgaagaaacatgatgcagactccttctaccagttttcttgcaatatctgtggcaaaaaatttgagaagaaggacagcgtagtggcacacaaggcaaaaagccaccctgaggtgctgattgcagaagctctggctgccaatgcaggcgccctcatcaccagcacagatatcttgggcactaacccagagtccctgacgcagccttcagatggtcagggtcttcctcttcttcctgagcccttgggaaactcaacctctggagagtgcctactgttagaagctgaagggatgtcaaagtcatactgcagtgggacggaacgggtgagcctgatggctgatgggaagatctttgtgggaagcggcagcagtggaggcactgaagggctggttatgaactcagatatactcggtgctaccacagaggttctgattgaagattcagactctgccggaccttagtggacaggaagacttggggcatgggacagctcagactttgtatttaaaagttaaaaaggacaaaaaaaaaatctaaagcatttaaaatctagtgaaataactgaagggcctgctctttccattgtggatcacagcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatgagccaaagttaataatcctatataataattgctttggctttcacctaaaattctgggcatcacaatttccttgggatagaggttgtgttggggaatagattgcttattgctgttcactggagagaaaaggtagtgtttttgtacaaggtcataccgccagaagccccaaatcctattttggctcatcttcaggtaaagagtaattcctatcctgtgtgcctcagaagctagaatcgaaggcttaccctattcattgtttattgtcagaaatgcatgatggctcttggaaagaatgacgttttgctggaaaaaaaaaaaagaacagtttgtgtttcacaaacatggcttatcaattttttcaaagaattcttttttcccaaaaagaggagtaacaaaatgtcatttctgaaagaggcttactttataccaactagtgtcagcatttgggatgccagggaacagagagtgagacacctacaatcaccagtctcaaatgcgctattgtttcttttcagagtgttgcagatttgccatttctccataatatggggatagaaaatggaataaagatagaagggatgtagaatatgctttcctgccaacatggtttggagtcgactttggtatattgactagatttgaaaatacaagattgattagatgaatctacaaaaaagttgtcctcctctcaggtcccttttacactttttgactaactagcatctatattccacacttagcttttttgtcacacttatcctttgtctccgtaaatttcatttgcagtggttagtcatcagatattttagccacctacacaaaagcaaactgcatttttaaaaatctttctgagatgggagaaaatgtattctcctttcctataccgctctcccaacaaaaaaacaactagttagttctactaattagaaacttgctgtactttttcttttcttttaggggtcaaggaccctctttatagctaccatttgcctacaataaattattgcagcagtttgcaatactaaaatattttttatagactttatatttttccttttgataaagggatgctgcatagtagagttggtgtaattaaactatctcagccgtttccctgctttcccttctgctccatatgcctcattgtccttccagggagctcttttaatcttaaagttctacatttcatgctcttagtcaaattctgttacctttttaataactcttcccactgcatatttccatcttgaattggtggttctaaattctgaaactgtagttgagatacagctatttaatatttctgggagatgtgcatccctcttctttgtggttgcccaaggttgttttgcgtaactgagactccttgatatgcttcagagaatttaggcaaacactggccatggccgtgggagtactgggagtaaaataaaaatatcgaggtatagactagcatccacatagagcacttgaacctcctttgtacctgtttggggaaaaagtataatgagtgtactaccaatctaactaagattattatagtctggttgtttgaaataccatttttttctccttttgtgtttttcccactttccaatgtactcaagaaaattgaacaaatgtaatggatcaatttaaaatattttatttcttaaaagccttttttgcctgttgtaatgtgcaggacccttctcctttcatgggagagacaggtagttacctgaatataggttgaaaaggttatgtaaaaagaaattataataaaagggatactttgcttttcaaatctttgttttctcttattctaggtaaggcatattaaaaataaatatgtaaagaagaaaaataaaagttgtcttcatggaaaaaaaaaaaaaaaaaa

SEQ ID NO: 1175 - DNA, 167488 bp, Homo sapiens
gatctttcttgcatggcctcagaaacacgtgacccacgttcagaagtcctgaaccctgaggacggaatgccagtggcaccttcccccaaatcgagtaaacaaccagcatcattcccacacatttttaaaagctgcagggaacaggacaacacaatctaaggacgaatgaaaccccaaaacttgacaattcacctataaaatataagaaaagcccttgtcgtgccctcgcatgctggtcaaagtgctctcacttacactctttttggagatgtcccccaggggtgctgggcaggaatatttttcctctcctccatgcccaccccatccccagccaatccccctcccctagtttcccacagcagaggcgagaccggctggaacacggaatgaaatttattgaagagaaacatatactgaaactattgaagagaaggaaaccacaatacagagagaaactgtaaacagccaccacaggccacaggtcccaggccccctcctcctggggttcctggcaaggcacgtcatctgctccccctcccgctgctgcccccgctgccacctccctccttcccgagggccccagggtctgccttttgccaggacagtggactctggcagtgtccactggcttcagggagccccctcctgagcccatccctatggccttcacaggacagtcacagaacactgggaaacaccagggaacaccccaccaggctgaagaaactgagtcacaagtaacaacaggggtgaaacgccaaagcatagttcttgtggatcctcacgcagccccgctgtgccccgggtccggttcttcttcccgcagtcagggtcaccatcgtggtcacggggtgagcgtccgccgtgccctggtgcctccttcccgccatctcctgggactgcgctgggggtctccggggagaggctgctcagagaagaacacacgcagctccacgagaacaagcagcccctggcctagatctacgccaggaaagcagaggtggtgctcacgatgcaggacagcagcaagcagagcctgggctcgcaggaagctcacagcacgtgccccgggcccagaggtggccgcctgcatgggcgcacagtacatgacttttcgcagaaatgatggctagcagtgggtgggcgtctgctgggcgcgtgggtcacacaggtgagggtgagcttcccggaacagagggcagcctgccccggagatggcaagtgggctgacccctcttgagagacccaggcagctggcaaccttgagagggcctctttccccctgtctctcccaactcacggcctgggttgggggcagacatcttcaggtgcccccacccaggccacagctgcccactcagggctccctccaggccagccccccgtggcggcagggtttggggctggggctgggtgtgctgggtgcaagggagcgggggggcgcctctccccaccccattttgtatcaaacgtggtcatccgggtcacagggaaggaatgggggtggtgaccagagccccttgggggaggtggggggcccttactcctgaatgtggggtgagggactggccctggcctggcctctgtctgcctccaaggcgctgctgcctgagaggagaggaggccccggggccctaggagcctatttgccctgggaggacttgggctggccctcgtccccggccccatcctcatcctcgttttccggctcctccaagatggtctggagcccctccagtgggggtttcctggcttcctggcctctcacctggatgaggccctctggaccccagctaagacctcttgggaacacccagacagcactgctcatccgggctggggaggagccccaggggacctctatgggccttgcctgacctaggccttcggggcctgcaggggcactttcaccttccccagcggcaggggctccccttgcagcctctttggtggcagaagcggcctcggcagcatcttctgctccgggaccagcctcgctggcattcccctgggctggggaggcctgggcagcagctgggtcttcactctccactggggccgctgcccaggccacaccctgctggctcctcgctgggaaggctgcccatgcctccatctcccggatgagccggagcagccccaggaagccaggtggcctcttctccagctgcatccctctcagggtatcctggagtgcctcgctggggcgggcccaagacagcacctgctgtagtcgcaggtaattggccaaggctgggcagacggcccccttctccacagccctctgcagcaggccttccaggcgcaccacgaaggcaaacagcccctcctggggcccctgcgtgcaggtcaggaacttcagcctcgaagtcattcgagtgtcctggttcctaaatacctgccccagcgccgccaggcagtccagcgcggacaagttggtatcttcctccaggaggccgctcacgacttccagggccgggccgcccaagctctccagcagccacctcttcttctccctttccgacgcatggcaccacagctgcagcatatccttggcatgctccacccagctctcaaaggactcttcctcgcagcctggctgctccctcctggaaaagggtctcaattcccggtaggccctgttttccagcacaggctgtagggtgcagcgccaaggctggacccaggcttttgttacatttgtccctcctgcttcacccacagctcctgcctcacctgcagctcctgcctcacccacagctcctgcctcacctgctgctcctgcctcacccacagctcctgcctcacctgctgctcctgcctcacctgctgctcttccctcacctgcgcctcctgcctcacctgctgctcctgcctcacctgcgcctcctgcctcacctgctgctcctgcctcacctacacctcctgcctcacctgcgcctcctgcctcacctgctgctcctgcctcacctacacctcctgcctcacctgcgcctcctgcctcacctgctgctcctccctcacctgctgctcctgcctcacctgcgcctcctgcctcacctgctgctcctgcctcacctacacctcctgcctcacctgcgcctcctgcctcacctgctgctcctgcctcacctgttgctcctgcctcacctgtgcctcctgcctcacctgctgctcctacctcacctacacctcctgcctcacctgcgcctcctccctcacctgcagcttttgctactgcttgaccctggggctgtgcaggaaaactgggcatatcctgaaactcaataacaggtacttggggcaggaagatcactttccagggccccccattgcctggtatttgatggggaatcaagcttcggtttaaatactcagcgaactccaccaaggctgccttggccccgagctcctttctgaagtgcttggtgagtactcggtacctgcccaggggcgacagggcagcccgcacggcctcctggaactcatgttccttgcagtcatcagggatacccaggatgagcagggagcgctctgcgttcgcacccatccacctgcaccagtcccgaagcatcgccagagccatcgcagaggacttgagggagggagcctgatcaatcaggaatgtgtgctgactgttgcagtctccgacacagcctgtgagtgcaaagagagaagcttgtttgtgccaaacactcactcccaccactcatctgcccctacgtgtgtgggggtgagggggcagggctggagttcctctgcctccttgttttgtcgctttgattttagtgaaattttgatggcaaaattaaatttatttgcaagatacagggctagtcacattttctatgctacttggtgccatttgtagtaagttactttttttcccccacaaaggaattgggaagcttatctcagttttcaaaacttttgataaaaacttgttcacaatattccctctttatctttttaatgtctatatgatctgtagtaatatcctgtccttcattcctgatattgattagtgttcattctctcttgtgtgttgtgtgtgtgtgtgtgtgtgtgtgtgttgttttttgtttgtttgtttgttttttgagacagggtctcactctgtcacccaggctggagtgcagcagcttgatctcggctcagtgcagcctcgaccccctgagctcaagcgatcctcccacctcagcctcctgagtagctgggactaccggcacatgctaacacacgtggttaaattttttgtactttttgtagagaaggggtctcactatgttgcctaggctggccttgaactcctgggctcaggcaatcctcccgcctcagcctctcaaagtgctgggattacaggcataaaccactgtgcctagccccctctcatcttaattagtcttgctagggttcattaattttggtactctttaaaaagcctaatatcggggtttactgattgtcctttttatctctgttatttctttatttgactcattctgtgtttacttttgctctttttcgagcttctttaaatggactgttcggccattgattttatgttctttttttctgttatgagcactgaaagcaagaaattttcctctgaccacttccttccttccaaatggctagtaatttgggtaagttgaatgttttgtgcagtttgaaatatcttgtaagttccttggtgatttcatctttgacccatggatttcaaaatatctagacatatgttattgttattaatttcaaataaaattccactgtgatcagagaacttatgaaaacgtgcgatccttttcagtttctgaagatttttaaatggctcgacatatggtctatctaagtgaatgtacaatttgcccttgtcatgaatccgtattttctacagaggccaaggtctgccccctccaaccactgcaactcctgtcgccattccccacgaagaggcgacctgaagcctttccaattccacctgtagggggccaggctcctcacggcactgccacgccgacagcctccagggggcgctcaccgtcgcctgtaccactggccgccaggcagcctccggctccgcaccccgtgcacccttaggcattggccctccttccagcccatcccccaccgcacaccggggacagtcccttcctgcccccaacgtgcccttccacactgggcgccccctaaacccagctggcagcactccagtctagccccgggcagcagggcgtcccacgtgcttagacatgagcctccctctgtggcctccccacagccaggggcccgacaatcccgccctccacccccaagtcaggagcccccatagcccacagaggcagggcaccctccgctctggtcggccctccaccgggcttaggaatcacctctgccctcacccacccagccctaggacctgaccacggcacccgccaggggccgtcccctctcgcgcctcagacccaggctgggccgccctccgtcccgccccacgcttggagcccgccagcctgctctcccacgtggcgctccacagcccccttgccctcccaccccagggagccccctcccgacccccagccccacagccggaagccctcgacaccccctcaccccagcactgggcgagtcaccctccctcttgcctcttctaccccgcgtgcttggcgaccctctccgcccagggacccaggggtcctcctctggccaccccgcactgaggaacccctcccctcagccctccttccaaccgccctcccgagggggccttccttggcgggaagcccaccgtgacagccacgccgcacctaaaccgggccaggcgggaccgccgccccccagctccgcagccggctcctcacggcctgccacaccgcctgccccccccccacaccccgggaacctcctgggccgccatcctgagctccggcaacacctcctgggcctgggtcctggcaaacccccgcggtctactcactttctcaaactctgggcaattccgggtctctcagtgggaagtcagatatctgggtctctccgaagggtctgaagagatcacctcagctccgcagcgtggaagcgtgtggctctctgaggcacttggcgccaacagtcacccgggctcccagaaacccctggttctcccggaagccacagggagttccgaaagaaagttccagactggtgtcgctatgcaaggcaaatgattggatagggagagcacaagagaggagcacgtgggaatgcactgttgttaccatgacgactacacgtgaatcaaaaggtggaaaggctcgaagcccagaagcggcaggcacaccgattgaccctccgccaatggaaaggcctgcccacgaggatcggcggagtacatttgcaaagcgaaagttcattgcggtaaatcggtccaattttttccactgtttgctttccaatgtgcttggtaatgtcataaaaagatcctatgttttgttttgttttgttttgttttttgtttatttggtttttgttttgttttgtttttgtttttgtttttttagactgagtcttgttctgtcgccaggctggattttttttttttttttttttgagactcgctctgttgccaggctgcagtggcgcaatttcggctcactgcaacctccgcctcccgggtacaagcgattctcctgcctcagcctcccgagtagctgggactacaggtgcgcactaccacgcccagctaattttggtatttttagtagagacggggtttcaccatgttgaccaggatggtctccatctcttgaccttgtgatccgcccgcctcggcctcccaaagtgctgggattacaggccctatgtttttattgatcccttttctagcagtaacaatgactggggcaggagtgttaaaatctccaattataattgtgaagatgccgatttctgtctttattctgtcaacttttgttttatgtattttgaagctctgaagctctgttattgggtgcaaacatatgtatgaattcgatgtgttcctgattaattgatccttgtatcattattaccttttattttaccttttcagcaataacattttgcattgttttctagtggttgctctagggattcctatatatatcctttacttttcactctctacttacagtttacattgtaccacatcacctaaatttaagaccattttcattatacagattactgccccctgcaccccgtcctttatgctatagttgtcatatatatatctacatgttataaaccctataatacattatttataattttaccttaaactgtcatgtgtattataaataacttataaagataaaataaatattccttgatatttacccacatattttgttattcatttctacccaaagatcgagatttccttcttttccttaagatcgaaagtctttctgtagcatttattttaatgcaagtctgttgatgaattctcttagctttcatgtatctcgaaacatccttatttcaccttcattcttaggagtattttccctggatatagatacagagttctgagttgaaaggattgtttcttctctctcaccactttaaagatcctgttccattctctcttggtttccattacttctgatgagaattcagtagaacttgtgaatgttctcttcttcttcgagttgcattttactgttttcacaattcactcattactctttgttttcggtactttgactgcaatgtgcctacacgtgttttttctttgtatttatcttccttggaattcactgagctccttgaatctgtaaattatgtctatctccaaattttggaaatttcagtcattatttcttcgagtagtttttcttccccattctctcccttctctcctaggagtccatatacacattcattagacctctatatattgtcccacagctcactgaggcgcccttttcattttttcctcttggtttttcagaaaagattatttctatttatctgtaagtttgcaactcacctgtcatctacaatgttattaagatcatccagtgaagattttacttccaatgttgtttttcagttcagaacttacccttggttctttacttacacttgcaacttacacagtccttgatttatgacggtttgacttatgatttttcaactttacactggctttactgggacatcaccccaacctaagtcaaggagcatctgggtttatcgggacattaaatgcattttcaaattaccatatttttgacttactactggtttgtcaggacttaaccacagtaagtcaaggaacatctatagtttctatttctcttctgaaatttcctatttgaaaaaattcataatcagtgagcagtgagatgggtttaaaaaaaaatgttaggtggctgggcatggtggctcacacctgtaatcccagcactttgggaggctgaagtgagcagattgcttgaggtcaggagtttgagatcagcctgggcaacatggagaaaccccatctctacaaaaaaatacaaaaattagctggatgtggtggcacatgcctgtaatcccagctacctgggaggctgagatgggaggattgcttgagcctgggaggtggaggttgcagtgagccatgatcacaccactgcactccagcctgagtaacagagcaaaactctgcctcaaaataaataaattaataaagtattagaagcatgcttctttttttttttttttttacacagtgtcactctgttgcctaggctggagtgcaatggtgtgattatggctcattgcaacctccacctcccaggctcaagcaatcctcccacctcagcctcccaagtagctgggactacaggtgcacgtcacaatgcccagctaaattttttgtatgttttgtaaagacagagtttcaccatattgcccaggctggcctcaaactcctaggctcaagcaatccacccacctcagcctcccaaagtgctgggattacaggcagaagtgtgctttatctccttaagaatatatatttttttaatattgtgaattactagggtcatctcagaggttggattctcttgaatgcttttttccttgagtatcaggacaattcttgtttcttgtagtaatctagcattatatcctagacactgtccataatgagttctagtagctttggcttcttggtttctgttatatttctccgaagatgagtcattgtttgttattgttgttgtggtggtggtggtggtggcggtggtggtttgttgtcctagtagacaactaaactagctaaactcacactaagtctcccctgtgttgggtatcaactgcaatctccagactccgtttccacggtattgggcatcagctgaaacctctgctcagttcttttcttggactctgccttgtgtattaatagccctggggtcagccagagatttgggccaagtgtacaggccaaatacggggctcctccacatggtgcttctctgctcccaggtgatacccctcatgctttccctctcccgtggccatcccaaagtctactctctgagtctctgagttttggtcacccagcacggtgtcctctgtggcccatgctcacatgtaagaaactcacctagtgccagtctcttcttcgaggtgttaaccccctatggtttctgcctctactgcttagtccctcatgccatcagaaggttttgttgttagtatttcatcctggtttcatagatgtcatctgtgggagggttggtctgataggagtgactccaccattgccgaaggcagaacctgacttaagttttaacaagatccctggggccaacactatggcaagttttaacaagatgccccggatgacagtttcgctgtcgccttgtgagtgaccctaagccggaacctcccagctaagccaccaggagtaatttgttatgtagtgatagataactaaggctctaacccccactttgcttcaagtgttgtcgcctctccaacccatcctctcattcatgggacctgatgcagttatcataggtgactaaaaagaggatttgaagaatacgtccacaaactctgtgatactcccctttcaagaggtgtagctggatccctctccctttgagtggagtctagacttagtaacaaagagttcagcagaatctgtgggctgtaactggcaagcgtggcttctcagagaaggcagcgtgtgtcttgggtgctctctcttaccttcttgcacttgtttcccctttctcctttcctcccccgccctttcctccctccctctccctttccccacccttcactctgtctccccacacacacatagatccccctgcctctctcactctctctctctccctcaccccccaaaatagatcactgttttgcaggaagccctgctatgagcagccctatggagaggcccacgtgctgaggaactgagctacttgccaacagccatgtagccacgtgagtaagcctggaagtggatccctcagccccaattaagtctcagaggctgctgccctggatgaaagtttcactgttgcctcatgagtgaccctaacccagaacccctcagctaagccattgggagtaatttgttatgtaacaatagataactaatactctaatatccccttaatgcccagcagtctacagtggccggtgagatttcctccaagcctactcttctgagcagcattgtcttagtaaatggcaccaaaagtcacccagggaggcattgcctggtgggccatcaatcccgcaagtaatatgaagcctctaaatattcataaccatgaacagacaccaatcttagaggaaagatgaagtaagaagagtcaaaaaaggactctgcagagagctgctcaagttctgagaagcaaaccaagggccagtggcatcctgagcccggggaggggagcatttaaagcagcgggagattcgacggcatcggcggagagctagtccctcagggttctcagttgcacataacaggaacagactggctgatggaagcccagggaaaaccagctagagggtatcccacaggcgtacctcgggcctcacactcagtgggtagtgggtgtatctgattggtagagcctgggttaggtgcccatgccatagctacaagggaagctgggaaagcccagacattttccactcctcttttgggagggaagctccccatcaggtgagagaattgcatgtgcaaaggtcctggagctggaagggacatggagagtactgggctgaaaggtcggtgtgactgcagggttggggatgccacgcaccaatgctgcggaggccagacagtgcagacctcatggacctcagaggggtttcatcttcatcctgaaaaagctgagaactcactgacagatgtgaagccagtgctgcacatgcacgcacagacatgtatttgtgtgagtgacacgaactcattgcattctaaagagttatctctggtttctttgtggagaaattatttggggaccagagtggatgcagtaagactagctaagggtggctggagttgtcctgtgagagataactagcctagatgacatcaaggacagtgtcatggagcagatagagagggtccgtttaacagacctaaaacgtgcagagaactaaccagacaccgtgaatgatgggaggtggagggtgggcaagggatgtatccccactttctggcctttgacacaggcgtgttccattcactgcagctggggacttggtaagagcgctagccctggcacgagatcacaagctcagttttggatgtgtgcattggcgcatccaagtgcaaataccaaaaaagcaggtgcatccaggtggggacatgccaggcactgaggctggggaggccagccaagaggccaggcacagccacgctccagctcagcctccgggccagtagatggctaagccttctcctctgccaggaagtcttggcaaggctgggtgactcttcagctccttacccttggtgaccctcctggctttggtccctatcacctgaaggaatgtctggagactagacactgctggctgccctcccagcagccattccccctcttttttcctcagtggactcctgcttgttttagagtcggggtctcgctctgctgcccaggctggagtgcagtggggccataatagctcactgcagcctcaaactcctgggttccagtgatcctcccacttcagcttcccaagtagcttggactacaggtgcatgccactgtgcccagccaaaacttttttatgttttgtagagatggggtctcaccgtgttgcccaggctgatctcaaactcctgatctcaagcagtcctcctgcctcagcctcccaaagtggtgagattacaggcatgagccaccatgcccggctagaagcccctttttgttccagcctccgtccctcccccacgtggctcagggcatggtgactcccatccccaaatccacaggtggctcctgattggttcaaatgcagctgcacatgtgttcctggggcaactgttagtgatccgagcagtccatggcccaaatggcccagtcagaccaaagggaagttttcagattttatccacagaggaggggcctctctttccttgagcaggaacaaggaagcacgtgatcccagcggacactgacagacattctctagcacacaggcagcagcctgaagccagagccaagacttgaggttggaaagaggctggggcctgggtgacagctcaggacagtgaagccactggagggggcaccataaggatagctgtggccacactgggagggatagttgagaaacagttgtgatcagactgggagagtcagtgaagggagagggaggccgtcctgggagggacagtgagaacggcagtggccacactgaagaggatcagcagagggccagtggtggctcccctctgggacattcaggaaccggagccacagctgcagccatgagagaagctgccactcaggcagtggacggccacctcctggggcaggtgcccagctgagcttcagggcctcaggcttctgaaggccaagacagcctgccctgaggcctgggcattgctccctcctggcacccaggcctgacactattgcccctaccggcctcatcctgagggtcccatcaatcctcaggggtcgcagggttggacaaactggcccacatgacacaaggcattctccatgccatgagccacgcagtactccgacccttctgcagggtcaaggagcaacctgcgtgacctgaggcattgccgcgtgcattccatcccctgctttccccagagccactgtctcctgggactgcagcctggacatcccctcccccactcactggctgcaccccatctacagcacttttctggcaggggggcggaggcaggagttgcaaaaacagctcatccagtccagacacacatcctgtccccacaggagctcacagtcgccatcaccctcagtggatatctgaggctggcagcatattcccaaggctctgcatgcagcccaagaccacctccctccaagggcactccagcagagcagtcagccacagcccagctgacccctgggagaggtgccgccctgacccctgccctgctgtgaaggtggcttacagccccctttggcctggccttccccaacttgctcactcacttcccacagacagcttgacgtcaccctggacctccctgctgggcccctgggcacctgctgtggcttgggagaccggctgccaacctgcccccaggagggggctgcctgtgacctggcgggtgcccacggcacagtgggcagcaccacagctgtgggaaagcgcccactcccctgccccccggctacctcacctgcccgtcctgggccagcctagggcaaggggagaacgggagaccagagctggggagcagccaggccagccggactgtgagagggctaggtgtggtgggaacccagggaggaaaggggacctccccacttccagaccccaactcttcctccccaggttctgaatccgggtttgctgcccgggaggccctgcccctgcctaaagcagagatggagatacctctctcaggaggccccaggcctcagggccacaataaggggagtggagaggaggagagagggccgtgtgaggaccgccgggagggcccgtgtgccctgtcatcctctctaggttgggcatgggtttgcagttctttacagtaaaaaactgaaaacatgctggaagggagattgatctcccgacaggatcgtgggcttgtcaaggtcgtcttcacttgctctaggcgtcgcgctcttcagctgaccgcgctgccgcctccaccaccaatgtgtccacacacgcggtgccaacaatggtgcacacggtgacccctgctcccccatttctaagcttgtgtgggacccgcagcccagtgcacatggccctttctcttgcagtggaagtggggtgcactcccaggggcccccttcccctgcccgaggcacacactccccagcctccatgcaggttggccgctcacactctctggaaatgagccaaggacaacaggagctgccttcccaaggtcgccccagtccccaccaggttactggatgatgcgggtgcaaaggtccccccgccccctgcctccatggcccaggaggactctgggctcagcctattccctcgtgtcggagtggcctgggctgccgcagcaaatgaccacaaaccgcttggcttcagccaacaggaattgactctcccagttctggaggccggagtccagaatcgggcgcttcctccggtggctctgggggtggatccacccacctcttccagcttctgggggccctgggcactccccaccttcgcctccacatggccttctctgtgtctctctctcctgtctcttctaaggaaactgtccttggatttggggccccctggatcatctgggttgctctcatctccacatcctcaatttaatgacatctgcagacaccctttatttgcatataaggccctgatcacagtgcctgggtgttaagatatggatgtatctttcaaggggcaccaaccagtcaccccacaacatctcaacagcccagatcccagcctgcccagccagagccccggtgaagggacaagcttgggcaccaggacacacagctgagggccaccgggagactccctgcctctgcgccgggaaaggggctccgaagctctccctgcactgggccccctgggggccctgctccctgcaaccggaggttccctgagcagcgtcctcgcccttcccctatgccccagatggacggcttttgttctgggagcgcaggcttgccgagggctccttgctgcgggctaagtgctcctggccagggcccagggtctctgaagaaaagaaacccctgaactctggttcaaaggccaaggaggctcccgcctcgtgctcagttcccagtggccggggctgggatatgtgatgtggctgatttttccctgttgcttttcttttacggtctttttcatacgcttcactatttgtcaaaggtctcacaattgtcatcagagcaatatcccaaccaaccttggatttcactccctgctctaccacgtggagcatgaccctttggaaaatgacaaactccaggtgcgatcccctccggtaacctgagggaaagccagatgcacccagagggtcttggcttcttgcacttccctgacctcctttttcccctcctcgtgtctccacaccatgctccctgagtcacctttcacctcttccccgctctctgatccttgccatcctgggtcactcctttactgagtgaccatggccggggtacttggtgctagctgccctgcagaggtcccggggaccccagcgagatgaataactgaatgaatggacgtaataacgcccaggggtctagcccatgggaggtgttctgccaacgcgggtccctcccgtccccttcaggagccgcggtgcgctgaccacttcgaccccagccttcagagcagcccagacagaaagcggaagtgcctcggggcgcgtggggagccaggccagacgcccctgtggggcgggcgcggggcgggccgccatccctctgcgccgcgcatgctccatgccccccccacaacgcgccccgttcccacgctgccgccgccccggccccgcccgctcccggcccgctcgtcggcgcaccagactgagactccccttcaggacgctcttcgcgagcggtacccagaggcgaagtcgagacaagcccaggagcccccaccccccgcccgcgtttcctggggacgcggcctcggagggcttctaggaggaggcggcggccttggcctcgggcctgccgggagcaggaagggaggccgactccctcggctgcccgccgagcccaggtaagagggccgagctgggccgcaggggtgcgggtaagcgggtaaggggcccgtctcggcagggtgcaggtgtcgagggggacgagggagctgcggcggcggcgacaagcagggactccctgggaggcgggctagcactgagtggccggaccagccctcggggccgccccgtaccaggggcgccaggggaagagccatccagggctgggcgctgggagctgcggcccgtgtctgtcaatttctctcctgattggtttccagccaccggtcccgaggctggctaaagagcatcctgtcgctgatctgcctggtgagtttggattttgcacctctgggtgtgagagtgctgggcagactggcattgtgaggttgtggcaccgctgcccaggcaccggccctgagggtctccagatcggggcaggatgcccaaaattgtgctccagagggtatcaggtgggggctggtgcctcgcggtggtgcgggatgttgaccaggtgactggcatgccacggaaaagcatcagcttagccaagccaaggaggaagcgaagggccgatggaagtggtgggcaagggtgagagaaggagccagctgagctgggcagaaagcggcacccagcgcttccctacagggctagttgtgactgattcactcccacagatacctcctgagcaagcatttgagatctgccagggacacggcggtagtaagccctgccctgttgttctcgttctagtggctgagcgcagacaataagcagaaaatgttttccattagtaattacagagtctgttaaaaggcagtaagagccggggaagggaggtctggttgccagtttaggtggttagaataacttattctagaataagtctcatttctaccaaaacttgaaggtggtaaaagagcgaggcatgtggttatggttttggaagagcattctaggcacaaggaatcccctgtacaaaggccctgaggcaggggtggcctggctcaagggagcaagagtgtggcaggagcagagggaggtgcagaggtgggaggagggttgggcaaggtcaggaagggttgtgtgagtttactctgagtgacacgggcatcccagggataactgtgagcagagaaggacaggacccgacccgcctgttagaaggatccctcagcgagcagcctgggtggcccccttttggctaggttaccctctgcccccagagggcaaggcctgcccagctgcaaggaagctcctcagaggactttttcaggctaggctgcatggagggccccggtcgacccatgcagcacccaggccgggccttggctctgggtttctccagtttccttctccagccgttctgccaggtgggcagcaggtgactagggcctcgggccaaggaaagctgatggggctgagagaagcaagatcccccaggacggaagaaacccaaccaaagtggtgatgcctgtcccttgctgtggatgaaaaagcccaaattcctgctcccaccgagtgggactgctggatgcttttctgattgttgtttgtttgtgtgggttcttttttctttttctgggaatatctccccatctagtggtcgtcttaaggcatcctgctagagccagctctccccttggttggccaggcttccttgctggcagtggccctgctctcatccccttcccagccctccccgcgtggagcaccctgcatactcagttccacccataggctaaggtccgcaagcaggggtcccgggtccgaggcccctcacagaggtggagcagccctggaggggccggcagtggcaccggtcacccaggttgatgggcctttctggctcctcacctgaggcgccaaggtctggtggattctcacctgtgtgcccgatgctgtgcctcggggaagcctggcttcagagcccaggattatccttctgcttggcctctgctctgctggtccccaaaggtcacagggtcttgctggtccagctggaagaagctgctctctagttccgccaggtgccttccaggtgcttctgtcctcagatgcacggagtagtgcccacctgggtgttatttgagttctatgggcacagggtttgtcgtgtctttctttccaggagttgaaattgtagatgattttcgggaactagctctcaaggacaggcactgctctgggtgacggcttggtgtggccagcacctccgctgggtcttccgatgctgcacttgagtgcgggtctccgtctctgggcggcctcccgccgatggggtgttcactcagggggtcaccactcaacagtgctctgctcccttggggctcagacctgcctcagtaatcttggggtggagggactagagataactcctccccctttcaacttgtccaaaatgggtagtgaactttcagtactgttatggtaaggaaaaaaatgagcttatgctgcttttcaaaacaataattttatactagtctgaaagcactggcaaattatcagtaatacctccccacgcacctttagttttgcaggggtcccagtgactgacagtgtgttataatgaaatgaggtgtggcctgcggacattagaatgattttacctacaggaacatttcttttccctcctttttgattgaggtgagattcacacaacataaaaattaattttttgagacagagtctagctttgtcgcccaggctggagtgcagtggtgcaatcacggctcgctgcaacctcaaccttcccagttcaagccatcaccccacctcagcctcccaagtatctgggactacagacacgcgccaccacacccagctaattttatgtattttttgtagagatgggatctcactatgttggccaggctggtctccaactcctgagctcaagtgatccacccacctcggcctcccaaagtgctgggattataggtgtgagccaccacgcccggccaaattaaccattttaaagagaacaattcagaggccatttagtacattcaccatgttgtgcagtcaccacctctacctggctccagaacattctcatcgccccataaggaaacctctagacccattagcactcactccccatccccccacccccgggcacccaccaatctgccttctgacatgatggatttacctgttctggacagacatgttttatgagagttaaaggttctttggatgacaggaccctgggatagatgaaaggcacagctttttgttctgtatagctctgaacgagagaaggctgccaggcagggccacacagaggttagacccggggaccgggaaacagcagctggggccggaaggggccagcagaggcgggtggctaggtttctccagcttcctttggattgattgagttgcataagttttcaggctccaggacataggggctgtccctacttgtctggtgcctggccccagagtgtgggggcccaatgaggcaggggccgttggagtgtgtgtttggtggccccagagagagggaaattgtaagaaaagtggtgggagtggggacttagcaaactgccctcgaagggcatagagatgagaggttttagccactatttcaaaactaggtcaagacggctcttgggaaatgtgatgttacatcacaaaatggaatcatacaatatgtgacctttcaagtctgcatctggcttctttcactgagcagtgtcctcagggttcatccacatggtagcatgtgtcagaatttcctttctttctatggccaaatacttttccattgtatatataggctcatggtgttggtccatccatccatcgatggacatttgggcttcttccacctttcggctctagtgattaatgctgctgtgaacacaggtgcgcaagggtttgtgtgaaccacctgttttcaattctttgggggtatatacccagaagtggaattgccgggtcatatgataactatgtctaactcattgacaagccaccagtctgttttccatagtttttttttctttttaatcaccatcttgccttttttgtgtcagcttttctctctttctctttgtgaaaggttttaaagtaagttgcatgccattccctcccccaaatgcttcaatatgcatttctttaaaagggacattttcttccatgacccagtgccactatccatccaacacatgagcagttatgatcccctacttccttccgagggccaccccataatcaccctctcccaatgatccctaatccctttgacgactctctcatttacgccagcatctcattgacgacccctcttgcagttgggtgttggaccccgtaaatctcttttcatctagaacagcctctctccccagtctcctttctccccccatgacactgatttgcagaggatacgggacccgttgctctatggaacagcccctttctgggtcaggcaggttgcttccttgtggtgtcatctattcccaagggcctctggacactggacattgagtgccaaggctgcgttcaaatccagtcatatggctttggtaggataccttcctactgcatcctggcagcaggactgtcccaccctatgtcccactgctaggttagattactctcttgcagccctcaaataatcacaggatggcattttgatatgtgatacccctttctctctcaagtctttaacctaatggtttagcatccattccaccttcagggattcagaacatcagcttatgtatcttggaccaatgttggctggcaggtcatcatggatgataagggactttggagcaatttaaatgccaggcaaatactgtggctgtccttctctatgctcctgggatcctgtgccctctccctctctcctgtggcgttgttggcacaaacaaactgtagtcacccattggaacatcaataaaagcttggagaccaacaaaatggaaatcccaggcagagaagcagagaaaccaggaagtagctggtgggggcgtgtgctgagaaaggaacaatcttttacccccctgtcctagtcctcctgtgttgctgtacaggaataccagaggctgggtaatttataaagagaaaaggttgctttagctcaggattttgctggctggaaagttcaagactgggcgtctgcatctagtgagagcctcaagctgcttccattcagggtgggagtctaaggggagctggtggcgcacggcatgtgcagagatcacgtggccagaggggacgcaagatgaggggaggagccaggctctttttaacaatcagctctcacagagcaaggactcactcacccctgagggagggcattaatctgttcatgagggactcacccccacgacccaaacaactcccatgaggccccacctccaacactggggatcaaattgcaacgtgacgtgtggagactcagatatccaacccacagcactgactgccatctggcattgagaactgctgtggagaagtcctgaggccgaggtgaattttgtccactttgtcaatttcatgttccctactcttagcctgaaactcaacttcctgctgtccctccagggtcccacgtggtgtcatcctctgcgcctgttccctaattttcagcaccacgaatgccaaatgcaggaccatctgagggccagggtatgtgctgtgctgttggctggctactctctttgccacttgcagcctccagctctctgcctgaatgtcaccccttcagagagcacccccactactgtaggtcccccttgattctgcactgccctcacctctcttctcttcattttgcaaagggaggtcgtacatgtgcatttggagtttccttaagaatcccgacctgagggaaggggattggcagtggagcttccaggaatggctggaaagttggggtcaggggacgctggccacatggggagagagctaagaaaagcagcaaaagaagaaaagaaaggaaagaaggaacgggctccctcgaaagcctggtcaggcgagcgccagtatggaagtgggcatggcacctcaattgcagagagtgtcctgggtttgaatggtgccccccaaaaagacatattgaagtctcaactcctggtatctgtgactgtgacctcatttggaaagggagactttgcagctgtaatcaaggtaagatgaggtcatactgtaggagcagggtgggccctaatccagtgattggcattcacaacagaccagggaaattgggacacagacacacacagagagaggatggccacacgaagacagaggccaagaaggattgctggaaaccaccagaagccgaaaatggcgagaaaggggcttcagtggagcgggggcctgccagcacctggatctcggacttctggcctccagaaccgggagagaaaaatgtgtcttgcttgaaggccccgatttgtagtacttattatggccgccccaggaagccatacagaaggtctgatggtgaggggcccttggtgaagctgcaggagtgagaacaccacaggtggccgctgtgcttatttcacaagaaaaactaagcagggtcttcaagcaggtcgcagattggctgctccaggctgccctgggctcacagggggctctttgcatttcccttagctcctctgcgccctggtgatggcagccattctcctgaccacgagacccaaggtgagtggtggcccctctccctggcctctccccctggcagcccccgtctgctgcctcctcatgcccaggcctctccagctgggctgagcttaggctgcccttagcatcgttttcctttcctgaggcgcacaatctgggcttcctgcctctgtcggctgtgctgcctgtttttctgtcttacaactcgtgcaacccgagtctttccacctgctgagccttccagggctccccccgccccccacattttgtttctgtcagctcctccaggggcccagggggttgaattcccctgtggccacaagaatgccttattttaggtgccagtatcttttgaggatgtgtccgtgtacttcacaaagacagaatggaagcttctggacctcagacaaaaggtcctctacaagcgggtgatgctggagaactatagccatttggtgtcactgggtaagtgatccctccacgacatacacacacccagtcccacctactctgtctctgggctcagtttatttccgagattcctgtttgtcggttgctatgagcccaagaataaatgcatttctccatcagaccagtaatgccagtaatccattgcaggccagccgccatctcagtaggatggtttttagctaagtggtctggacctgtaaatgttttaggtaaatgcgttggcctgtaagtttcagtaccagtcttatcttgtgtataaaatcgtggatcgactaaaggtctttctactcaaaagagagatgcaaattctactggaatatttatgtgcactcttttagacttaattcgtttctatgacggctgcattttgcatccgttccactttgtaaaatttagcaacatcttttccttccattgaccagggaggtcccacataaggacaaagtgtagacttggatttcaagccttgagaagtcccgggaggagctggggcagcttggagcacactgctctcccccttccatgccagtgcacacccactgccggaaggggcagcaattttgccaattaaagggcaaaagcaggagtcacaggctagacggatgggggccggagcactcaggaaggttttcaggtggggtaaagaacgtctgagggtgccagtgacttgcccccacctcacgcagctgatgagagatgcatgcgtgaaacagagtgggactgggcctctggcttttcccccagtgtgcccagcaaggctggctgctgcagctaagctcagacactccacttcccagtggaaatggaaacactccacttccccttgccgctggaggggaaatccagagggtcttcaacattgcactctactgcctttggggttgtgggagtctgactccacagattttgcctctgtaatctagccccatagagggaaagcagcttcatcccctggattccttctgacactcaccaggcagacctggggttccagggaggggtctgggatcctcagtggagttggatgatgaaacagggcaattcagctttcggggcctatggctgtcggcctcccaatagtccctggggcttgcaagcccttcttctgtccctcagggtgcccacacacatccccgatttctcatgagcttctcagcctccctgcaggccaggtgacaaacacagttgtcctcatggcccaaatcgccagctactgaagatctccgtgcccacctggccctggacgcgcaggagcccttgccctcgtagagggacttggccctttctctgagccttcccagtagtgctttttagagagttctttattctctgttacctgaagatattgagaattgcctgagttcaggagcgaccctgccctcagccatagtggtcttgacctgcttcatattccacgcccaggattttccttctccaagcctcacctgatctcccaattggaacgaggggaaggaccctgggtagcagacatccccagaacctgggccaccgcaggattgcacataggtgagtgagaggtgctcaaccagctccccatcggggtaaaaagaaatagcagtggcaaagggggcgggggagggtaccctgccgctttgggtgggaaatcctctttggaggcagatgtcaatctccaggtgtcacagcagccccgctatctccagcccatcctcccgccccttcatctctcctgtctgcctgtgtgatggctttctgttctgtggtcaccttgccccatccccctatgttctcacctcctgctcgttcatctctctgacttggcatgagggtgacactgcctggtgctctgtctttccaggtgacagaacacagagcaagacgtcgacttcaacgcagaagcattctggacgacaactccccggggccgatccacaaggtggcaaggaggggcaggcggcgaggtcgtctgtgctccagagaggtgcccagggcttggggcagagttcggctgcggggccgcagggccccaaaggcgcggagaagcggtacctgtgccagcagtgtgggaaggccttcagccgcagctccaacctcatcaagcaccgcatcatccacagtggcgagaagccttacgcgtgccccgagtgcggcaagctgtttcgccgcagcttcgcgctcctggagcaccagcgcatccacagcggcgagaagccctacgcctgccccgagtgcagcaagaccttcacgcgcagctccaacctcatcaagcaccaggtcatccacagcggcgagcggcccttcgcctgcggcgactgcggcaaactgttccgccgcagcttcgcgctcctggagcacgcgcgcgtgcacagcggcgagcggccctacgcgtgcccagagtgcggcaaggccttcagccgcagctccaacctcatcgagcaccagcgcacgcaccgcggcgagaagccctacgcctgcggccagtgcgccaaggccttcaagggcgtctcgcagctcatccaccaccagcgcagccacagcggcgagcggcccttcgcgtgccgcgagtgcggcaaggccttccgtggccgttcgggcctcagccagcaccggcgcgtgcacagcggtgagaagccctacgagtgcagcgactgcggcaaggccttcggccggcgcgccaacctattcaagcaccaggcagtgcacggcgccaggcgccctgcgaaggcggagacggcgcggaggctagcgggccctgggagcaccggccctgggagcgcggtggcggccaccagccccccgcggccgagcacagccgccaggccttccaggcccagccgccgctgactccccgccagcgcacccagggcgcggccggtctgcgtggggggccttcctggggacgtcgaggctcagcccccttcaggtgggaagaccgccctcccagggcctcgattgcggccacagccctgacctctttggccatcagaagaccccaggcagagcctcaccctgaggctgagaaacgcaggaaggactcagaaccgaggactgccgcctgccctggctcctccatcaacggcagtgcgggctgggaatggaggccctctactccctcctgagtcctgggccttgcaactgaggcacatagatggcacctgggccactcgtccctgagccacaggtactatcgagtgtgcacaggcgtgcgtggaggggatgcgtgaaccatccctcggatttgcatcagaatcgcctgctgcgggtagggaggaggccacgtgaggccagtgaggccagccagcgcggggcacgctggctttgagttacagaagagtggtgcatttcctccctgggggtcgttcccctcgccctaagagttgttagtgttcccaagtagaagatactgaaagcactttaatcctttaagcgcttatattgcaggtgggggaggcgctaaagttagcacagaggcaagaggctccctgaatgttggcataggatggggggctgtgccagaaaactcccgccttgtctgggtggccccagctgcttctgggaggaggagcagcgcccaggccccatcatccctgagcaccagtggttctgggaatggctagcccaggccctgcagagaggataagacccttcaagtcactcacaattggacatttgtagctagccaccctccaggctttgctttcccccctgcccgcccactgccttctgctccccagaccccaccagcaaaggccaccctggcctctctgtcccctgtccccctgccccgccccaccaccagtgcctaaagcttcgcacttacctgctcctccccatcaggcagcctctcttgcggctggtgacgattaggaggaaagccagacgggttaggaatttgcacttaggcaacagagcaagcccaggaacgaatctttcatcgaatgtcttttgcgtgacattttgtagaatactggacgttccgttgctttgattgtttttgtattcaggggtaatgtatattgaaaatagagattttgccatatcagagtatcagggattcactccctaaataagagtccccccagccctctgagaagacctcaggcaggagaaagggggccaccccaggcctgcccccagatgagtgtggtggcaagcctggcccctcttctccctacaacgatgcagtccacccctcttccccttagccctgcagaaacagggcagactcttcaaatggcactttactgaaagccaaggggaattctcaaggaaaagtctcagggctggcagaggcagctgctggcaggccttatcctagttccccagcgctgtccccagagctgggctcaggagctctgccccttggtgctctcagcccagcgtcctggtcagcggccacctccttccagccctgtcccctcccaggggagagggggtttttcatccacaaggcctgagggcaggtgggtggtaggcgtggtggaggggggaggttcaaagacagctggctcctatcaggagagtgtgggaagacccaaacatacaggattccctcggagaatgctgcttggagtgccagtcactaggacaactccagaaataatgttatacacacacacacacacacacacacacacacacacacacacgatatatatagttttatgaaaacttctagagttcttgtaagttgcacttataccgtagcctccttcagtgtgtccctattccccatcctgtgattgcgttcttgtctgcaagctggtctcataagcccacaagtgtgtgtcatgcctgtccccatgtccttgatgccaagcccggtgctggtaatcagtaagcatgagtgaaataggtcttgcagtcctagcacctcagactcaggcttgggaccattgtcggctccagccttgccttgaggcaatccgaagcatctacgactttgggttttccagaaaaagaagtattaggaatggtgtatttgaagtccctgatgaggccattgggaagtctgggtttttctgctgtgcagacagtctttgcaagggctggcatgggcccagaaatgcaatcctcgtgcagagtaggtgcctgtggcaggaggccatgcaattgggctctagtcttgcttcattcaactgaaccaggaaagaaacagatccacgcactctgatacccatttccgttgttctaggaggtaaatgatttcgttcctacaagccagacagtagccagctttcactaaagaagaatcgactccttagtatcttgtcatgccattggttctgatgcataagtgaaccctgtttttaacggaagctccttttttttcacctcaggacctacccaagactgtctagatactggcaggacaaggtacaggagttttcagcagaaagtggagttgccaggagagatgctgggcacttgcactgtgactttggagtgccgggaaaagttccagggtccccagtgcttacttagataaatggcatttaaaatagtgcagccttttatcattgcttagtctaatttagctccccataatgacattctcactgcaaggtggtcattgctatcattttcttttgggtgtggcagttaggtatgccacgtgagctgaacgggtttcacatggaatcaaagtcagaatgttcgaaaaggacatttgtgtttttccttcaatggtgccttgaaattgggctccctccctcttgctgtgtggggaactgggagggtatagcccaagcttgctttgtgatggacagctagaatgtaaaagcttaaactatggggaaagtcttgcctgttttccaaggcttcctccaccctgccaccgaagaacttacctggatgccaacctgggacccctttgtctttgggcttttgccctttgaaactgtgaatgcttcaagagccacataaatgctctggcagtgtctccatgtaactagtaaattgtcctggctggattcgttgtgaaatggaactgtcccatttactttggttgcaaataaggaagatgtatgagtattggcctggaaatgagccctctagtgtagagaggttattctgagggtttaaactacatggataggccttgggttcaaggttacaggaaaggctgtaagcctgagattgtggggaatggccagagctgggctttgggtgttccttgtgggggtccctgtgaaggtaagacagaaaggcattctgggtgagctgcctcgggtcagcccaggggtgcaggctcctctgactgggaccacaggcagccacccgaggccactcagatgccgtgactctgagaccagagggaagggaggctgggcctggtcccctgtgttcctcagcaaagtgccacatcagtctcctgagaacacagctgtgtgttctttccagtcgcttctgttcccagacttcaggcaacatggcagctcccatacttgccagggtagttggaagggcagctctggagacaggaagtggaggtagaagcaaaggaagggagtccttggctgggaagtgcttgggttcggacagacagggaagaagggaaagtatgaggtgtgttcagggaagcttagaagggcagagaggtttcagtaggacatgtatgggctaaagggtcagttagaaccagagtatggagagtctgggatgccatatacaaaagtttgggctctaacagtctcctgatgaggagcaattttccaaaacatgaaagaattattctaagaatgacaaagggaagttaatataaattatgactaccacagggtttgaatttacacactgaccaccacaaattttataactgtagtcgtctcgatggttgtgatgcccatgaggtgttgggctgggggcatgatgacgctgaggcaacatgagaggggacgtctttgacaccagggccccagccacgtgtctcaggggctcccacttgccatgggactcgcagctggttccatccgatgccagccccagtgcatctatcactgtcttcacaaaacgggggtcctccaggagttctggacagctgctctgcagattcttatatacctttaatcgaaggccttggacttttgagaggagcgcagtgccctccttttgtgttcaggaaggccaaattagagccttctccaccgccggggaatattcatgtgggaaatggaggcctgctgcagacctgaaggtcaatgattgtttaatctttctttgacagcattatgaaggtataatgggcatacaagaaactgcacgtctttaaagtgtacagttggagggtttttggcatgtgtggacacccatgaaacctcccccataatcaagacagtgaattgatccgccactcccaaaagtggccttgcgcctccagcaacccctctttcctgctcctcactgtcccccatccccaccgccactgcttggcttgctgtcactatagattaattcccattttctagaattccatagaaatggactcatacagtgtatgtctggcctctttcactcagcacaattcttttttcatcaggtgtttttgtgcatatcagtactccatttttttttattgttggtaggatcccattgtatgggtggaccacaatacctgttgaatacctgttgatggacatttgggttgttaccaggttttggccatgacaaataaagctgctgtgaacatttgtgtaccagtttctgcgtggacatatgttttcatttctcttggatatacggctaggagtggaattgttgggtcatgtggtaactctgtgttcaactgtgcgaggaactaccaagcttttccatagcagctgcaccatcttatgttcccaccagcagtgtacaagcgttttagtttctccatatgctcaccaaccaatatagtttggatctgtgatcccacccaaatctcatgttgaattgtaatctccaatgttggaggtggggcctggtgggaggttactggatcatgggggcagggttctcacgaatggtttagtaccatcctcttggtgttgtcctcatgatagtgattgagttctcccaagagatggtcctttaaaggcgtgtggcacctcccctttctctctcttgctcctgctctggcagcgtgatgtgcctgctcctgctttgcgttccaccatgagtaaaaacccctgaggcttccccagaagcagatgctgccatgcttcctgtacagcctgaaaaaccgtgagccaattaaacctcttttcttcataaattacccaatctcaggtatttcttcatagtaatgcaagaacagactaatacactaacacttgttattgtctgtcttttcattatagccatcccagtgggtgtggggtggtatttcattgtggttttgatttgcatttccctgataactaatgatgttgagcatcttttcatgtgtcctttggccattcatatgtcttctttgaggaagtatctgttcaagtcttttgcccgtttttaaatgaggttgtttgtcttcttcttaagttctaagagttctagacacaagtcctttgtcagatatgtattttgcaatatttttcttccaaactctggcttgcctttccatttgcataacactgcattttaaagagcagaagttgtgttatgttgatggagtctaaggtatggacttttaaattttatagtttgtgctttttgtgtcatagttaagaaatctttgcaaaactcaagtcactaagcctttatccagtgttttcttataaaaacatagacctgtttccttatagaagttgtataatcttagctcttatatttaggtctatgatccattttgtgtgtggtgtgaggcaaattcacaattcatttttttatatatggatatccagtttttctagcaccatttgttgaaaagagtatcttttctccagttgagttaccttagcccctttgtggaaaatcagttggccatatgtgtgtgagtctacttctggactcttcatggtacctcatcagtcagcactatgaactgaatatttgtgccccctgaaaattcatatgtggaagccctgatcccagtgggatggtgtattaatccattttcacgctgctaataaaggcatatcgagactgggtaacttataaagaaaaagaagtttaattgactcacagggccacgtggtgagggaggcctcacaatcatggtgggaggcaaggaggagcaaagtcacatcttacatggtggcaaggaagagagaacttgtgcaggggaactgcccattataaaaccatcagatcttgtgagacttactatcaggagaacagcacaggaaagacccgcccccatgattcaattacctcccactgggtctctcataggacacatggaaattttgggagccacaattcaagatgagatttgggtgggaacacagccaaaccatatcacatggcattaggagttggggcctctgggagcgcattaggtttagatgaggtcatgacggtgggaccctcatgatgggattggttcccaacaacaagaggaagagacactagagcttccttcctccactgtgtgtgaggatacagcaagaaggcagctgtgtccaagccaaagagaactattaccaagaaccaaatctgctggcaccttgactttagacttttagcctccagaactgtgagaaataaatgtctgttgtttaagccacccagtctgtggtattttgttatagcaccccaagcaaactgagacaatgtctatctcgatgccaatgccacactctcttgactactgtagctttgtaacacgtcttgaaatcaggtaatgtgagttctccaatgctgttcttcattttcaaaattgttttgtcttttcaaagtttgtcacactttcacatgagttttagaataccttgccaatttatatggggggaaaaagcctactggggttttgattggattgcattgaatctataaaccatttgagggaggattgatatctttaacaatattaagcctttcaatctatgaacatgatgtatctctccatgttgggagccttctttaatttctctcaacaatgggttgtagtttcaatgtttagaccttggatgtgggttgctagagaacctgctagagtggattaaataattagtagatccctacatgtggttattgagtttatgggtattgtttcaaccattcctagtaaccctgcattctcatttagttcttcatttatctaacagatatagactgaacatttaactgtgtgctgcgatatgaggatgagtatgacagaattaggtgtatttttttgttcctatgatgtttttgtttagcccagtccatatttgacagcagccttgaccataatataacacagagctattttccgtttctttgtccgtttgtttgtttctttgtgtttgtttgttttggaaacagagtctcgctctatccctcaggctggagtgcagtggtgtgatcttggctcactgcaacctccacctcctgggttcaagcgattctcatgcctcagcctcctgagtagctgggattacaggtgcctgccaccacatccagctaatttttgtatttttagtagagacagtgatttgccatgttggccaggctggtctcgaactcctggcctcaggtgatctgcccaccttagcttcccagagtgctgggattaaagaagtgagccaccacgcctggccagaggtttttttgtttgtttgtttgtctgtcttgttttgttttgtttttgtttttgacagagtctagctttgtcaccaggctggagtacagtgatgcaatctcggctcactgcaacctccacctcccaggttcaagcaattctcctgcctcagcctcccaagtagctgggattacaggcacgcactgccatgcccagctaatttttgtatttttttttttttagtagagatggcgtttcaccatgttagccaggatggtctcgatctcctgaccttgtgatctgcccacctcagcctcccaaagtgctgggattacaggcgtgagccaccatgcccagcccagagttgtgttttatattatgtgtgtccgtgtgtccaagattttttagctgtgtccaatttttttttttttttttttttttttttttgtgagatagagtcttgctctgttgcctagactggagtgcagtggtttagtcatggctcactgcagtcttgccctcttggcctcaagcgatcctcctgcctccaccttcacctcctaagtagctgggactacaggcatgtgccaccacatctggctaattttttttttttagatgagtctcgctctgtcacccaggctggagtgcagtggcgtgatcttggctcattgcaacctccacctcttgggttcaagcaattctcctgcctcagcctcccgtgtagctgggactacaggtgcctgccaccacacccggctaattttgtatttttagtagagacgggatttcaccatattgatcaggctggtctcaaactcccaacctgatgtgatccacctgcctcagcctcccaaagttctgggattacaggcgtgagccacctcgtccagccacctggctgattttttaattttttttttatagagatgaggtctcattatgttgcccaggctccaagattttttaagtaccattttctgaaaagggcttctgacagaacctcaccaagaaccagatctgctggcaccctgacgttagacttttagcctccagaactgtgagagctcaaatcaaatcaaatcaaaataagaaagtaagaattaaatttttttcatttttttcaatgaaaatattcctcgcctactatataatgtattctagctggttacatgagaacaaggtgagaggaggtagagaaggacaaaggaggaaagaggaaagcacaggtgagaaggagagcagcttgactgcagtgactgaacactcagatcacagggtctcctctggttatgggaatgggatgcaggaagaaacaaacacagtatatcagttaggaaagtggccacaaaagtagtagaaaacctaactatggtggattaaagaattagatgctttgttttctcacctaaggactctggggtagctttctggcatcggttcagcagcagagcttttggcagtacgcagcatctttctgatttgcttcgctttgctgcgtgatcacaaaatggctgctgaagctccagccatcacatatgcattagacagaaggaggaaggggcagagacagacactctgtcctcttttatcaaggaagcaacagttttcccagaaacttgcctggcagacttccacttagatctcaggagccagaactggatcatgcggccacccctaacctcaagagaggctgagaacgttgggaatgggatggattttcatgacctatcacctggggctgagcccactgatgccttgaacaaagttggggtcttatccccagagaaaaaggttaggatgcagattgggtggtgttatgagtcaaattgtatcccccaaaaaggtaggttgaagtcctaacccccagtacctcagaatgtgatcatgtttggaagtagggtcgttgccgatgtaaatatttaaaataaggtcataccggagtagggcgcacccttaatccaatatggctgctgtccttacaaagagaggagaatgccatgcaaaggaacagacacacagggagaaggccatgtgaagacagagacagggatagaagtgatgaggccacaagccaaggaacacccggggccaccagaagctggaagaggcagaaggaccctcccctagagcctctggagggagcgcagccctgcccacacctagatatcaacccgagggccctcagctctttatgcctgaactctgggaggctgggggtgagggagagaaggccagccttgctcaagcccctcccactggccggcatcctgactaccatttacagatgtgaaaactgaggcttagagatgggaaggaattgtctggagactcaacactaggaagcggcgacagattcatgcccaagttccaggactccagcattgctgctcactccagccaatcagggagagcagctgtgtgaactctgcccccaaactaaagggaatccagtcgcctttaccattttcctaacttcgcccatttggggggatgattccataagttggccataaccaaacataaaaatcatttgattttctggaaaagattgtacaaaaggaaagaagccaaaggttaaatcctgccttggaattgggaaagcgtttggtcatccccctccccgcccttgcaccatataggttctcagctggtgagaccctcaggagcgctggggctgtgggccctggagccctgccacctgcactttcttccatcccttacccacaattgctcactccggatgccatgcaccttcgtttcctttctgtaagactgagggggccaggtgtggtggctcacatctgtaatcccagcactttgggaggctgaggcgggtgaattgcctgaggtcaggagttcgagaccagcctggccaacatggtgaaaccccatctctactaaaaatgcaaaaattagccaggtgtggtggcgcatgcctgtagtcccagctacttgggaagctgaggcaggagaatcgcttgaacccaggagacggaggtttcagtgagccaagatcacgccactgcactccagcctgggcgacacagcaagactccatcaaaaaaaagaaaaaaaggagagagggagagaaaaagagaggaaggaagggagagagggagggagagagggagggagggagggagggagggaaggaaggaaggaaggaaggaaggaaggaaggaaggaaggaaggaaggaaggaaggaaggaaaaagcaccacaaaccaggtggcttaaaacaccagaaatttactctcttattgttgaagagccagaagacccctcccttgccttttccagccgctggtggccccggacttccctgggttgtggctgcatcgctgcaatcccggcctcagtcttcaagtggcctcgtcctcccactgtgtgcctccactctgcgtctctcctaaggacacttgtcaatggatttagggcacactccagtaatccaggatgaccctgtctcaagatctttaatgtaattacatctgcaaagaccctttctccaaataaggtcacactaaaagggggcagagattaggacatgaacacatcttttgggggctgccttcaacccagcacaggcaggaacaggcttggtgtgtttgaggcctgtgtggctggaggccagtgggcctcccaggggcagtggggagggatgagggtggcagggccagggacagccatatagggctcggagggcatgacaagaagtgcaagggctcagacataacaggagctgtcaccgtagctgacatgcactgcacatgtgctatgtgccaggccccaggcatgacccaccctcccaggatcattgtattgtttccattttacagatgaggaaactgaggccaggctgtgaggtcatttctgccagccacagggttgggcagctggggggtgaggcctggcacccaggctgtcaccactagctgaggccccctcccaacggcttgggtgcctttcagccctggacctcgagggagggaaccacaaacgccaagtcctcctctccgccccaggggacctgggaaatgccaagggttcttttgccgggcttccgggttccctggcaggagggggaatgctgtacgtgctggatttccaggttggaaggagactttgtaaaccttttcaatacagccccgccaggcttacggcccagggaggtgtgtctgcaggacccggacacatctctttgaaatgcaaacataaagctagcgcccctagctccctgccttcctgagaccaccaagagaaagctttcattttcctttggatacaggcaactcactagcgcagaatggccagctgctgaccaggtgcactcacgatggatgaggacatgcagcagggcatcttgagatggcatctgcctgactagatcaaagggtagctgacatgcactgcgcaaaggatgaggtttccttctcggcctgtgatgcccattgcagctgagctcacctttgtcttctttcccgcattgtggagagggctccccgggctggcaggacctccagtcttcccagtacatgcaggggtggagcgcccagggtggggagcagggtccagaggtgggaggggctgagcggaggccatggatccggggcccggggcgaggatcagcctccagctacccggaatgcgctgggcccctggaggtacctgggtgactgacaacccaggagcctggggcttccgctgggactgtggcgactatcacacctcacgccacttaaggggttgtcgctgcttctacaaatccagctagaaacaagaagatggaaattgggaggatgctggccagaagacaagaagtgaggagcaggggcagaggacagacgggtcagcccttgactgaagaaggcctcccagaggaggcaaaggcccgtctccacctcaggagggctagctgagctccactccaaaccggattgtcatggacctgggctttgcctgacaaacattcccaagctcccaagacagcaggagcatctcagaagcttccaaacagaaagaaccagcaatagcagaaatggatcagagtgggccagcttccctgtgcgactctggcagcctgtggatcctcatcctcacccagcagggaaggaaagcaagaatccttgtgaccaagcaggttagcttcaaaatgcattttgatactcgggaggctgaggcaggagaatggcgtgaacccgggaggcggagcttgcagtgagcagaaatcgcaccactgcactccagcctgggcgactgagcgagactctgtctcaaaaaaacaaaaaacaaatgcattttgaaacttcgtctttcctttcttgctttcagccttaatgtactttgaaactccttgtttccctcccttcccaccagacactcccttgcactgctcactcacctaattttgtgcttacttagtagttccagggcgctaatcttgagacaaaccaagcatggaaatctagctgtgaaattccaggcggtcagtctacaacccagccatcgtagagatgatgccagcccgtgctcccagtggaccatgactcaagatagccaagggaacaaggcacacagaccttgtgcccagtgccccgcctgcatgtctcccattccaagctcccttttactcctctcgcccacataaagcttgagatggttcctctgaggcttgagcctggccagcccggccattctcccacctgctagcactcgagtaaaagctgctttcggccaggagtggtggctcacgcctgtaatcacagcactttgggaggccaagttgggtggatcatttgaggtcaggagtttgaggccagcctatccaacatggcgaaaccctgtctctacaaaaaatacaaaaattagccaggcatggtagtgcgagcctatgatcccagctactcaggaggctgaggaaggagaatcacctgaacccaggaggcggaggttgcagtgagccgagattgtgctactgcactccagcctgagtgacagaacaagattctgccaaaaaaaaacaaaaaacaaaaacggctttcctttcaccacacctcgcttcttgtattctggcctccaaacagcaagcagccagacttgagtcggttacattctgcaaacatctgctcactgcaaagctgcaagaccaaacaacccctgcaacagaacagaggcctcagagaggaaggggcggtgggcagccacctcacaaagtatgcgctcaattgaaataagtgatgacagaggggctggctgggctggctgtaaggatcaagtacagattcgtgggtgttacgcacgaagaaaattccagagaacaaagaccagaccgtgctatagtgactgggaaggtaaagtttatgcatcaacctggccagtctacagtacccagttttggtcaaacaccagtctagatgtggctgtgagggtgtttttaaataaaattagtatttaaatgagaagactaagtacagcagattgttctccatgctgtgggtgggcctcatccaatcagttgaagggattaagagaaaatgactgaggtcacccaaagaggaaggaattctgcctccaactcgagcctttggactcaaacaactcttccctgagtgtccagtgacttgccaacctccatgtcacgtgagctgattccttaaaatctctctctctctacacacacacaaacacacacacacgatatgatatatatcatatacatggtgtggatataatgtgtatttttggtgtggttttttgggattttttttttcttttttgagaccgagccttgctctgttggccaggctcaccaccacacccggctaatttttgttgcatttagtagagacagggtttcaccatgttgaccaggctggtctcgaactcctagcctcaaatgttctgcctgcctcagcctcccaaagtgctgggattacaggcatgaaccacagtgcctggctataatatgtatcaagtatttgtcagtatatatgtgtcatgagtatatgtgtgttagagcgtgtgtatatatatatgtgtgtgtattaatacagttgtaatgcagtaagcacaaacacacagcaactaaatgcataaagaaaaatgactagacatgaaggaagacttcaagaaaatgcaattacaatggaatgttctaatatattgtcattaaatcagacagatatagtcaacaaaaaaaaaaacaagtaaaaatgtaaaggaaattgaatagtacaattgtcaactagattttagagatatatagaaaagcctgcatctctgaagcaggtgcatttttcagagtctataacatattttacagttatttatgtattcggcctctgttatccattgaattgtgtctgcctccctcctccccctaaaaaaagatatattacagcccaaacccccagtacctcagaatggagccttatttggggatcttcacagaggtaatcaagttaaaatgaggtcattagggtgggctgtaatccaatatgactgtgtcattataaaaagaagaaatgtggacacagcgccttgtatgcagggagaaagagggctgtgtgaagatgaaggcagagattggggagaggctgccacaaatcaaggaacaccaaagatggccagcaaagtcccggaagctgggggagagcctggaatagattctccctcacggcccccagggggaaccttgccctgccaacacctcgatctctgacttctggcctccagatccgagaaacagtccatttctgctgtcgaagccccctagtttatggaactttgctatggcatccctagagaactcaagcagcccccaaactaccttaattcgaaaaggtgatattttaagcaacacatcctcagattattatccaatacaactaaaatacacaacaaaacatgactggctgggtgtggtagctcatgcctgtaatcccagccctttgggaggccgaggagggttgatcacttgagctcaggagttcgagaccagagggaaacatggcaaaaccccatctatacaataaatacaaaaattggcaggctgtggtggcgcatgcctgtagtcccagctatttgggagaatgaggtggaaagatagtttgagcccgggaggcggaagttgcagtgagccaagattgcgacagtgcattccaacctgggtgacaatgagaccctgtctcaaaaaaaaaaaaaaaaaaaaaagatcatgaaatcataattactcagaaattaagataaactgcagtatataagcatgagatcaagaagggaatggaaagcaaaattacaagctattcctaaagcaaagcaaagaagaatgtttaatagcaaacctataggacacagtaaaatctgcatttagcgataataaagtgtcaagcttattgatagatacaatttcaacaccaaacgcatcactggccataatgtttagggtacagattgaatacacactttaatttaaaatacccgaatcactcaaaagatactaataaatcaaagttttaaaagattcagctgggcatggtggctcacacctgtaatcccagcattttgggaggccaaagcgggcagatcacctgaggtcaggagttcgagaccggcctggctaacatggcaaaaccctgtctctactaaatatacaaaaattagctgggcatggtggcatgcgcctgtaatcccagttactcgggaggctgaggcaagagaatcgcttgaacccaggaggcggaggttgtggtgagccaagatcgtgccattgcattccagcctgggtgaccagagcgaaacttcatctcaaaaaaaaaaaaaaaaagattggacacttccctttaaacatataattacctctaaaaactatctgtagctttggaatatgaaagtatgaaattgtattcacccagccaatactatgcccacatatactgctgctccctattgaaataggaacgtagtcagtgggtgatatttgtaattttaaaagttcgacacatggaaaacaatttggctcttctaatgggcatagagagcagctctcttcgtcaccacgcagagatctgccaggctgatggacaactggatacccccagaggatatattttgaatgaccttatccagtgacccatgggtgtcatttaacgcatgaggctccctggagcaggaactgacatacctgcttccagagcttttcagccctgaacgtgcactgcaaacgcgtaagagtggtactagcaccattgtgagagctccctcaagtgtcagccaatgcaaattcagaccaccaggagaacatcagatccttttagaaaaaccatggagaaactgcgtttctcttacaagttagttcccatatcaagaagaatgccacagggtgtgtctgtaaagtaaaaaacccacactcactgccagctgccgtcacctcaggttcttgttcttcctcggcatcttcatcgtcttcctcttcagcctccagatacccctcttcccagcctccctcagcctggtcttccatttctgcctcttcagtgatgggccaggtaaatgaagctcctgaggatcaacatctgtacactcttgactttctgaaatcttaaagaaattatcagaaactgtattaaatttatttttcaaaagttttcaaaacttcataaaaccttaacttatctatcatggaagatattgctgatatcaataataacacaccaattttactccaaaaacccaaaagatatactggataaattttaaagattagaaaaaatgtccatgcacaaaataaatacacagacacacatatgctgtcttcctcagtattttgattgaaatgccgtgctgtaaatggattcatgtctatgctgcaacttaaaataatttatgttcagcatgataccaagtataaaaggcaattaaagaacatgattttgattccaaaaaaatctacatttagagggaaattgcagccttcgagtgccttatgccaaatcacaagtgagtgtgtgggagtggcatgtgtgtgtcaggggagtgtgtgtggcacaagtgtaaatgtgtgtgtgtgcatgtataggttgtgggggtgggggtatgtgatgtatgagtggggggtgcatgtgtatgtggtgggggagtggggacttgcatgtgtacccccaaaattcatgttaaaactgaatcaacaaggtgacagtagtaggaggtggggcatttagaaggtgagtaggtcatgagggctgcaccaccatgaatgagattagtgcccttacaggagaccctgtgaggcagctagtcctttccacaattcgaggaaccagccctcgccagactctgaacctgctggtgccttgatcgtggccttcccagactagagaactgtgagcaataactgtttgctgtttataagccacccagtctaaagtatttttgttatagcagcccatagggactaagacaaaatgcaagtaatactccccaggttcttgtcccagctgaatcccttagaagaggttgatgctcaagagacattaaatggcaaatacaagtctagaatggattggcacagtgtgtacaagtgtgtgcgagagtgagtgtatgtgcaagtgtttgtgcatgtgtgtggttgtgtgtgcaactgtgtacaggtgtgtgtgagtgctagtgtgtgcgagcgtgtgtgggtgtactgtgtgtaaatatgtgtgcaggtgtgtgcatgtgtgtgtgcaagtgtgggggtgtgctcgggtgtgtgagtgcttgagtatatgtgagggtgtgtgcacaagtgtgtctgtgtgcatgcaagtgtgtgagtgtacacatctgtgagtgggaggtgtgtgttcacaagctgagctataggaagcagtgtccccacaatgctgatactgttcctggaggtcccctacatgaaacctccgcagctgacactcatcaatgctgcttaacttctttgcaacaggcagggggcagatatcatttacaagaaatgcagacgtcccgctgtggtcccgtggcactccccaaccttctgctgcggctttcagcgtgctccccacattgtcttccgcacaaagacaaactggaaatgttatggcctttgattttagtattcatccctctccatagtgaattccattttcaataggcttatgtcacatgtcccccaggtacactcccgtgatcaccgctgtctccccactggcagacacccctggtggcctgacggggctcatcagtcagtgatgcagcttgatgaggggcaggcagctggccaggggcgagctggagcagtggagtcggttcgctgttggctccacagcatcaccttgagtcccatgcaaatgagcttgcacattgggagctcacttcttcctgctgagtagtattccgtggtgtggacgcactgcggcgtgtccaaccactcacctgatgatgaacatttgggctgtttcctgtttggggctattatgaaaaagctgctgtgaacgttggagtatgagtgtttgtatggttacatcaatccctttgtcttgggtaagtatctaggaggggaattgttggctgatgtggtaggtgcatgtttaacattttcggacactgccgaagtgttttcccaagtggctgccccattttcccttcccaccagaaaggcacgggcacccccggtgctccacatctcctccctggtaaaccaacacttggtgtggtcagtggtttttgttttacccattctaatagatgttaaacgtccaggaattttgagagctaaacaaacactatcattattaaaaagttaaattatgtaaactgacaaattatatgaaaaataaaggagatactcaaaactcacgtcttcattattcgagcatgctttactgttgctgtgtgttgacacctgtcagatgtgtgtggtggaaatcctggaatctcttcccaaggtcaccttcagtgacttcctgttggtagcttaagactggccaagtggaagtattataccgcagagctcggcatgccacggcatgccagggcttgatgtattactgctttgttgattgcctagactttagaaagaggtgaagaaaatgctaatattgcagattaaactgaagaatgctgggtctgcggccattacattataaatagcaaaaaaataaataaaaataaacattttcggtatttgaaaactatcatccaattaagcaaagaagttgctcatctttgctgcttcatgtttatcttactcattaaaataaatgaaaacatcagccaacatgtatgtgggaagcacagctgtccatccatcgcactcaagtacagggtacagataacaagaactcagtaaaagtcaatgaaggtattttgtgagtattcattggccatgtggaatttacggcgaagagtatattgtgtattttgttgcatattttatatatattgtggattttattatttgtaaattgtgtgttcatgtatatgtatgcatgtgcctgtgtgtatagcctgtgtgtatatagagaaagagacaggggaggaagggagagagatccatgcctacatacatacgtgtacatttcctttcctggaaagctggttgttaaccatttataagcacattgctgctttgaggcatcagagaggcaggtcacagcctgtctgggcagcatggtacgcaagacgcctggcctggccagtctcgacatggactcggggagggcgcccgaggccaggccaccgtgaggccaggggagcccagagtgatgagagagaggcacctcagcccaagacaggtgagagggcccaaaaccagagacccctccacagaggcggcagcagccaaaatcaggctgtcacctgcctgtctgtcccatcctggggttgagacccttctagcatgcccaatgagaagggccccacttggtgtcacctacccagcaggtcagtggcaagaccaggttttttttcttgtttttggatttggaaggggggtctcactgtcgcccaggctggagtacagtggtgccatcatggctcactgcagcctcactttcccaggctcaagtgatcctctggccctcagcctcctgagtagctgggactacagatgtgtgcctccactcctaatttttctttttaatttttgtagagatagggtcttgctatgttgccccggtcagtctcaaactcctgggctccagcaatccgcctgccttggcctcccaaagtgctgggattataggcgtaagccaccatgcccaaccaaggccagggttttaagggtaacacctgctggattcggctgcccagctggagcctggccagtaagataaacagaagcaggccctgtctgggcaccaggggatctgggggctcagtgtcccctactccagcttctgtagggccagcccagggcttgtgacactctcccaggtgatgctctcctcgggaagcttggctgtgacaagatcttctggttactaaccacattcccaaactaggtcctgtggggcttccccagaccgtgccccctcccctcccctgctgccactgtccttggccaggcccatagctctccctccctccaccaaagccctccatgctctgcttctgcccgccttgccgtcgctgtcctctccagcccattctccatgcagcagcctgatgtggtttggacgttcgtcccctccaaatctcagtttgagatgtaacccccaatgttggaggtggggccttggtgggaggcgtttgggtcatggggttggatccctcatgaatggcttggtgccgtcctcacctccgcaaggagttgaattctcgctgtgagttcacctccccgcctctctcttgctccccctttgccttctgccataagtggaagcttcctgaggccccaccagttaacagatgccagcactgctgagccaaaataaacccgctgtctttgtaaatgacccagcctcaagtatttcttcacagcaactcgagaacagctcggcacgcagcccaagcagcatatggcagaagcctacaccagacttttcccctctcctgctcatgaccctccgcggctccccgctgccatcagggtcaggcctggcccgggccacaaggaaggtctgaggtggtcactgcctgtgctctggcctcaccatcctaccaccgtgcacgctgcagtggctccagtcattctgacctacttagggcttcccagattgtccagctggctggaggctcaggctttgctcatgtgagtcactctcaggcgtggccaccccatcccttcttacctgacccagcgttggtgacaggtctctccccacccatgaggcctcccaagactggaagtgcctcagggtggggcccctgaggcaggttagcagggaacccaaagcacagtgcggtggccagaagctgccctcccaccgagcggcctcctggccctacggggacacgggctgcaggataggctcccttccagggtcaccctcacagcaccagccaccccacctctgctccgtgcaccgtcagggcccttagcatgtacatgtacatgtgcatgcccacatgtgggggcacctcccttttccccagcaccccgtttcttaacatttcaccctgttaccacttcacagagcagggacagagactccaggtcccacggcgggcaagcgctgcagctgagctttgtgcccaggcaggcggccggctctgtgggcttaaggccctactcatggcttctttgggcctctggggtgacaatgcagatgggcggcaatcagcccacagccacaacccatcagccctcagaccaacccaagagcttgacgtctccctacccagccacccacggtcctcaccgcgaggagaggccataggggggcggccctggaggtcttgtgctggcccctggcatggctcaccgcctggccctgctcagcagggggtcgagggagtccagcccctagtatctggccagctagtcggagggtgagtagttggcaatgtttattgggaaacagcaaactctgctgggcacccaggccagccgggagagcacggccctggaagcggggcctggagaggaatccagggccgtatggctggtcaggcagccagggaaggcctggcaggtgcacggacctgaggctgcccagataggaggagccgggggtggtagaggccagctgaacggtggaggctggcactgtccatggcacaggaggtggccctggtgctcaggcctccaggctggggtcatcaggcggcaagtacatgggctcgatgtgggcccacccacgggcctgctcatcggcccaggcgagcagctctgcggcgcggtgcaggaagatcaggagcagggtgtgcacgtcgccctcggctgagtgggctgcgcttggctctgcccggaagtagcggtggaagaggctgccgaggctgtaaccctggcggccccgggcccgggtgccgtggctgtgggcgcggtccaggccccgcagggccggcagcgtgtccaggcagacagtgtcccggggcaggcgggcacccaggcgccgcagctcggcacacagcagggggaaatcataatcaaagccattgtgggccacaaggcagatgggccctgcctggcggctcaggaaggcctgcagcgtccgcaccacggcgccatcaaagccagccttccggcatcgcgccaggccctcactgctcaggccggtgatctcgctggccttggcagtgaaggggcgctccgggcacatgcacagcgtgagcttgtccaggacccggggcaatactagggcaccagactcgtcgtgctccgggttctccagggaggagcggtggacagcaaagagggacagctcggcaatctcgggctccacactggggagcccagtggcttccaggtccaggaagacaaaggtctcggcccggggtgcctcggacatggtgatgttcccacggggatagcaagtcctcaaactgtccgagcgagaggcacaaaccctgaggactggagagaggggttcgcccgggccctgctgtgtaccatcctccccctagccaaagctctgacccttctggggctcacttcctgccacccccgaccacagcacctgtgacctttggctctgggagcgtcagccccactcctgtcacctactgaacagaaaaggcaggcctcagagcgctctactgcctgcctccagccacagtccccagcagggattgggagaggcagaggcagctcagggaccgcaccttggcggggtccagccccttcaccggaatgccttggctgggaacctggggcatagcacactgggtctccagccctggaaccagctgccgggaagcaggcaagcagccacccgaaagagcccatgcagtgcacccagctcccgctgggctcgacctccccacccttgtccctggcacacaggtgctggtcccgagctggcctctgcctgcttgcccccaggctcccggggagactgtccttgccaaccccaccacaccagcttacctggggcgggcactgaccggcttcctgggcttctgggcacctgtcgccacacaggctgctctaggcggcctttaatcagcggccgcagcccgcccccagctgcctgttggccaacaatgaggcctggggcctcaggacctgcgcagccggctcgctcgccaccccctcgctagctcacagccactgagacacacgccccgtgtttacaaattaggaagcaggccccgagctcttcacaggcacggggaggaagccagagtggtgcggaaggcagtaacctccacctagccaggctgtggctgccaggcctggcaggcctggggtcaatgcctcccccatgctggggccaatgcctcccccatgctggggccagttacacaaaggcaacaggtcctctttgccaggcctcagtctccccgtcactggagatcaggtgccgctcgtggggatgaagcgagctctggagtgtgaccaaggtgcccacacatgccgtgctcagcctccaaaggggaaggggtgctcccccaaaacctagggatggggcagcctcgggagatgctatctgctttaaggacgtcgcttcatcatgtctaccgtgcacctaacagtggctgctggggaaggaagggaggtgggcctggcccgggagctgtgcaggccgcagctgagctaatgcttcctccaccacagataagcaacgttagggggtgggccaggagcgccgggactacaggaggagtgaagcccagcccctcggaccccaggctcagggacctgccctgtctatcccgctccaggcaaagggcaccaggtccttcccggtcctgcgagcagtggcgccctgaagacctcattctggagcaagagacaacagcccttgatggtgggtgcactgcagggccagccccatgctgggggcacagagaggtgaccaagaggagtcccttggcctataaatcaggtggtgcacctgcaccatggtgaccacaggcctgcccggcctcccacctctcacagtggtggctgggggatgcctcaggcgactgggatggaggggggtctggcacctggctcctcctggcctccttgccttgtgtgcccacagggaccttggggaagcaaaggagatggtgccaggagggagcagggtggggcgggcagcagcaggtacaatggccccaaggaggcagaggccctaccagtcacgcctgttccggtactcacagggagggaggcagctgtgacaggcacactgctcagggagatactgggtcaccctgggaagcccagacagcatcttcctggacaaccagtcaggctgaattccccagcccagagctgagcgcccagccagggaggagcaggaaactggtaccccgcgggggatccaggggcactcaaggagggcggctgaggggtgcgtctcgcacaggaccctaaggccagccgggggaggcgacagtgggttctctgctttcaagtggctggcagcagcagggaggagtggagccacaggaagaggacgcagcccaggcccgccaagatgacaggagggccgccgccagcctgcccagacctgggccacctgagcagctcaggacaaggggaaggagagagacatagagctgaggaagcagaaagcaggctggaggcaactgcttagaaaccaaggctttctttgtgtccaagtcaaaccgcccgtctgtctctccctccccaaaggggccaaaggtccctgcctagagcacaacgtggggctgcaacggcttctgctgccacaatcatccatcctcggccaactcgatcttgggagagggcttcctgcccgccccatcctgtgctttggcgtaggccatcactgaagactttctatttctccattagttcattcatcttggtagctgcagaggaaagaaaagaaaccaaaaggatggtgggagtgtaaactagttccaccattgtggaagtcagtgtggcgattcctcagggatctagaactagaaataccatttgacccagccatcccattactgggtatatacccaaaggactataaatcatgctgctatacagacacatgcacacgtatgtttattgcagcactattcacaatagcaaagacttggaaccaacccaaatgtccaacactgatagactggattaagaaaatatggcacatatacaccatggaatactacgcggcccataaaaaaagatgagttcatgtcctttgtagggacatggatgaagctggaaaccatcattctcagcaaactatcgcaaggacaaaaaaccaaacaccgcatgttctcactcataggtgggaactgaacaatgagaacacttggacacaggaaggggaacatcacacactggggcctgttgtggggtggggggagggaggagggatagcattaggagatatacctaatgtaaatgacgagttaatgggtgcagcacaccaacgtggcacatgtatacatatgtaactaacctgcacgttgtgcacatgtaccctagaacttaaagtataataaaaatatatatatataaaataaataaataaaataaacaaataaataaatagaaaagaaaccaacaggaaagcgagcctggcgcaagaggcgaggtgcctcctgcccaccactcaaggcacatgtcctcagctgatcctccttgagccccaggcaccaccaggatggcagggaagggacaggcactgccgagctgggagctgctcaggctctgtggggaccaggccagcagcttgggagccctgggctgggtcacaccgaccgcagcacagttccgagacccaggccagggtctgttgacccggctgtgcccccgcccacctgccccctgccccccaagccccaggggcagcacatggcacacagtgaggaggcaggggctgtcctgacttcagtggcacgttcagtattaaccagatggagaacactgcacacacaataaacccaatcacacagacagccctaagccttggctgcccggcccagtggcgaccgtggtggctgcgctgaccttatctgccatgaccacatctgcctctcagttgccaaccctagaccatggccatcatccccctcccccagcagacagaggaggacacagcccctcacctgccctgcctgtccgctccccatccgtggccccactgtcagctagactttgccttttacatgttgaagtcattagcattgacattaagtgctgtgaaccctgaatctgtcatcctctgcccatcccgagggtgactctgaagctcaggaatcctggggtgtgcctcggggtgacaccgagctggggaatgtgctcagcccgcctggaattgcgccccaggaccctctccactcgccatcagcttccagtggcatcccagcagaggggcttcctgccgcaatgcgcactgctctagactgtcttcctaggctccggactgtgtccctcgtgtggcatctgcccttatcaaatcgtctagacctccatcccggccttcctgctctgccctcactcttggtgcagggcttggcagggtccagagcccaaggccgggtgtgcagggccctcagtgcttgtaaggcatcctggctgctcctctgaggccacaggctgtctctcttgaagctttggccccagcccttggcccctgtactccagatggcaggaggtgggttccatctaccctgtgctcggcgcctgcactcacctggcttgtactgtgtgcccacctcctccggagccctgcccttcatctcccctgtcccctgccctggagaccctgtgcctggctggggcctgtgtgatgctgatctttgtgctggtttttctctctgttttctctcttcttagagatcccagcctcacttcgtttctagtctctttgtggctgggttttcacagctgtccaagcatgtctggatgtcgcactgagtgtattcagtggtgtcggaaagtccttcaggtcagatttcctgctcatccagggcttccttctctcctgcatggggctgcttttcgagccacaggggctgggaagaggatctgggtagctgccactgcccctggtctgctgtggtggagccgttgcctgtggggtctctctctggaggacagtttggaggagttccatggaggcgaggcagggatcagctcttgccccatggaccctcagaggctgcaaaaaggtaggtttcacccgggctgccgccagccacatcagccacatcaagagacgagctgggagccgctcaggctctgtgtgagccgggccaccagcttgggagctggtttgcttattcatttccatcactttcttcacagaagaacaggctagggtctcgccggggaggtgggcctctccagacctgcttcacctgtgccctctgcttccatctgctcaccactgccctgtccctggcaccccgctgccccttgggctgtcctctaggctgccaccttccccgcccgctgagcccgtcaccactgccggggttggtggcatctctccactgttggtaccctcaactctcctgtcccattcttgcactgacagcattgcttcggtttctaaatacattgatgttttcatggcagtgaggtttcaggaagcctggggggcgactcctggtgtgtggtgctgatccacagtgccaaggccctcccaactcacatgaggccatgcccccagcaagagcccagaaggcacactggctgctcctcacttcataggtggtgccgcacctccaacagagcctggctgcgggcatgcagatcgctgggaggtgaaacagcacagaaacacggccttccacagcgggaggagggccatcgagaccacggccctcaaggggtcagatgggaaacgggacaaataaagaactgtcccgagtggcctttggcgtggatttgatgctgaccctttctctggtgtgtccagacactaagaattcatctcaagccacatcaggatgctgaactgatgggagctgagttgagagcccctagagaggccgatgcccgccgtaggcctgctcccctggcgtctctccagacccccaaagtggccggggctcaagggtgaagagacacttccctgtacacaacgcactgcccagttcacacggcctggatgtaaagggtgcctttctggtaagaacagatactacacttgatcttagccaagaagcgataaggggcctttctgaaaggcaagacctgccaccagtcctatggtgccacagtcacaggtgagatggcacactgttgcgaataccaatgatcattataagaatgatggcatagattataagcagtttactaacagcaattataaaaactgggaagagagtcatagtgactggtgattaggataaacgctataatacattttaaagtggagggttctgctgcagttcaattggcaagaagaggctcctcagtgcctggtatacatggggtagttatgtgccgaggccaagagcagtgagaagcctggctctccgaggagacggctggctggagggttcatccaaagacagtctccaaaactagggctcagaggctatggacctgaaaccactacttgggggtgcaacagtggaaaacatttacagcaaatgctttagctgctgctgcctgaggcagtgcataatagccggggcaaacaagagactaaacaagaagctcaggagaggctggaaaatcagatgtccacaaaggctctggaaagctctggcacagtcctgggaatctggaagaccatgggtgtgtgccgggctgtgaaaatcccagagagagagacctgagaaggccctgatctctcacctctggctgaccttgaggctctgagcaagcaagatgtgaaggagaaagagctgtcaactacctggctgagtgttgatgaaaaacatgaatgacgacacatttacaaagctcaaaaagctcccaatggaataaattcacagtgattcacacgaagacagattataatcaaactgtccaaagccagggaccaacagaattttgaaaagaaagtgaagagactcatcatataccagctggcttcgcatcagaagctttggcagccagaggacactgaaatgacacattcaaagtacaaaagaattctatattcagcaaaactatccttcaaagatgaaggagaaatgaagacattcccacataaaaaatgagggagttcatcactagtgagccttccctacaggaaatactaagggtaggcctccgggatggcatggaaggacactagacagtaacacaaatccacatgaagaaataaagaactccaacaaaggtaacaacatcgataaatataaaaatgtgtaccaatgtacacatttaatacagcttcattctaatgggcaaagtttttgtatacaactgaaattagtttggtaatacactgttttcagttaggatgctaaatgcaattctaaggacaaccacttaaaaataacttttaaaagaagtgttaaagaaccaacaagggaattaaaatggtgtacccacaaatacattttgctttaataggaggcagtttctgtatactattgaaattcatttggtactagactgttttcagttaggatgctaactgtaattctaaagccaaccacttaaaaaataactttaaaaaacagagttaaagaggctgggcgcggtggctcatacctataatcccagtactttgggaggccgagacaggtggatcacctgaggtcagcagttcgagaccagcccggccaacatggcaaaaccccatctgtacttaaaaatacaaaaattagtcaggcgtggtggtgagtgcctgtaaccccagctacccgggaggctgaggcagaattgcttcaacccaggaggtggaggttgcagtgagctgagactgcactccagcctgggtgacagagcgagactccatctcaaaaagaaaaagaaaaatacgttcacacaaaagacttacgatgtacatagccaaaaagtagaaacccacatctaccaactacaacaaaatgtgggatatccacacaatcaaatattattcaaccatgaaaaggaatgaactacatggataacccttacaaaactttatgctcagtgaaagacaccagtcacaaaaggccacacattgttattccatttataggaaatgtccagcacaggcaaatccatagagacagacagcgtctctatgacagtggttgccaggagttgaggctagggagggatggggaatggctgctaatcatatggggtttcttctgggggtgataaaaatgttctggactcagatagtgataagaggatggttacacaactctgtgaatatcctaaagaccatgaaattgtacacttttaaaagggtaaattttatgttatatgaacttgaattcagtagagctgttatttaaaaaataaattagaagaggtagaaaactggctttaccttctttctttgggtttattttgctgtttattttctagccccctgaaacgtggtattagtgcagggatagcaaaaaaaaaaaggaatagaatggaacagaggagaacccagaaacccacacataacatatggatacttaataattaccaagagtgatggtattgcagatcaatgagagaaagagtgatttccagtcaatggtgctgcgacaaatgtgtatccatataggatacgaggaaactggatccccacctcactccatatgcaaaaatcaactctgagaagatggccctcattataagccttttcccattttccttaagtaacttttttttttttttttttaagacagggtctggctgtcacccaggctggagtactgtggcgtgacctcagctcactgcaacttccctctcatgggctcaagtgatcctcccacctcagcctcccaagtagctgagactgcaggtgcacgccaccatgcccagctagtttctgtattttagtagaaacgtggttttgccatgttgcccaggctgatctctatgctcaaagtggttcatcctcctctgcttcccaaagtgctgggattacaggcatgagccaccgcgcctggcccaagttacatttttaattgtcaaatactattccattcaggcatttgttatcatttgcttcacattttctattactgagttatctcaattttctacgatgagcgttttcatttgataatccgctgaaagcattttttcaagtgaaggaaaacatgcattagaaaatgaaaaacaaaagaaggggccggtccccaaatgctcctccagggctagtggagcacagaaaaggaagcctgtgcgtggggcagccccaggcagagggccaggtgggcagccacgtacctagactcatgacggagctgctgccaccccagcagatctgctcgccttgctgcttcttcacggtctccacggccttcgcagaggtgtcagcaactgccatgaccacttgcagcagctggggagggagggagggagggagggagggagggagggagcgagcaggcactaaatgccgctggtctcacgtagcgacggcatctcctgcttcccacccccactcacactgatcaggtggcattcacctgaaagacagccaagggtgagggacagaactcccagcggggaagtcaccaatcagagttctcggacctaagtcccctcttcctggcccagtggggatgccacactctcatgtcgctctggcaaccctcgatgcctagggacatgccagccagcactgcgtgtcctcccagccccagcaattggcaaggggggaaaataaatgtcccaagaaaaatggacaggagagggctgtggcctcaccatccctgatcgaggggtctcacaggaccagccagtcagaggttggaaggctcggagcctctcgcttagaaaaccaaaatgaacatcacggaatccttgagccaagggcagagttgcgcacgtgggaactgtagtcatcgtaactaaagccggctttttaggttggcctctggggatctcacatgtggaacaacgaaacaagcaaacattgacgagcccacttcctctcatcctgtctgagcaggctcatgggcagacaggcaggcatttgtctgcctgtctggcacagttcttggtcatccacaagaatgaatggaccttgctattttggagcgtaacgtgacaacagtgcggccaacacaggaacagcacctggaggctgggacacgcaggaccccacaccggatctgggcctagctagtgcctgctaaggtgggcaggtccaaggaccagaagcagcacctccccagcccactgaggggcccagagccctgccacgccactggccagcagggagcccagcccagcccctcccagcccctggtcctgccctgtggtcccttgtcaggggctgctgaggcccctgagcccaagcaggatataagctctcagtctgagtgaacaggggagggggcggttagaggggaggggaagggcacccttacttggctgtaggaagtcagattctggtgcgtggcctggatgatggggccgcacgggtggaggtcagggcctgggcgctggcagcactcgcccagctcgtcgtcgtagacttggagaaaagccaagattagctggtggaagtcggaagtgaccagacgcagcttctggtctagggtgctgatgtcggctgcgcccgcagcagccccttgctcatgctgtgcaaagtactgcaaagccagaggcagagtcccttgaggctgccctgcccaccagccaggctgccaccggccctcacctcagacactgcacacccagggcgaggaagaaagctttcagaaacagggacacaggggagctgtaccgagcgactcaggccagagcaagaccttctggctcccagcctcagccccctcactcactctcctgtgggccccggtctcctccgcaatcaaacagaggccaggccaagggctgccaggaggaccacgtgcggcaaggcacatggcaatgtgctcaggcgtgggcaccacccaatacctgaggctgatcccttcccccagccacgggacccacctctcacctccccgcggactgagcaccacagtattctagaacatgtcaggcccggtgcacaggcaacctcgcctaagcctcacgtgctgagggaggtgacaaagcagggccttgcctccaagcaaccccctcccaggagctagcaccctcacctccgttctaagcgcgtgcaacttggcagcactctcctgcagctgcctggcaagctccgccagcttctcctcctcctcggacttggcagaggcactggccctgcagggagagaaagggaacacttgcaactcaccgctgccaggggtgtctgcagtaacagaaccaagcagcctggggctgggacaggaggccagggtgctgccactgaggcctccaggagcacgtaccactgccagtcatcactctgcttgttgaggaggggctgcatgtccaggggccacgggtcgcactctggattcaggagcatctgcaggtgggggctagagaagagctcccccagcaaggcctcgttcttctccctggtgtcctcgaagtgctccatcaggctgcaaaggcagcccccagggccacaccgtcacaggccagagcactcgcccagcaggccctcagccccacagggaaggccccagaagcacatcggggccaggcacagaggccaggacaagccccaccgcgcagaatcctgccccacctgtctgccctggctcctccatttttgcccgcctacctacccacccatggagcaccctaggtgctcaccctcctctgtgcctggcccgtctgctctgaggcccacatcccaccttcatactcacccccggggccttgggcaacagccagcacccttgggacacagctgccccttgcccgtatgctgcccggcccctgattggccagccagatccccaagtggggtgtcacaccccagccagcatcagagggggagtgacaccccagcccctaccagctccagaactaggaccaagagaagcccgtcaatactgcccacctgggccatccacacctttacctcgagcaactggagcacccaatggtcaggctccggatggtatcgagcaactggtccatgaagtgtagctgcttctgggcgcaggcacagccctgggcaaggaagaccacagacattcactggctccatctaagccaggccaaggccagctgtccccagtgcccctgcccccacatgccacccatgccaggagccaggggaaaggaggggcctggcccatcaacgaccctgtgcctgcccagcaatgtcttggactagcaagtgctccctgcctggtccctgccttgggctgtaatgatgctgggaccacacgccagaacgggctgagcactgcagaaacatacaggagcatatgtgtctgtcgtgcagccgacagcatggcttgctgggtgggcaggcagcacacagcagggcctgctatgacagaacacagcccacagggacacctccaggacaaggcctgttctcctccaaggatcgccgtcccagctgggaacagatgaagccgacaggatggggctgagaggtggcctgctttccagccaggggactggcgttccagcccggaaggcccaggctccaggagcagcagctcctgcggggctgaattagtcccccactcgccggaaaggtgagtgagatacccatgggagccacccagccagaagctcaaggcttccggaagcacagctctttcctccttccagaaaagggaagaggatcgctgaggagccccaggacctgagaggctacgcctgctccagaaagcccccagccaggcctacttcttgagctctgaacatcctaaccacgtcaaaagggtcaactccatggcatgaaatgccaccgggagtgccttggccctttcactgtggcctgtgccttcagcgccaacttgtcacacaaatgctccttggcgggcttggggaagctgccagagcagctggctgagccagtccgttctggtgcattcctcagaaaagtgtgtggcaggcgggggcaatgataaggtaaaattggcaacactgccaatagcatagagcctgggcatcaccatgacatccaactgaggcagattcaggagcacaggtgcgagaagctcagggcacccaggacaggggcgatggcactgggagggctcactgcctgcacggtggtgctgaccacagtcatgtgctccaaggtgatctgggggcagcgggctgccacgtccccacagcactgacctggcctatctacatgctgcacagcaatggaatcatacactaccaagcatgaggctggcgaggatcacgcgtgtcccagcgcagatgagtagttgatttcctttttattgctagttagtttatacattcaccagctgatggacatttgggctctttccactttcaggccattaagaataacacttctatggacgctcaggtacaggattttgtgtgcatgtatattttcacttctcctgggtggacagctgggagtggaactgctgggtcacggggtaactgtgttgacatctttcaggaactgccagacttttccataacagctgcaccattttatattcctacagcaatgcagaagggttccaatctctcctcatcctggccaacactgggattttccttttttttcttaaacaacagggtcttgctctgtcgctcaggctggagtgcaatggtaccatcatagctcactgaagccttgaactcctgggctctatgtgatcctcccgcctcagcttcccaagtggctgggactacagcagtgtgccatcatgtctggctaattttttactttttgtagagacggggtcttacgatgttgtctgggctggtcttaaactcctgagctcaagcgatcctcctgcctcggcctcccaaagtgctgggattacaggcatgagccaccaggcccggcctccttttcttttttgattctagccatcctagtgtgtgtgaagtggcatctcatgatgattttgctttgtgttcctctaatggcccgtgatgctggccatctttgcttgtgcttcttggccatttgttcatcttcttcggagaaacgtctattcggacactttgtccatttttgaactgggttttctgtctttcttattgagttgtaagggttgttaatagattcgggatacaagtccctcatcagtcatgtgatttacaactatttaccgcctttctgtaggtttttctgtttcttcactttcttcatggtgtcctttggtggaccaaagtgtttcattttaatgaagtccaattgatctgttttttcttttgtcgcttatgtttttagtgtcaaattgatgactttataaaacatcactatgaacacctggatttgggcatacgtgaagggtgcctgtctactgcagcccctatgcttacgaggctcccactggcccctctctgactattgctagttggctcctgagtccctcggacgtgacccaagtcttgggtgactgctgctctctgtgtttccgcctgcattacagccggggtgtcatattgttctaggcattttcagggcacaagataaggaaatacatatatatcccttaatgtaaaaatatatgcggaggacgggcacaatggctcatgcccgtcatcccagcactttgggaggctaaagtgggaggattgcctgagcccaggagttcgagaccagcttgggcaacatggcaagacctcctctctacaaaaattttaaaaattagctgagtgtggtggcgcatgcctgtgaccccagctactcagagggctgaggtgggaggatcgcttgaagcccgggggctcatgctgatattcccaattaaaactcaggactacaagggttgaccctacctaatgatcttaaatctgtatctccttcctccctcctccaactcccaggtctcaataataccaatggaattctccaattcctttgattgtttatccataacaaggaatgcagtcctgctaagtgctgccgcaacatggacaaaccttgaaaaccttgtgctcagtgaggaagccaggcaccaaaggccacacattccagcattccactccaatgacatacagacagatggtaactcagtggctgccaaggcctgaggggaatggggagtggctactcagtggttcagggtcttttgggggtgatgaaaatgttgtggaactggatagaggtggtggtcatacaacactgtgaatgtactgaagaccactaaatcgtacgctttaacgcggcttaaaaattgaggacgaagtatcagtttgggaagatgaacaagttctgcggctggatggtggtgatggctgcacagaaccgtgaatgtgcttatgcccctggaccgcacacttaaaaatggtgaacatgatacaatttaggtgatgtgtattttaccataattttttaaattaaaaaaaaaaaaaagcagcagcgagctcccacagggcctgttaggaaattgtttttcatgactgacatggcagattttacgtaaagtgcactttgccacaatgccaatgtggaaatataaagcaagcgcagtgctcccacggctgggcagaatgtatggggcaggtgctcgcaggctctgagaagcgaatgtcagcaggtgggtcagggaggaacaccaggattccgagttctcctgcagactggcagggagctggccgtgccaccaccatcacggaagtgggtggtttatgtctggaggacaggaaaagggagccccagggaactagaaagtatccaaaagacagtggagaggaaacggctcaagaaagtgaccccacaaatctgtttacaatgcctgggctcaggcccacctgtgcacaagtggatctgatcttggtgagcccagcaaagtctcccaggctgaccactgggtggcgcacacacaggggggacccgaagagccatgcaaaggctgcagaaacagagctgatgctggaaggaacggcaggcaagaggcgggaggcggctgaacttgctccttaaacctaagcaggtcaagtgcctgctaaagcacaaatatgtatacaaatataaattgtgtggagaatacattttcccagagccaaagtaataggcaaaatgtcgagagaactacttggcacacggagaaccacggactctcaaccacaggagagaagactcactggatatggactttgggtgacaatgtgtccatgctggttcatggactgtgacaaaggagcccccgtgtgcagggtgtcgtgtccatggcgggagaggctgtgtatgtgtggggcagggggcctgtggagactctctgtactttctgctcaattttgctgtgaacctaaaactaccctaaattattaagtctactaattaagaaaaaaaacaaaacaaaacaaaaaaaaaacctcactggacaagtgacccaattaaaaagtgggcaaaggacatgaatatggaaatttttccaaagcatatacagaaatggccaacaagctcacaaaaagacgctccgtatcactggtcatggggaaatgcaaatcaaaaccataatgagatgccaccccacaccgagcagggtggctagaatcaacaagacggatgccagcaagtgccagcgaggacgaggagaaactggagctctcccgcgctgctgctggaaaaggaagatggtgccgccgcactggaaaacagtttgggggctcctcgaaaagttaagcacagagtgaccctgtgacccagcaattccactcccagctatacacccaagaggatggaaaacacgtgttcaaccagccagtgtacatctcacatggattcactgacgtcttatgtctccctaaatcgtagaaaaccagctgtagcccaaccaccttgtgcacatgttctcaggacctcctggggctgtgtcataggccattggtcacgtgaataaatctcttcagatataaaaaaaagaaaacgtgttcagtcaaaaatcatatgcaagaatgtttatagtagcattactcataatcatcgagtgaaaacaattatttcaaaatttagaaacgagaaggtgggtgctggagtttctttgacctaccgcagggtagatgagggacctcgggagaaactctcgggccacaagggcttgggagccaggcgccgggatgaatgaagaatgaagtcatcaaccaaggacaggacactttccatcccactggtcatcagaagccagagatctgcccctccctgcacggctgccctctcccctgcgccccagggacaaccaggttctacccaagagaatcccagcagttctggccccagggatgcctagagaagcagcctgcccgggcacccagccggccccagggcctgaggaacctcaaaggcactaggggaggaaaatcctcccacctcagccagcaccatgaggttccctgcccagggcagaaagcgtgcgtgccgtctgcagagcagacagaggccctcttaccttgaggagctcctggtcatctggcgcacacagcatcagctcgtggcccagcttcgtcatttctgttgaaacacaaagagcccatcatggcaggcacctgcccagacagcaggggacagcagacacccaggaagcccagcacccacagactagactgggtataggagaccagggtgggccaggaggcaggcacccaggtgccagcgctgcctcttgctgagtggccccacccctctctgggcatcagcttcctcgtctgaaaattaggaattgtacccaatgctctcccaggtttggggtcactcactctggctttgagcagaagccagcagctgcctgaggagtggacaggggtcagtgaacctctacagtgcactgtctgccactctctccaagacctcacaaggccaaagcaaatggactcaccgctcccatctggccatgtcctaaaggaccttcgtgccatcatctgctatcaccctgccagcagccctgggggtggaagaccttgttccatttcatgcatggggaacctggcgccgtgcacactgcagactatccagccacatctgccagggtgcccagggcattttctgagtaacttggagccagaaagcctggggccgatgccagacctgcccctccacctaaccctggagggtttgttgcaagaagtaagcagagagtctgtggggaagcactcagtaaccccagaaccaccatataaatgccaactgcatgcctaggcaagcctgttccaccactgcccttaaccccacatcctcaagtcctccctgacccctctcttcctctcagcgagtccagccaactctataaatccagatctggccagcgctgcctcctgcactgcctctccaaactttcacctggaccactcactgcaagagccccacaccgctctccctgcctcttccccgggcaccctgttcccagcacagtgggccaggggtgtcgttacagccaagagcagaactcggccttcctcggagtcaaagcccacgtccttctggggcccacatggcctggcctgatctggcccgtcccctcccaacctcactccttgccctgccctgctctccagccacaccagcctccttcttgtgcctccaagctgccaggcacagcccacctggggccctgtgcgcatgctcttcctctccgcacatgccgcgctggcttccgcccctcctgccatcttatgtcaagacagcaccaccctttccccaagccctgcaggaccctcagccctcagctggctgttcccagtgcttctcgctggcaggtgcatgaacaattctcccaccctctggccctgtctctccccgctagcacgcaagcgccacgagggcagtggaactcactgctgcaccccagcaccaggaacagcgcctcgcatgtggtggctgctccttaaccattcgtcggatgaattcctgaactatcctcacaccctactggtcctggtctctcccacctgccctctgacaagcctgacactcagtatattcccatgaggtaggcaaggctgggtttcatccccacttgacaggagaggaaacaggctgggaatggcggtgtcagggctaaggctgggctgggtcgggtcacacatgtgttggtgtgggtcagagaatctggaatgtaccagacacggcagctccagggagaagggcagtgcctctgtgtggcccaggccagcccaccggctgctctaaaacaacacctccttcttctggcccacttcagcacaggaagaactggccccagataactcatgtggcaatgccagctggggcacggatcaggactccagggtccagcttatctaccctggagtggccagaacagacacaggcccatgaaaaatttgacctttgacattccaccaacttctagagagatcaccatgaagatgaaaagttagccaccaacttggggactgcagttttgctcacctttatccaacattcattaccaggttaagcacggtttctaccaagaaatgatagaaaggaggttataaggcaagctccgctggagagcagcaggtgcccctagaaatgccacctgtagagagcgtgtcacacaccactgacacagggagacggaaccactgctggcatcggcaaaaatctctgtctctggccaccagcgctgcagggactgatgtgctctaggtccctgcgagaggagttctcccacctgccatgcctagggaagggtggggttcaagaaggctctagcaacatccacacaacatgcaccacctaaaagaaaacgttggtccaatggaacatgcaccaccactccataaggaggctgtggacaagctcagaatggaccaagattccacctaccttggatcttcacctctgttgggacccctttcagtgagctgaacctgtcctgcagtgagggccagaccctgcagggaaacagcagagctggtcaggccggagacagccagagaatccccctgggccctctatacgcgctggaagaagtgaattcctgtgcacgtgctcaacggcacggagcggctcactttaaagtggttacttctgtgtcacgtggatttcatttccattaattattagggaaagaatattccaggaagtttacctcggaaatctggatacagaaatgaatctggatactgaaatgaaaattcttctcaagaccaaaaaaaaaaaaaaaaaaaaaaaagatggctgcagcagaggcagagagggaagctgccagcactcagggctctttctcgaaatggcgcagcgggtgggttttgagggctggccccgggctcctggcaccctccccggcctcgcctgggtcggcatcaactgctccagggtggaaaactttcttcccacccggccctctgcagaaaaggcttgtgaggcctgcattcagtcatgtgggggctcctgccgcaacagagtctgtggtcacagtcgaggctcatcaccttgggcacggtgaaggcttgcccttgactgcagcacacaggggccgctcagaagcatgtcaccttaaaagccatctggtgggcaaaaccagatccacatgcacagcgcatggaaggcaggaagtcccacgacacccagacatgcaccacaggtgacacacggctcagccctccactgggtctcctccttcaggggagcacagcccaagcactgcatccccagtcccaagccccatgcctcaagcccggtatgacactgaggcccagaaacatcactccggccgctggggccacaggctcttacccgggagccccaggcacctgccaccacagcagcctttcataaacaagaaggagtcgctttccaccaggctgccagagcctggctacacctcaccattgccatcactctaggagcctgctgactcgtgtggtgggaaagggctggtggctgttccctggagaggccacacttgccccagaactgcaacagagatcgggctgggcttggctgcctccacagcaccacccacctctgtgacttattaagacaaccgtgggttctgcgcaagcggggttggggaaggaagggggaggccagcaggctgggctctgccagcggggttgccgagaacatctctgagcacaaggctcggaggagcagagggcactcacccagcactgtgcaagggcgggcacagtaaaccctgaacacactcaaaacccacgctgcagaagccccagtagccagactcagtaagggctgtcactcaagtcaccgcaccgtcacagcagagggcagagcaggaacagaaaatgctggaggccttggaggccccaaggaaagccacagggccttgacctccacaatccagggggctccatgagctctgccccaacccacaccaaggaccaacactaggtgcagcttccaggttctactgggaggagatgaaaaggcggccctaaatggggctgacagggtgcggtcacgtacaaagaaaggcaatgggaaattcacaggaaaactcccatccatctgattctcctgtaggaccctcaaaaggcctaaggaattctcgccaacctgaaatcagacaacgtcatcgtatgctccctggcagctttttcaaaggattcggtttctggtatttacagaagtactacaggttgaatatccctaatctgaaaacctgaaatgctccaaaatcctaaactttctgatcgccgatatgacgctcaaaggagatgctcactggagcatttgagatttcggattttcagattagggacactcgaccagtataatgcatatattccaaaatccgaagaaatcgaaatctgaaacacttctggcccccagacattttggatatgggacactcaacctgtagaagcatctgaggggcgtggctttggcctcctacccgtccctctctggccagatgaccccagttccccaagtgcccccagcttccacctgagtcaggcaaatctgcgccccctcccacaagagcctcctcctgggagctcgctcaagaccctcacactccacccagccatctccagtcctgcctcacctcccagcctcccaggttcccaggccaggggctggtccctccagggccagtagtggctgccagacaagccatctgccactcagcgcagggctccttctgtctttccctggggtattggtctccctgcctgcagccattgccctccaaatccatctgccacagagcaccctgagtcaccttaccaaaatgccaatctcagcacgtcgctccccaggttccacgcctgccctgcccagaacataaagctcaaaggccttggcacagcatgcaaggccctgagggagctgccctgagctgccattccagctgctgctgcccagctctctctcccacacctcaactccctgctcctgtccaaacgagcaccccgctgttaccgtccccatcccagatcaaatgccacctcctccctgccaacatccacagcacccaactcagactgcagtgctgtgcatcatttctgctgaaccccaggacttgtacccactaaatacccagctcctgaggacacccagtcacgtctgcagcgcgtggaatggcacacaggtgcagcctggagaaccccccgactgcacggccacaccatgctgcggctcccatactaaagagccggaaatgacagcaggccaagagtgcacccacaggttgagggctccagcaggggcagggtgtgctcaaaggctgtgggcatccagagggaagcggaatacattctgccctgggaacaggaaacattttaaaaggagacaggacgtgtgagttgggtctttgcgggctgtacaggaggacgtacgacatgcagagactagaaggccatttccaggagggggaacaatgtgagcaagagcaaaaggttatgaagcgaggagctgctgtgctgagccctggggagaggcctgaggaagggcctagaaggcagaggcaggagacgcctctggaacagcaagggctcaaacacaaaaacgcctcctccttcctctgggggcctgtatccagctgggcgtcctgctgatgtctctggtcctggcgggccagaccggctggatgcaggttggctccccactgctctactgccaggctcccgcccaggccccttcctcaagcagcaagggtaggcaggccgcaggctgaggagggggaggcccgggcctggactcacgagaggctcctgtaccaacagactacagctgttcctgagcatggcctgggcacacacccaatcccacaggagcctgtgctctgtgggaggcggggaaagccttctccactcacagctgtgaggcagtgagacagaccctcagctcagggactacgtcaccaggggaaggatgtctgccctgggaatgggacactctggatcatttcctccaccatcactcaggaagtcaccctgtcaccatgggcttcatagggtgccaggcacacaccatgctacaccctggcccaaaggcaccagaggactgggaaacgggtcacggcacagaagctgacaagaggtgacactgcatgaggaccacttggccagctgagacccagccaggagcccacgccctggccctgcctgtcactcctccactgggagaccagagactgttcatgcctccagcctgacccttggcttccgggtctgagaaggaaaggactggaatggagcatttctcaggtgcctgccagtcctgaacctccaaactcataaggcaaggcaaacgctgagggcaagttcagcactgcagcaaaggggtggctggactagcccagcaccgccaggggccactttgccccaagtttgatcatgcctgtcaccagtactccttacctacacagctgttctcacgagggtccaggctagggggtggagccctctgggaagacagctactcacagtaaccacaaaccccatcttccccaggtggggctggctggcgcccatgcacaccccaggtgggaagaggaagaaactgatgcattaccgggtacacatccactctaggatctccaagcggtactctgaggggctgcacagcagttcctgaattgtctttggctctgtgatatacagaccctcgaggaaggggcagtttaggtcctaagcaaggaaaaggaaagcaacattcactgaaagtcccagtgtacatcatttcattttatttatttatttatttttgagacggagtctcactctgtcgcccagcctggatggagtgcagtggcatgatctcggctcactgcagcctccacctcctgggttccagcaattctcctgcctcagctcccagggtagctgggggattacaggcatgcgccaccacgcccggacaatttttgtatttttaatagagacggagtttcaccatgttggccaggctggtgtcaaactcctgacctcaggtatctgcccacctcagcctcccaaagtggtgggattacaggcgtgggccgccgcgcccagtcctcagtgtacatctgcaagctcccaggaccctttcctttacccgcgtcctgccatcttgccaagagttcaagtccccccattcttaaccccacatctcccgcggcatgcagaccccacctctttcaagtactcccactctgggctcttgtggcagcaggacctaggagcaacgcctgagactaagacttaagagagagtcctaggtttcgggactgagggaaaggggagagggaaagggagagggaccactgagccagtcgcggacaggatgggggagtgtctggggggaggagcgagcgggccgaggggacctgggacagctccctaacctcgtgggccagctttcctcactgctgcagtgagggctctgtcctgtggggctgtagagggcttctggaggctatcacccctggcatctgacaccaactgacaccaagccctagtctcgctgacttgacagagtggcacgaggctctgcccatctgtccccccagaccccgcaagatccctaaggccaggcctgggtcctctgtgtctgcacttgctccgagcgcccagcgcgggtactgcagttccacaggcggtgctggccccaactaccaggcacgggccgtggagacagcaagaacgaaggcctggggcacaccaaagggcaaagatgaatgatccacaagcaccccctgctgcaagggaacagggcgcagccggaaccggcgacggtggccgcgtggcgccgcggacttccgcagcaagccctcccgggcctcgggcggggccctccccggtcccccgccctggagtggctttctgggccaacagcaccttcagcttcccgaacacctccacagccgccctggacacgctgctgtcgccctcgtcctctgagtagtcgtcgccgccacggccgcagccagcgtcctgccccgccatgtttcgcgctccgagccgcgccccgcccatgccctggcttcactggccggcaagaccgccaatcaacctccagcgttcttcccgcccacccgcctgcgcccacccccttcccgaccgacccttcccattgggcgacatctccgcctgcgcgggccccgggctcccaccccccgccccggcaccacccagaggcaggaccacagtgaagcgggcagggcggacacagggaagggggcggggcggacacagggaagggggcggggcggacaccgggaaggaggcggggcggacaccgggaaaggggcggggcggacaccgggaaggggcggggcgaacgggccaagctggctctgagtcgcaggccttgctggcgtcgcccctgctgccggccgggaatgatgatgcgttgaagcgaggctcttccaggagggggcgctcctgccttggtcgggttctcctgggccaccaccactaaggggcaccctggttcccaggaggaccaaggggagccttgggtgcagaatggaactcggactgaagcgttcctctcccagcgcggggctccgtcttctcttcaccatgctcacgctgtagttagaaggaaatttcttgtcactcaccagctgtgtgcctttgaaccagttacctaacctctctgtgcctctttgccctcacctaatggagctaatgagagcaccttacccactgggttgctaatgaggatggcaggcggtaataattcctgtggaatccctagaacagtgcccggcgcatgcgaagaaccacgtaaatgctcactattgtaatacatgctgggccctgctcccctcacggctcctggggctacctgtggctccttcctatcctgtctacttaacaaatttttctacatccctcaggaccctcaaactcaatgcgtctgcaatgaaatatgtcagtcgctcctcccccagacctgcaaagcccccagttcactgaatgccccttacccagggacctgctgattgggcaaggcaggaaggagttggagggtggcttgtgcccagtagccaggagacagcagcaggcagctgccactgtgccctcctctgtgccctaccctgccatctcctggagggtgggatcagggggcaagtctatagtcagggagacccagggacctgctgggaggcaactgcagtcatccaagtgacaggaggggacttcactccgtcctgggaggagggagcgggcaggagtccgggggtcacaggaagggacctcagcctgggaggccccgacacaggcccagcgaagtgcctcaaggttgctctctacccttccacgtggctgctgcctcaggcccttctggtagctgagggctgtcaaaggctttgggatttttttttaagcgtttttttccctcttttttgtttttgtttttctttctttctttttagaaaatttcatctcaatcacagccccagctcagacattcaaattcttgtgggtttttctgtggatctttcctaggactggggaatttggcggaagaaaccacggcagtgtggcagcctcccccaaccctccccatattctctgctcctgaggaccgggaagaaaccagctcctgtgtactctggaagaaaatctccctcctccacccagctccacggagccagtgtgctcaacaggcctccccaacctcagcagttcagtctatgggaccctgaggaactggcagggccttgagaggcgaagatcatcttgagaggttatggaggccatccccctcatggagaacctgttggccagccctcagcccctggagatggtcgctgaagacccagcagcaggctgcagcttccctgcccacgccaccccaccacccaccacccaccacccaccacctgccacccaccacccgcccccagaatcatagcacctcccaggcatcttcctccggaaaagctggaggctggggagggaacagagaggctgctgggcctctcaggaagggggaaagaaggggcccagaggtagaagcttctggaaatgtggactcaagctcagtccaagaaagcactcctcccagaaatcactgtctgaacaccagctggctgccaggagaggaagggagctcccggtcctagaaggtctacaagcccagggaggtgggtgggcggggatgtggagggttgagtcctaccatgggggagggagggggcacatctctaagggacattccaacccagagaccccaggttctctgagggaggcctgggtgggtcaggagccaaaaatgtggctgaaggacccattgacctggaggagggatgttggggggaagctgtggatgtggcggggaagctggggggtcctggtcatggaggaaagttggccatgcgtcccagcagggcctcagccgtgtcagtgcttggaaaacacgttggaaaatgagactggttcacggcactggccccgctgtgccagagatgggctggcgggtgctggtggcattcgagacctctcagtttgtgtggtgggcccagagatatatggccaaacagttgagctcaccaagtgggcagcctccctgacctgtggagggtattgaaaaagtcctcagagcatccgggccctgctcttcatatgaccttaagggcagaccccacggtgcagcgggaatcaaccagggaccccccaatcccccaaagacaccgcgaatcaaaggaagctgaagtccaagggctttcctctctgcagaggcgggtctgcttctggcaggggctggagttagacctgagggggagccaccccacctgggggcgcctaggccctagaatgctgtcagagctaaagccctagaaggccttgctccacggggccacttcgactcccggccctgaaccagggaacctggggaggagcctttgagggactgaagtgtcctccatcaccccccacccctggccactaaagttcctcagtaagggtggagagtaccaaatgcaagctgttgaagacaaggcaagtgtgtgcgtgtgtgtgcgtgtgtgtgttttggggagagttcaggtctaagatgagaagctgatcacacccatgcgagaagcaagtggtgagccctggcattgggtttgagggagaaatgtgacagagtaatgaggtcaggctcaggacggtctgagtgtgaggctctccgcaggcaaggcaaagccagggggctgcctctgcctcccctcccctccctccccgtcctgtcctcctctccctcttccttctcctcatctcctccctgtcttcctgggacctctctgctgctaagctgccaggctgagctgttggtcacccatccaccctgcatcctggcatgcaggctcagtacccaggtcttgcgggcagcccacgccatctgcaccagccaggagcccacccgaaacccagccctatccttgcagatgggggaagggatggagaacacgaaagcaggggtgggggccttgcaaatgagacaaggaagtggctgtaagcttgggggagccctgcggcctgtggccctaactctggagggaccacactgtcaacctgggagctgcctgaagactcaactctacaacgttctcctcctaggcctccgtgttcatctttggagtctactggcatatgagaatggagaggctgccttgggaccttggcttcctcttcctgtcacttctagtccctatgctgggcctcctgctttagggccccaccctcacctcctgcagttgaggggccctcacctgccccatcctgcccccaggccaccagctcctgcaagagcacattccgcagcgcagtcagcatggtaccaccatcgccatcaccatcgcctccagtgggcctggaggtgctaccatcacctaccccgccctgtcccccaggccacaggctcctgcaagagggcagggcctgcgacctagggcgacccttgctctgaggccagaggcagttgtagggggtgtggacagagtctggctggcagggaggcagtggctcagcggtccatctttgtcctcctgccccgggccccaaaaatgggagggatggtctggggccctggggacctttgggtttcccgcttctgccctcgaactgcctgtttgcagtggacgcaacgggagaggcgggggcgggggcgggggcgggggcgggggcgcgggcgctggcgcgggatgggcgagtggctgcgcgtgcacgcggctcgcgggaggtggcgggcgggggcgagcgctgctgcacgtgcgcggggcgcagccgcgcaggcggcggcaaaggaaacggcggcgggcgggatcgccccctccgcggggagacgctcgggtctagacggcttggcaaggccggcggggctgagtcacatgcgtctggagcgggaagcgagggcgccaggacgggaacacgaacgtgcccgctcggagggccggccgggggagggggcgcccgcctcgccttcttgctttgcccgagctccccggccgggcctgagctccagcttctgcccaacctccgttccctgccgaggtcctcgaagcccaccggaggggatggggcggggccgctttcacacggagtccagcgaagccacgctatgggcgggaatgaactcgaatttcacacgggcaaagagggtgggaaactggcccctattctgcccccatcccgaccacggccctgctccctatgggctggtccctgctgcgtgccaccctctgcagtccccctccactggcaccctccaccccatccgcagccacccttgtcccatttggggtcctgtgttccccttccctcctttttcttctccacccccaccccgcagcaggctctctcgctcaggatcaccaggtctcaagcatttagtgctcaccaaagcgtctgcaagaaaagtcatttaattgggaccagatcctctgaggtttcagtagcattaaaataagatgggtttcctctagggaagagttgcgggcaacaggaagagggcatggaaaatggggcttttttcttctccaagctttaagggggaaaggccccatattgttactgacatataagatagctgcaggcgcatgtccccagagaatgccacccatgtgccacacactgctgtcgttttcactcagacaacatgtggaaagctcaagaatgggcctgttccttttctctgggggtcaccccaaggctgtgtctctggctgccctgggccctgggaaaaggacaggcacgtagtaggtgctcctgcagagagcaggagagcaggagagcaggaacagcccccagaccttgaccctgaggcccaaatgctcctgaccccacccgctcctcctcgcaaccccgcctccacccttggccagccactatcacctggcccctggcgggctcagctgccacacggtggctcccacctcctacccttatgcccccagtacatctgctcgtgctccaccccacagcctgaggggggccggatcctgtgactcctctgcttagcagtccaaggtggctccctgattctttcaaggacaaaggcaagccagcccaccgccacagacaccttcccacggctcactcagcctgctccaccacattgctgtcattgccaatgctcaaattgggcccaaccctttctcacctggggcctctgcactggccatccctctttttcggagggctctttctgtggctttttgcatggccatggcctcttcactcatgcctctgcccaaatgtcactttctcacggtcctcacctgatcccctgtcagtgagcaaagaatccactgtccagtcctcgttgatgacagccttgagggacaaacagcattgctttggcatcctccaggctaccaatctgagtcccagcttgtagagggtatgtgtgtgcatgagtgtgtgaagcgtgggctacatggaagggaagggggaggaggacaagggacaggagtcccttccttgaccttagaatcctgggattgtacaactagaagcgaccttgatcatgtaatccagcttctctaggcgccttctggctctcagattctagaactttctaaggagcctgtttccaccatactgaaatgagaagactggggcactgaggagggagggaagcttgttcctgatgtcacatggccagtccgtccatggcagaactgggagcccaaagctctttccagcaaccctcgggctgcatccctggttcctggaaaatcccaacagccctcccaccctctgctccagacaccgggctcgggattactgttggcttggggcctgcctgtctcagcacaagtccgtcagtgagctcttgggcgggggggagggcaaggcagaaacttgccgggagcctctggctctgctgagcccctgaaggctggctctgctccatgggggttccttcaaggtccccacaatggccgggtgccctgggactggacagagtgggcagcaggagtaccactccccaggggcccacccaggtcagccaccaggctcccgaccaggggaagggcagcgaggccaggcctccatgggagctgggaactgagagcaccccaggcctcaccccttcctgcctaggtgggtaggagcggagtccctccctcctccaggctggctgtgccagagaaacctgggagcaggcttcccccacccccagcccagctaatgggaaccagatggcaggatgtttagtcagcgcctggggagcggcgcaaacaggggaaatgggtagggggccaggattccagaatccatccccaggcagggggaggggcggagccggggttcccatcaccgtccagtctcccgaccccaggtgctaggctcagctcaggcagggacctaccccgtttctcaggcgatgcctggaccaggaggcaggaggactggcctctggtatcgagacttgggtgagccccactccttctctgttccttctctgtaaaatggggggtcgactgtgctctgtcttgcaggatcctggggcaagcttcacttagtcttggcagcatacttcaagtctgccgtgccccagtgctaccctgtcccagcttcggcagctgcccccaggcaggacactggcccacagccatcctgtgtcacccacaggacgcacaaggagatggtggcctcatccctgactccagaggcatttgctgactccctagatggtccctgtttctggtctgtacgtggcagggtccaaattcaggtcagaaaccagagccctggatggcgagggtaccctggatatagcagaggaccccatgtggctcctacgggactgttagctggagcggcagctcctcaaggagcccagtgaagacccagttgccaggcctcctccccaccttgaccagccctgcacccctctggatctcacacattgcctcattgccccaggatggagactcctgcctgatggcccttgccggcccctgcccctcctccactgcttcccttctcccctccacccaagccttgcccacaattaactcatttcttaagatcgcttccaaacctaagtcaacgctggacagggctgtaggaaaagcttcctcaatactggccctgaagagccgagccagcggtgagatcagtcctctctgccagcccccgcctgcctgctcccacaaaccctggctcccacagcagaacgcggggttggggctgcagggacaccccagttggagcagggacttccggcagccctctgagggtggcgggctctaggaactggagccagacacccccttatttgcccctcactccaccacacgcccctctggccccacccagcagtcccctcatcgagcccagcctattttccacctcatgtcatcctgacccacaggtgcccctctgaccaaaaggatgcgtgcagcctaggcacatcagagatcccagactgttggccaagaagtctgggggggacctgtgacatggcttcacccaggcagtgcctggaacacccatgctcctatgtagggggtcgggacagccacagaacgtcaactctgccccctaccccattttacagaggagaaggtagagacctggagggcaagcagaggaaccaggagccagcccagcccgaggcacacccatgcccaagcagcactggggtctcaggcacgggaggcataccctcgccgcctgcactgtgcccacagattctatttcctctggaacccggaggcctccacagtgctgcccacggcagaagcccacggccttggcacccaccccctctcctttcgcagccatggatgcagggcccagcagcctgcggtggccgacccgctctgtggtgggcctctcaggcctgccacgtgtgagacagaagccccattcatggaggccactgggccagagccagcggagaatcaatgcgggcctcacagcaaaagggcaggaccgtccggtctgaggaaagggcaatctgtctttctcttcaggtgggagcagtgcacgttgtggggagttgggggcaaggtcgggggaggcgtttgctcgacagaaggggggccttcccagggaagggctggggtgggcagggaagactccaagtgccgcagccagggccaggagctcagggagcaagaccaacttgtgccgtccgccatcgtcctgccgtggccaccaccgtgcctctcccagctctccttccctccatggcagccaagaggagtgtgctgctccccatcctggcactgtgggcggggagctgctcaggaggggccccaccaacccccatgggcttggctaccctgcagctgctgcccagcccaccaggggcccccgacggtgagtagctggcaccagcaggaagaagactgccgcaggctgtccacctcaggcccactttgggtactcaggcagggctgcaaagggcccatggccctgagagagccctccctggagggcgaggggtgtgcgcagactctaggggcgagggagggaagaggccttcctaggagcgggcgctacagtgaggctgagagcgggctggggtgtgctggggaggagttgctctggctgccccagtgcctcctgagacaggaagaatctcaggtggctgggagtatagggcttgggggtgaagtggggttgctggcagagaggggcttgaggggcccgaggacatgggctatgagtgtggcctttgtcttataggccagtggttgtagccacacttggtggccctgccccaggcttgggggtagggcgggaggggccaggtgggtgggtctgcccctcacccctgcagacagagcggtgccccccatggttggccctggttaaggaggagctgctccatagaggacaggaggcattggggttatcaacattcctccaaagtggctcacagaccccttgaggtggcccctgggcttgcctaatccccaacaaaccccctgtagcagacactggggctttcacttctaaaagcaaattgtgccaggtcgcagcgaccccttcatctccccagaagctgtccctaggaagcacgtgtgaagtccttgctcactaatgggtatggggcaaaggggatgctggggaaacgccctaccccccacccttgggacacactggggaagtgaggggaggtgggacccaaggtcccttgagcagcccaaggctttctacccagggctgctgaagctccctgggcccaaccaccggtccaacccctgggcctaacctataggcccagccccttagccctaatgggcctagagcgccacccacccccctccccagcagtgaggagctgtgtaagttctgagaggtactctgggttactggccccaggggctggtggcctgctgctgacggtggggacactctgttctctcgccagtgctcctcaggaggtaagggaaaggcggggcggggggaggcctgggtaaagaggaagggcgatgggctttctagcagctgacagccccttggggaaaggaggcaaggcccccagcccacactggctccttccgcaggtcagctgcagcccatccctggcatcggccacccagacaagcctgaggctgggaagctggaccagttgcgggatcagcccaccccgaagcagggagctcaaggaacccccacccagtccccctccactggctggaaagcgcttcccaggccagggctggccctgaggaaggagtcacccccagtgaccttggagcaggagcagggtcacaacaagggcctggtcgctgagtgggctcagccccaggccacagctgccatgagggctggggcagggaagcccgaggccttgaagctgaggccctggcaggccggcagggaccctcaagctcaagagggggcagcagtcaccgaggaggaccagggccagaggacaggaggccgggaagacaagggaaggggcctgaaacccaggaggccccccaaaggtgagaactggccaggacaggcggccttcaggtggggcctggggcctgctggggctgacaggaccacgcatgagtttggccacccaggcactgccccgttcccggtgtttccaagccaagtgccctcgtgtgtggggtgggagggaagccctccaaagtcacgtcccctccccagcctcagagcccccatttgggcctttgcccttggtgccaaggggaggggtcccagtaacctgtcgctccaacccaggctggctgagtcactggcaggccctgggagcctcgggcaagcccctgttcctcagtagggcccctgttgcttgtgacccagcaggggctgtctctcttcctccagggacctcccatcaacctgggctgaggatccggcgcccacagaaggaccgcagccgaggccagggtggcggcggcagcacctccaagaccccaggccatgggtggaaaagaccaggaagcacacatgggcacaggcacaggcacgcagacctgggcaccacccagcaggccatgccctctctgccggcctcgtgcctcctggcccaggcagtcatcgcctgtggcaatgtcaagatgaagcatgtccctgccctgacccaccctggtctgaccacactctacctggcaggtgggtggcctcctcgccccacacccacccctgcagcaggggtgagaaggctgagacctgggctcccaccctggctcccctgagcagccctgtctggtgtgggaggtacagagtggcagcgggcagggggcagagaatatggctgccccatgtgcgcacagagaatgaaattgccaagatcccagcccacacgttcctggggctgcccaacctggagtggctggatctcagcaagaacaagctggatccccgaggcctgcacccccatgccttcaaggtatgctgtggcccattcacctcttctcgggggccggggctggggctggggctggcaggtcccaggtgacctgaggcatccactcactgcagggtggagctgcttagggggtaaggcctggaggaggcactgcagagagcagccagcatggtgggcttccacaatttggtgtgacgtgttccatcgctgggagtagggggagcagcacaggcttgcaggccctgtataggagcaaacagaaaccttcccagacaggcctggattcagtgggaactaggaagccatgatgccaccaacagagtgcccttggtcaggatgggcccaaagccatgcccaggaaggcctgtgccccgaccagcaggcccccaaccccagcccacctattccccatgacctcccagaatctgatgcggctgaagcggctgaacctggttgggaactcgctgaccacagtcccggccctacctgcctccctgcaggagctcaaactcaacgacaacctcctgcagggcttgcaaggcagcagcttccgtggtgcgggcgagttccgggggcagggaccgagggggcaggcctgggcaggtgccccacccccaggacaggggctggcaaggggtgggtctgccctctaggaggcacactcgggagagtgcccagggcagcctggctggaacgcagaggagactgccagcctgggtaaggggccctggcctctaggggcaggcaggggttctagagctactgcgagcagctctgcaatggctcaccgcacccctctgcccgcctgcagggctcagccagctgttgacgctggaggtggaagggaaccagctgcgtgacagggacatctccccctggccttccagcccctctgcagcctgctctatctgaggctggaccggaaccggctgcgggccatcccacgcggcctgccgtcctccctgcagttgagctggagcccccaggatggggaggcaacattgttaccatcaaacaaccctgcctctgcttctgctgagggggcgtggagcagcccatagggggatctgtgcgctgaaactcacgaggcttcaggcctctcctcagcttgacctaaccttccagaagcccacagtgggacctcctggatggctctgcaccctctgggttctctgagtaaggcccataccctctctctggaccatacagtcccctgaaaatccacccctgccatgggcctgactgctcagggcagagactggcacctgagttgcacagacatggctgggtggaaggaggcagtgccggcagagaatgggcacagccagagttggagcctgaccaggtggccaacaactggcaggtgggcccctcaccccaacccctgaccccgaccctaggagctgcacctgggcaccaacctcatcgaggaggtggcggagggcgcactgagccacatccacagcctcagcgtgctggtgctcagccacaactggcttcaggagcactggctggcaccccgagcctggattcatctcccgtgagtggcagtcccagagcttcgccccaatgggcattcggaggcagagagcaaggatggcccagagcagccccgagaggcaggtggggaaggcggagagggcaatgctgagccacggagccccagagagggccaggaggcagggggctccaggggaggacttgttccttgggcctggtcttcggtgggtcactggggtcacctccctccctgcttaggttagcctgggccctcagtcaccacagactcttccaagatattgcttgcaagcttgcaaggccttccctctgtccctcccacccagcagaatcccctttgccctcccgtgcctaggcctgccctgccggcccccaggaagctcacctgggaggtgccacgggcctggatggagggcagcagtggtggggagagctggcccgacgatgggtgcagttaggaggtgacaggggcaggaagcagcgcggaagggctgggggcacaggaaagtggggaagagaagtgcatgcatgtcctggggctgccatcactgagtgccacaagctgggtggcttcaaacaacagaaataacctctctcagttgcagacgccagaagtctgcaatctagatgttagggggccgtgctccctccggaggcctaggatgggatccttcctgcctctcccagcttcagggggctccaggtgttcctgggcttgtggctgcacgtggccgtctcccctgcgtgtctccctctgtctcgtcttctctcttctgtccctcaaaagcacacctgtcatgggagcggggcccagccggggaacccagatgagctcagctcgacatcctcccctgcaatccttacatctgcaaataaggccacgttcacaggttctggtggacataggttctgggggccactcttcacctcattccaagaaaagtcaagggcaattccctggatctggttgggacagctaggtagagatgctggcacacaggccactcacggcaaccagatgctgtagggctgtaggagtcgggctagggagtcaggacacggtcctgggaacagcggggagggctgggggaggctgggtgccaggcgggaggctgaggagggcctgatgaccaccaaggcagggtggggccgcagtggggagggaggcgggggtcgacagacagtctgacccgccattccagggaccagagcctcccgccctgcatccttgcgttccaggaaaaagttaccaggacgtttgggtttaattattcctctttcctctcccccacttgccaagggggcaaaggaaagcagacagcagcctgggaggggctgcccggccgctattccactcccgccacgaggcctgggcagggggctggcggccagtcaagccccagctgcctcagccgcggcctctcctggactctggcgccacccatctcttttcgggctggtggaaaaggaggggaccgagaggcacaggagcagcccaaaaggctgaccctagccacgggggctgagggtgttgccaagagaagccttccctgctccctctctccatgttcttacccattccagaagcctcaccaccctctgcccttgcacacctgcatggccacagggaccagggcttcctgctgctggggtcagggcctcaaggagtcaggtgtccaccatggagcgaccgggggctcccagctgaaggtggcagcctgaactccactatcggacagcgagggctgggtgacctcccagggtcccccagccctaaccctcatggagcctgatctttttctccccacacatctagcttccacacatctgaggataagactgggagaggcaggatgagggcaggagagtggaagggacagaggagagggcttcgaggccgaggaccggcaggggcagagagctcccctgccccacttttcccctagattttaggcgtcaccctctgagctctgtcaggtgtcaggattaggagacaggagaccctgaggcaacacctggagggaaggaagtgagtgggaggacagttcctcagtctccacaatgacagcaggtatcgctagccctgcagggagcaaggaaggcccccacccagatcctctaatccctaagccttgggggacagaggaggacataaacccacacagggcctggcctgactcacacaggagttgccagagtcccagctgttgagagttcgggttgcggctgccatctcggagtgaatccccacgctcgtcttgggagtgtggggctgcagcccctggaactcccctctaggagttgccaaccgtcagctccctctgcccctgtgtgccccgccccacaggaagctggagacccttgacctgtcctacaaccggctggtgcacgtgccccgcttcctgccgcggggcctgaggcgcctgacgctgcaccacgaccacatcgagcgcatccctggctacgcgttcgcgcacatgaagccaggcctagagttcctgcacctgtcccacaacaggctgcaggctgacggcatccacagcgtgtccttcctgggcctgcgcgcctcgctggcggagctgctcctggatcataaccaggtgcaggccatcccacgcggcctcctgggcctcaagggactgcaggtgctgggcctgagccacaacaggatcaggtagggcccccctcctcgaccccacacctgtggccgtctccacccccgcaccctgccagcacacagaggaagaggtaccctgaggccaggaggccctgccttctggctgggctaggacaggctggcctttgggctccttacccacaggccgcagaggccgagggcaggagtcggggctcatccatcctcccccaatccagccatccacccatcttggttgccatgatggaggctgtgcccagtggctggcaggcctggaaagccaagggcaggcagtggccggatgctggcagggctccagcctggagcgacaagggctggggctggaggcctggcactgagcctcgagttgggagggggccaggaggccgcagtggtctctgaagcccgccatcactcctccacagttccgattctgtggctcggtcttactgcttctctcagggcaggggtctctgtctcttcttgaatgatgcctaccccgtctttccggggtcttctctcccctgctctgccccacccctcccttgcagacaagtgcccttgaattccatctgtgacatgcgcgtggctcaggactccaaccttacctccacacacctggagaacaacctcattgaccggcgccgcatcccgcccactgccttctcctgcacccgagcctatcacagcgtggtcctccagccccagcggcggggggaggagggctcctagtcctgcctgccgccttcctccagcacacactctgcttctcgagggggtggaggggcaggctgaggtgtgcttggcctttgcaccactgggagaaaggtctagaagaccccactgcttccagtgcacccacttcccattgactggtgaggccgcttcacttagcaaatggcccaggggcgaaaggtggcactggtttgtacttgaacataataaatgcagcttgggcaggctcaccagccagcctccctccctccaggagctacgctgcatgtcctggctctcccatgtccgtgcggttcctgggctgcacctgagactgtcagcaaagagattcagagggcttgggtcccacagcttctctgagagcctccccacccccaccctgcctcaccagggtcctgaagtccttgctcggtcccaagccatcaagaggccaggctccccacccttgcttggggcagcatctgcacctgatccgtctcatccctatcctgggcctggacccaaagaggtgggcttggctggcagagcaggagggtgtggaggttcagggcacctgccattggtcctagagccacccacacctgcactgaggcctggggcaggggctggtgaccaccgcacagtggcacctctcgggaagcccctttgcctctcccttgacacctcccccccattcctggccccagaaccctcatcccagcccccaacatgcacacccacctgcaagagaggtccccagggccccaccctcagctcacagatgagtaacttgcccagagatgtatggctggcttgctgtgagaccaggctgtgcccctatctgacctggtgccagggaagggtggggagtgagcacgtggtctgtgcaaagccaagccccgccctgagcactgggcaaggaccacccctggccagagtttctgactgtctgcctgagcgaggccggccctccatgttgacctccccatgtgccaggagtccctgggaagtgacaactcagccctgccgagccctgaagacagactggccagatatgctggtggagacactgggtctgcggagccctcgaaggccactgaggccattgccccgttggcctgcctgagtgagggggcccctgggaaccggatgggtttcctgggacagcctccacagctctctaggccaccaggccctgtgccaggaagggatagggacaaagggtcacaaccgcagggaacacgacagccactgccctgggatggggctcacagagacagccaggtgacaggcatgaaggatgccgcaggagagggcccagcagagacacagcccagccccaaggagcgcatggctccgtccctgtcctctgtccctctaacttgtgagcctccagcatgcccctctggccctcgctatcccaccccatcacctcagcacccccatctcgatctgggcacggccttcccattccccggcctttctctaccctggcggggccgcccctctccttcccctctgcctccgggctgctggatgtgggtggagcagaggaggaagggcacagggtgtccgctgcaaggacctcgccccgccatcagctctgcctaggaccggggcctgggaactgagtctcgccttgctcccattccatggccgattccccctacccctgcccccacccctgagttctcagtggagaaagcgccagactgtggcgggggcgggagaggcctgggaagctgtgggctgtttgctttggactcgtcccggcattccttctcctccagctggcccctcagatatggcacttcctgtttgggctgggtcagaggtcagcagcccacgaggcgctggccccactctcccagctctcacgacccctcctccctgcctggccgccccggtccctgcgcctcttgctcaggtcaccctgcagcccccaccttctcgcagtcccagaggtcaggcccgggaggcacaggaagtgcaggctgggtgagtccccgacatctcctgcccacttcttaccactgcccgacagatgaggcaggtggggaggagaaggggaggggcccctcagctgcaggagggcaggggccaggcaggccacccacaggtggttaattccacttctcagagcctcggcgggggctaatcctcctgtgaccttcccaactggggaggcaggggactcgcacttgggaaatgtacctgcgggctcttggggtcgtcacctggccaagggagaagctgggctgcagccgaccccacaggcccggccaggcctcagccaacctgcactccgagatggggcaaagggactgggcctttatttccccctcatgactgggacaagggtgctgtttccagcccaggggattccccagagggccaggagctcagggctggggacttcacttcttggggctgtgggagggctggtcagagtctagctggcaccacgagggaatctctagacagagccccagcccgagagcaagggcagcccagccgtggccctgcacctgcccctccttcagcacgggccacgctccgacacccactcactcccaccttctctgtgattactgtgctcctcctcttcggggtggctgctggctccatctgagggtacagcagtgggtgcagccaatcggtgaccccaaaatgctgggcatctgaggggacattgcagtgacaattgcaatagtgatggcaacaggataggtgtgactagggtcagaagggaggcactcatcagtcctcagatggggatggggatgctgaggtgatggggtgggactgagagtaaggacagtggggacagctcacaattcagaagggtggagaatgggggcaaggagccgtgccctccctggggctgggcctgtgtctccggcctgagacctgggtgggaccttgcacctctgctccgcctctgccagctgcagtcccagaaaactgcccatcagcttccaaattcttctccaactgcccctcactggccccccacgggcccacccctcgccttcgccacattctgttctgagccctccctccagcctaacacccccgttcacaagcatctcgcctactgtgccaccctccaccccctacccccataatagctgccaccatggccacacggggacagtctgggagatgctaagctgtctggccctcaggccaggtgctatcccaccccatcttctgagcatctgggccaaagattgctccgagctgaagtcagggctcgggacagggcccagccccttcccactcccaccagagcctcctggtgctgctcctgggctctggcctctggcctccctgagggaagaccacaggggtcctagggtgcccctggcctctggctcccggacttcggcttccaaggcaacccatcttccatcctctggccacgccccagaccatgcctctctaaagatagctagacgcaggccaggcctccccggagcccccacgcaggccctgaaattacagccctggtggcccggaggggagagatgctgtgtgattatgtcctcagaggaaggtcaaaaaaagctcctggcatggagagtgccagctttcaccagccacacctcggccatccagcactgggaagcttccagagagtggaggctccgctcactcagcaccagctcagctgccccagggcatgttggcacaagcctcctccataaccgccccaccccctgaacccagaggtccccgctgagcatgagcttcatgccgcttcgaggccgcaggtcatccagagacccttgagtggtgatggggttgcccactggtgtctgcccccgagggtgccgacactgggaatggacgaagcccacaggctcggagtgaggcccactcaaggccataaacttggggccgctcttgctcaagaggtaacctcgatgtgtgagtgacaggtccctggatgggaatttgccctggaagctgaggctctgcaagagctactccccaatgacaggcggcctcagggcactgcctcctcctctagaagctctccctgccccccagtcttgtacgggcacatagcacttgtcacctccttgcttcttgagggtcttgctgatggtccagggggtgggagtgctgcctgtctgcctcgcccactgcagctctctgtcccagctctgtcggctctccctctgtctctccgtcccatccccaagacaggcatgggcccttctgttcacaccatcagaatggaagggtggggaggttcgtgtccaggcagaagggttcgagaagcagccacccacagagaagagggcccactggacacacttggggagcagggcagagggagcccggggcccagttcttgtttccagaccctggagaatcatggaacaagcagcccacctctgtaggggacccctgcataagaggccacctcccaggctcctaggctctgccctctaggactcacaccacccgccagtatttcatgcccaaatgggaccagagagctcacagcctgccctctgggcgcccccaccctgcttctctcctgggcctccctgctgtagctttgaagacagggcacaaacagctgcaagccagctgtgggggacaggctgcagctgactccaggtcctcttccccacactggccaaggagatggcagctggcttagatccctgcgccctgcctcccctcctcccagcccccttcttccgtggccctctccctccctcagacatgtccttgtcccatccttccgtcccatggctgccgccccacctgctaccttccagcagccgtcctgggcgctgtcccaggcaggctggggtggcagctgcctgatgaggcctagaccagagttaggctcagagcagggagaccacagtgtggcctggggccctgtgcaggggcaactgccagggcaggacagctttccctgcagggaagcctgagcaggctgcccagggctgccctccccacgcagctgagggggttgggctccttgtcaggtggagagagctgagctctcggctccatccggcaggagaaggggtctcccgggctgggatgcaaggcaaggctggtgccagcaggaccttctggccctctacagccttttgggggaagcatcccagctagggcctagggggcctgtgcagtggcatcccagggtcacatacaggccgtgctggaaggggccgggttctgcttcccccacctcctgctccctgtctgccgcgggttcctggggagctaagacagctgtgtgtccgcctcctccccaggatccctgagggcctcaggaaatgcctgctcttccttcctgccttgcgccccccgtgcctgccttccccctgcttccccctgcctcctcccagccctgagaggccagaagggcagaaggctgcccgcccgccagctctgctcgctagcaaggaagcactgttcctagagcacttcagctgggatcaaagtaccttctgcgctgcagagagagcccaggcctgaggaggggggagtgggagggggagcagaagggggaggccctaggactgaggtactgcctgtctggtctgggagtggcccccaaattagagggccaggccgagtgactcagtgggccctagccaggccgagtgactcggtgggccccgggccgggcgtgcagttatggcttattgcagactgcaaaccacagatacaaaaaccttccaggtacaaggaccgtatttatatgagtattgcccccagaagcagcccccaacttcaggtaagagctgcaaggtgcatgcataatgtgtctcccccaagcagggtgtcgcctcatcgccacttccaagcccccatccaggaacatgcctggctgagacctgagggtgaggtcggtgcagggccggactgcagcgccgcctggctcccctgtgtctccccacacccccccgcacgtgtgctcttccttccaccggcaacttccctcttccctactggtctgctccaggtcacctcctccaggtagccctcccgagcctctggcactgtgcatggccctgcgcccccacggtattcagagctgtttcacccccactgggactcctggaggctgaggccctgagtgacagctcctgggttctcagtccccaagcagtgcaggaaggtactgggtaccagcacctcgggcagcaggcatgccttgagtgggtttctccttttttctgaaacggctttactgagagtggctgtgcttaccacacgatttgcgcattgagcacgtacaaggcaagggcttttatatggtctattcacagaactgtgcaaccatcactcagtcgattgtagaacattttcatcacctcaaaaagaaaacccatacctttaggtaccacccctctagcacccactgcccacaaatccgctttctgtccccacagatgagcctagtgtggacatttcaaatgaatggaaccagaggctctgcggccttttgcgactggctgctgtcactgagcggaatgtttccaaatgcttctctctccacccagactgctagtcaggcttcgctgcctgtcccgctctctaccgacatatttctccacgaatgagttggcagtgggggagggaaagagggtgggacagagatgagaccaggctgccaagagtcggacgctgaggctgggcaaaaggtaaaacacacaaacctgccgaaagacaagccatctcctttgtctggaaagggcatatgtggtctccaatctcctcattccaaccatgaaatcaagagagaaccagggttaccagcctggcccctggtttcccacgtctctcttctccctggcccagtctagaagcttcttgcaggcaggtaccacagtttggtcaaggtgccatgcgtcccaggtcctagccaggccctgggctgccgctggtgaacaggaagggggtctgtgccctgccatgcccccaggtagagctcccctgggagcatcctccctggcctgggacctcccagaccccaccccccggttgagtgatggcactgccaggggttgaagaccctcagccctcgacgttgtcctctctccattggatgccgcctctctctagccacccctctctccctctctgccccttcgagctttttctctcaatatgcaattttctcttttggtcttccgcactcttggcccccagttctattgcagatctgtttctcactccatctaaactcttacccctgtgtctcaggagctgctcttgctgagggaagaaggggacactacgggacaggggggcagtgtcgtactaaggacctgggctctagccactggaggaactggactcatttgggccctcaggaagcggctgagtcttggtggggtaacccggttagcccccgtaagtgaccagcacagggctgagcccagaggaagtggccacccacagagtggttctcatgtccgaggggacctgcagggattgagcaagaagactgactcgctggatccttcgtctctgaatcagttcagggcaggcaagctggggagccccctgccccgtcctgccaccaccagccggatcgggccctctttttaagggaagaaagtctggagtggaagggagggcacagggcgccaggagcctacatgaagtccttccagaaatccacaacagctacctctctgatcctggagaaaccacctccttgcttaggcccaagcaggttcctggcaggctcaggaccaaattccaggggccactcatgggcctagcagcccaaggccgcctccccctcgtctttcttccatctctctttcctctgcctggcgagatgccagccagcacctcagtgtccccatctgggcagtggaaagtttgactctctgggtccttgtttgagtgagtgcgagtgtgtccgttcctttgctgtctgccccaggcgggggagggggggggaggtggtgggggcgagggggcgggggctcagctagtccagccgtctacaagaaaattgctccctttgaagctgccaggggggccgggaagcctgccccctcctgctcgcccgccctctccgccccaccagccccctccctcctttcctccctccccgccctctccccgctgtcccctccccgtcggcccgcctgcccagcctttagcctcccgcccgccgcctctgtctccctctctccacaaactgcccaggagtgagtagctgctttcggtccgccggacacaccggacagatagacgtgcggacggcccaccaccccagcccgccaactagtcagcctgcgcctggcgcctcccctctccaggtagggctggcttcaagctgcctcctcagcaacccagagatgcccctggctctgctgcctccgctgtcccaagccctggtcctgctgtccccagtgccgcgagggtgtccacagatttccccggtgctctctgtaggctgctgatccacgccccttcatcgccaccctgcggcccccttggtccctgtcaggcttctgcctcgtctcgccgccctccaggcacctttccctcaccccttcctctccctctcccttctgaccttgctctgcttcatccacctcttgtctctctgcctcccgctcggggtccgtcttcttggctaccaccctagagcgtggctgggtgactggtaccccagctttgccaatggccctgtttcatcattgcaagtcccaggcgcatgctccactccctcagcctcgctctgcccaggcgcctccttgctccagggcttggcgcctggcccgggttgggtcggatcggggaggaccgcccagcgcccaccgagctcagcacccaggagcagtcctccgctgcactgcctgaggccagtccttggcatgggctgaaagacttagtttcccaggcacaccccaggcaccctgcccagatgttcctcgctcgctcacccccaggttaatgctctgcctctacatcctctgtgagaagtctgggtcctgggagccctggctgcaagggccctgactgggggtgcctgggtggctcagccctgtctgtttccaggacccccttggactgggactcagaatgggtgtggaggggaaggagagaaaatcaggcaactgtgccatgctccccagggcggacctggcttggggtcccagaggggcctgccaagggacccaggagagggagcgagagagtgccctggaaggcccacggaggggagcgccccctcactgctccatgggcggggctgggtgcctgagcgcctgctgagcagagcagggggcccagggatctgcagggcacagggtacatcagtctccagtggtctgtcttggtgggcaggcctctctcctgctgtcctggctgccagactgctcaggtcccatcctcagggggtcctgtttctgggccctcgcccctccctggcctgccagctctctgccctatagcaactaattggaactgagacaagctggagatgctcagcccccctgcccccgtgccagaaaggctcccggggaccagcgcccaggggtgcgggtgagcacctcctggtgacacccagccgccggtgccagccgcaccccaggagagctggtgtatgagcatggatgtcttggtgcggagcatgcccatgtatggccactgtgggccagcatggtgagcctttgagggcaagcccgtgtgggtatattgaaaggaagatgcagggctgcctccaagccaccagggctgggcggtgggagcaggttgcgagccagggagcagagagggctcccatggcaagctggccagctgtgggtggcagccctggcctccctggcccaccttcaagccccaaggacccgtacggcagtgggcattaaccctaccaacgcatagatggggagtctgggaaaggaaggggggtgtttccaaggcaagaatgagtttcctgtctttagcaacattccagagtcactcaaacaaagctatagcgtgtcccttccagtgacagcgccaagtccccagaggaggggtttgtaatgagttcacacttgacagttagcactcagagccttcagcaagggcttctgagtccttgccaccccgtatagaggtgggatgaggacctccccacctgccgtctcctgtgcttcccgggcccaccccccaccccccaccccccagcatctccagcctgcccgggagtcacatgtcctcggcccacagaatccccagcacacgccccacccacaggcctagccccagccctggggtccctggcaccccacctgccagggcccctcccctgccttgctcaccccccaacacccctgcttgtcggaaatgtcttcccatgcccaccacgaccccctcccactcatctgtgggccggagagcttggtccctgccgcacgttgcccccctagcatccaggcccaccaccgagcccccgacaggcctgggagccccactggtgggtggggacccaccagctgggggtcttgctcacaccgaggggctgggggtggcggtggctttcccagggcaccctgccttgggctgcaggccgctgggtgggcaccggctccctcggaaggcagcgcaacccgggatcctgccggccctggcccccaccctgccgaccgggcctggggcgatcagtgccccagctcctgtcctcttctgctcagatgctgggttgggagatcaggggccacagctcggccactcagagccctttccgcaagtcttagagggaccagctgtggggtgtgtgcagaggggctgcgctgtggggagggcgcatggctcagtcctcctggcctgaggcccgcctagcctaagtggcctccaggacccatggccaggcccttctgcagccttccagaaagaaccagcttcccagggttccctggggaaggcctggggccacctcctctggaggggtggggcctgtgcttcattcctccttccccaggtccccttccaggccagaagatcccctccaccacttgaatcccacagccagaagccccttctgggactctagactcctgggaaccatcccagctgcccccttcgctgtttcgctgtttgccttcttcccctgccccgtcatggctctaggtcagagcagcctctggggtggctatggaggggccaccagccttggctcttccgaggactgcagaaccctcccactcccagcttcccacctgcgcagctctgatcccagccagcccaaggggcagggtcaggtcccggctccctggcaggcctggtgaaggtgctgcccattcccatgaggctcatctctgaggcttaggggcctggggctctagccagccttcttgcatggaactctcctggtccactgcatcttaagcctgagctccacttaaacactggcctgagataagctggaggaccaggggcccaacggactctgtgggcctcttgaacttgcctctgctggccatcccagtcctgtttggtccctgaggtgttcagatgggccaaggggagcatggcgggcagactcctgggtggccagaagattagaaggcagccctgtccctggaggcaggggaagtctgggaagccagtgtgacttctatcctctggaagtctgagtccctgcttggccttgactgccatcccatggttcttggaggctgccctcatgcaaagagacacacacccatgggagcccagcagtcccaggagcctgaagctaagcaggctgtgggccaccctggctggctgaaggaggctaatcccagcccagcctgagcccccggcagagagcgggttgcggcagggaggggctgcaggaaaccttcccctcccctcctggccttggtgggcctgtaccagggagggagggaggcagggccccaggctctggggggcaggccgggaacaccttccctggggccctgaagtgctcgcctggggagacgatggcttttccaggagactccctgcagacagaggcagaggtgagaggctgggcgggggctgccctgctggctgtgttggggctgaggaggggcttctggatctgtgggccatagggagctactgatggtcctcagaagggccatgcttccaggggagccccctgcacagccccgagagtgtgaagcgtgtcagctttggggcctgtggcactgtgtgcattgggagagggtgggtccagacatgggggcaaggacacagacggacagacagacagtgtgtgcagccccagctctgctgtttcctcaccgtgtggccttgggcaagagtttggggccaacttcctgagcctcagtttaccccttcatcaagttctaagagcattgcttccttcttatagtcaacgggggacggcaggatgctaagtaaagaaatcacatgagtcccctgctctgcctctgagaggtgacagcatcctcccttttccttggagactctagcaggaggccccggatctcttcggagagtgggagggggcagcagtagtccgtgtgcagaggaccaggagcgcacagtgggaagggctgagtcccgcactccgccgactgtggggacaggctggaccttgacatgggcgccacaggctgcaaagggctggcacagagaggtgggaggtggctgggcgcatcaagggagaactccacccttgtcgccaccctgccagaaaacctctggaaaggatttgagcagcagatgagccggggtttcccagcccctccacacgtggctgcaaggggagcagacgcccaagcgtggctgcctgaagggcatgctccggcaacggcaggggcttggaatgtggcacaaggtccacccctccccactccagcccccagcccctcaggcagccactcccacagatgaacgcacacgccgggctttggcaaggccagggagggtacacatcccctctctggttgatgcccaagtacaggctggagccatcggcggggagggactggtggactggggcctgggagagtggcagggggcaggccgggtgtcagcgggggcacaagcaccaggctgctggttgaaactgggcccaaaaggctttggaggccagaggggaggggaggaaggacacagtcccggggaccccgcagggctgcgtggaaggtggcacatgtgtcagagttcaggtcgggttgctcaggggggcagacgcccagggctgaggctgcggagacagcatccggcgtctgccacttggcagctgtgagccacaccatctgcaggcgagctcccagggcccgccagacctcaagccctgctcccgccgcccttggcctggcctgaatgcctggcacggaccctccatgttctcagaggctgccaacgcatcttgtttggctgtgacctcgagcaatccagtgcagaggactgcgctagctttcagaggggcagacaaggagggccctattggggtggtggcggaggctccaggaagcccagcctcctccctcactcacacctgcggtcgccaaacctggggcttatgccattgccgcccctgtcctttgctctaaagagatggtatccagggagctcagggcacactttggtggggcttgaaaccctccctgaagtccctgaagacacacccagagaggccaatgaagggaaactgaggcccagaggcctcagttgtggtggtggagagttgaggactggagggacttgctgtgggtctcacaggatctgactatggggtattcctgcttcctgggctggggtccccgcctgccttatctatgtgtggatatatgtgtatgtatgtgtatatgtatacatatgtatatgtgaatgtgtgtatgcatgtgtgtatagatgtgtgcatgtatgtgtgtacatatgtgtatgcgtgtatacaggtgtatatgtgcaggtatgtatgtatgtatgtgtgcatgtatgcatgtgtgtgtgtgtgtacgtgtgtataaatgtgtatgtgtgcgtgtgtgtgcatgtgtgtgcatgtgtgtatgtgtgcatgtgtgcatgtgtgtatacatgcatgcatgtgcgcatgtggatgtacatgtgcatgtatgtgtatagatgtgtgcatgagtgtgtgtgcatctgtgtatatatgtgtgtatatgtgtatcatatgtgtatgtgaatgtgtatacatgggtatgcatgtgtgagtgtctaggtgtgtgcatgtatatgtgtgtacatgtgtgtataggtgtgtgcacgtatatgtgtggatgtgtgcatgtatgtggatgcatgtggatgtgtgtacatatgtgttttgtataggtgtgtgcatgtgtgtgtgcacgtgtgtacatatgtgttttgtataggtgtgtgcgtgtgcacgtgtgtgtatgtgagcgtgtatgtgtgcatctgtgtgtgtgtttgtgtgtgtatgtgtgtacgtgtgtgtgtgtgcatgttctggcaggagggaggggcttggtgtgaggtggtggggagaaggcaggggccaggctttgggaggacagctgagcctatactgccaggacctcccaaactgccacccccagtcttgggcattcaggctctcacaggcccagagacatggctggagccctgtggctgaggagcacagctgagagctcaggcggggcctggaggcgccaaagctgagttccaagtcaggctgagtgacttgggagaaatcagagcctctctctcggccttagcttttgtgtccataaaatggggatactcatcaggccagctccaggggatcctatccttccccccaggctcccctggctccctctgacttcatgggccccttgctgcctcctgtgggctcagacacggagcctgccccttcctcgggagaggtctcagttttgtgccagttctttgaggggaaatgagggatgtgccgggaagcctgcccggcccccgcccctccagcctgcccactgcttgggcacagccatgagccatggaaaaccagccaaaccttgtccttctgcctctgtcacggggcccgggtgtatgggccttccagccctcagcctccctccccgctctgagggaacctcttccccttgcccctttctcagtctcttggagaccccccagacatcctactgtatcaggcagcctgcctccagagccctcgttgccccacagctggtcccgggaacccgcctgagaccccgatggccagtcttgccgtgactggcctgccctgtgcctgtgccccctgccctggtggagggcccgattccctaacaggagggcctgcagggaagtcccagctcctggggagaccccttgccccggggcaggagtccctgtagagtcctcctccaggccaatgcgtgggtcctggggggctccaagctggccatggtcagatggtcctctgtcccctcggccttccccagcccctccccacagcctcccgtaggcccagccggaccaccccaaccctacctgtccaggtggactgcccaccctggagcttgccagggctctggcggggtgtcccagccctgactcactctccctgggaggtagcggctttggcaggggcatcggcaaggaggggcagggcagtctcctccctcccccactccatcttgctctcctgcttccaccctgcccttcctgttctctcccactgctcctcctcctcctcctccttctgcccccgggtgtccactggcactgggagagggtcctacagcggcagcaggcatcggaggccctgccctgccctggaggaagggaaacaccatccaggtaggtgagtgttgagccttctccctacttgggggccaagaccctccgggcggttcccctaggttctgctgggccggcctgaggctggcaggccctgggctgcaactgtgggatctcaaggctcaaaagaatgagggaggctcggtgctgccccagcaggggcctcctggtgaccccaggggtcagcatgaagtccagctccacatgagggggaagctgagctaagccttgggctccgactcccactttgcagtgtggcccagggcctgtgggctcaggagggctccggggctggctgcggaaaggccactccacaggcctggcagccgctatagccacagcctcaccacaggcccctctgtccacaggtgtgggagggcgcatgggtggcttctaggggggatgccaatgcaggggggacgcgtgccagcagatgctccctggagcacccgaggagctgcatgggggcgacaggacaggcctccatcccaaccctctcctgggcttgtgctcagacccaacctggccctgaagtggcctcaggcccccggcccgctggtagcaaggactccaaagcggcagccccgggcagccagcccagcccccagggcaactggggaagcatcgggcagggcggggctgctcatagggtgctggcctgggggcagagcccccacctccccacggcctccttagacccctgcaaccagcagctgggcttagggggctcacctcgctctgctggagccccagacagcccctccccagctagtactggccctaagtgagggtctcctgggcgtgcgactgcttcaggtctgccagaggcccctgctgcccagctgggctccccatctccagatgcaccgagggccaccccaggctgggtggcaagcagggcaggcatgtttattcccacttaacagatggggaaggtgaggctgggatgagacctgggcctttgctggagagtcagggtggatgaagtggtgagagaggcagggctccagcctcttcctgtagggcacattcccggctgcctctggacgggagaccgtgtctgatgaggagggaggaggcaagcagaggtgggtgctgggggcaggctcgggcagggctgcttcgcctccactcccactcgccgcctcggcctggggggcctcaggcaagcctgaccctgccctgccaccctggcggcagcctgctcccctggggggcctctctgggctgccgaggctgtgggcagggaggaagggtgcgagcagatctgggagctccagggctgtttgggccaaggcggtgtgggcggggggctggggcgggtggtccagaggaggaagccaaggcccaggggcagtgttgggggcgccacggcctccacctcgggggcctccactcagtgctgcctcagccaactttacccacggcctccaaggataccccctctttctccgccctgcctccctaccttggccttagagggtctctgagaaacgtgggcagggtggagggaggaagcaactcagagtcgccgcactcaactaacttcatccacgctgccctgagcccagaactcaaaggaaggatcggcccgggtaggaggccacagtgatgtccccaaaagtgaattcttcaaagcccttgagggccaatggctaggattcctcctccacctcctccacgcagcctcatggacgcccccgccctaaagcaggcttctggcagactcagaggcgtgggggcctgcagacttgctgatgaggagacatttcatcgcctgattaagccaagtcctgtccgggatggggaggggggtagtggaagcagtgaagggagtggagtggagggggcaccctccttgccagcagcatccactcccttcctgcctggagccctctgcccacactccgccctctccgcctcccgctccagggtctggccgtccctggtgagggatgggaacgcagtgccaccacacacgcggaacaccagcccctggcatggagaagacaggtgggtgctggtgctgatgatcccctcgcctcttcccccaggtccatccgccatgtggcccctgtggcgcctcgtgtctctgctggccctgagccaggccctgccctttgagcagagaggcttctgggacttcaccctggacgatgggccattcatgatgaacgatgaggaagcttcgggcgctgacacctcgggcgtcctggacccggactctgtcacacccacctacagcgccatgtgtcctttcggctgccactgccacctgcgggtggttcagtgctccgacctgggtttgtccctgagtgatggggagcggggcatgcagggaggctcaggtgcagcctgagagccccttctgaaggggacacatgctggtcctgtgggacggtggcgagcatgatgtaagtgtaggaggggtccagccgtctggctgtgagctgtgcagtttgtgcccacttgtggtggcatccccgtgtgcccgtcagtgtccctgtgtgtgtgtccccggtcctccctaccagtggggctagtcggctggatggctccaagttcatgctggtgatggtggtggggcccctaggtctcgagttcatgctggtggtgggggtggggcccctaggtctcaagttcatgctggtgatgggggtggggcccctaggtctgaagtctgtgcccaaagagatctcccctgacaccacgctgctggacctgcagaacaacgacatctccgagctccgcaaggatgacttcaagggtctccagcacctctacgtaaggagctgggaggaaccagcaggcctacagcagagggcaggggtccgggtgggtgcatgtgcgtggacgtgtggggtatgagaggggttcggggactcgtggggcttcagggtgaagcctggagccagccgtgatgggagctcccgggtttgcggctcactcatgtgggtttgagcaaccacagctgcaggaccggatcgctcagttcggctcccttcgtggctgaaaacgtttcatcacgtccactcctcccagcaacagaggagaacggatttcattgtagccagtgtgcgtgtgaggaaactgaggcttggagcggcaaggcagtggtggcactgctggggctcaggaccgggcctgggtgctgcctcctgccctgcactctgctcacaagcatggactgaacctcctcgaggcccagtgggctggggaggcacaggaaggcaggagagaggggcgggtggggtggggagtctgtgccttcacctcctccgcccaccctgcttcaggccctcgtcctggtgaacaacaagatctccaagatccatgagaaggccttcagcccactgcggaagctgcagaagctctacatctccaagaaccacctggtggagatcccgcccaacctacccagctccctggtggagctccgcatccacgacaaccgcatccgcaaggtgcccaagggagtgttcagcgggctccggaacatgaactgcatcggtgagctgagggcctcccagaacattccagagccttgtctcgaggcatggggaagggagaccaagggatacctttagaggctcagttcaagaaagagtatggtgagaacggtcaaaagaaaatccatggatttcttggcaaatcctccatgcaggcgatcaccacggctaaagagaagactgggccagaggggccgggtggcttccgggagccccatcttcatctctggcactcctccctttcctcttgctgcccctggagctagcagtcctggggctagcagtcctgaacagctaggagtttgcaattagcccggtaaattagcagaactgctttcaggagacgggagcagccggcaggtagcagggcccaccacactggcccggaagtgacaggacccagggctgtgcagggaccaccaggctcccgggctaatgaggtctctcccctagagatgggcgggaacccactggagaacagtggctttgaacctggagccttcgatggcctgaagctcaactacctgcgcatctcagaggccaagctgactggcatccccaaaggtaggaagcccactcttcctgcacgcctgcctgcctcacccccaacagcacagatggccagggtgggggctctggatgggcccgatctactcagggaaaggctcaacagtcccctcccgccacctggggcagagctagggcccctgccctcagcacctgcattctcccctgtgccctcttctcctggcagacctccctgagaccctgaatgaactccacctagaccacaacaaaatccaggccatcgaactggaggacctgcttcgctactccaagctgtacaggtgaggccagcagggcaccgcccaagggtgatgccagagtccctcagtgctgtgtggcccctcgcgcccagccccccatccttacctccagcctttgagtccgtgtcattctcccgctcacaggctgggcctaggccacaaccagatcaggatgatcgagaacgggagcctgagcttcctgcccaccctccgggagctccacttggacaacaacaagttggccagggtgccctcagggctcccagacctcaagctcctccaggtgagagctgggcatgcacagccaggttccctaaggctgggctgggggaggcgtgtgtgtccccgggcagtccctcagtcccctggccctccttcccgaccggctctgggcatctgcaagggagcggtcctgatgctcccagctggtgctgaggaggcagggagcaggggctccatggtggataccgagcaaggcagcctggtagctcttggacccgagggtctccaggtgggtcggacaccagaaagatgtggcagagtccagggagtcgagaaactgtgggcgtgggagtgcacagatctgtgccaagacagtgaccgcccagggcaggaagtaggctgacgagggggagcagggtcttgcctgggattctatcgggagcttccatccctggcctggcccgcaaccaggtgggtgatcttggtcttgcccagccctgctccatccacaagtgtttggagcacccccatccgcaccagctgcgagccagcaccgcgcaggccatgcccatgctgggccgagtgcgccctctagtggccattgtcatgttcaccagcactgggctcccagcccaacccagcaggcgcctcgcctgcccacctccgctcctcccagagacagcaagacggtggctccagagagttggaggggctgctagagggcgagctcctctgctgactggaagaaagaggagggcatcccaagggctctttctcctctcatgccccatggagtgtgagggtgctcccccgaggctcaggccacctttcctccacctcacaccaccaaacacacctctaccccagccccgcccccacatgtcctcaacctgacccacctgagaccctcatccttgtccctggtcacatccagtgccttaatcctggctgacacccacacaaataacacgcccatgccttggtttgctcctcccaacaacggggagcctctggtgtggcccttgaagtagggtgcagaggcaacagcaaaatgcctcctggaggcagcgggcttggcgtggagggagggaggcctgccgtgacccggcctctctgccttcaggtggtctatctgcactccaacaacatcaccaaagtgggtgtcaacgacttctgtcccatgggcttcggggtgaagcgggcctactacaacggcatcagcctcttcaacaaccccgtgccctactgggaggtgcagccggccactttccgctgcgtcactgaccgcctggccatccagtttggcaactacaaaaagtagaggcagctgcagccaccgcggggcctcagtgggggtctctggggaacacagccagacatcctgatggggaggcagagccaggaagctaagccagggcccagctgcgtccaacccagccccccacctcgggtccctgaccccagctcgatgccccatcaccgcctctccctggctcccaagggtgcaggtgggcgcaaggcccggcccccatcacatgttcccttggcctcagagctgcccctgctctcccaccacagccacccagaggcaccccatgaagcttttttctcgttcactcccaaacccaagtgtccaaggctccagtcctaggagaacagtccctgggtcagcagccaggaggcggtccataagaatggggacagtgggctctgccagggctgccgcacctgtccagacacacatgttctgttcctcctcctcatgcatttccagcctttcaaccctccccgactctgcggctcccctcagcccccttgcaagttcatggcctgtccctcccagacccctgctccactggcccttcgaccagtcctcccttctgttctctctttccccgtccttcctctctctctctctctctctctctctctctttctgtgtgtgtgtgtgtgtgtgtgtgtgtgtgtgtgtgtgtgtgtgtcttgtgcttcctcagacctttctcgcttctgagcttggtggcctgttccctccatctctccgaacctggcttcgcctgtccctttcactccacaccctctggccttctgccttgagctgggactgctttctgtctgtccggcctgcacccagcccctgcccacaaaaccccagggacagcagtctccccagcctgccctgctcaggccttgcccccaaacctgtactgtcccggaggaggttgggaggtggaggcccagcatcccgcgcagatgacaccatcaaccgccagagtcccagacaccggttttcctagaagcccctcacccccactggcccactggtggctaggtctccccttatccttctggtccagcgcaaggaggggctgcttctgaggtcggtggctgtctttccattaaagaaacaccgtgcaacgtggctccgtgcgctgctcctgtggcggcctggcctctccgtgcccctcctggcccttgggctccttgccctcagaagaggggccccgtcaccctcagaagaggggccccgtcaccctcaggtctgggctagcccggactagggaggtttcccctcccttctagacacttccatggccccagctgtcctgagacgcggctccagaatccaaccaggcctgaatggcacctgccctctcagcgtggagcgtttgccaagagcacgccgactgcagggcgccaggctagagcctggaaatctaagcggggcccggcctgcccagctccatggagtctagggttcacaacgaggcaccgccaaaacccagggggtgacacaggagggaaggggcccaatggagccagggcagggtgctgtgtgcacccacttgcactggcctggccttggctcccctgccagccccctggcaggtgacactgtgtgtaggcagagccgagcctgggctgcaaggcattcccacacacgcagcatccagagagaggatccaggtcagggccgggaaagcctgcatgctggggacacaggtcgtcctggaaaggacagcttggagggggacagtccccagagcaacgctaccgcctgtgactttccttcggccctgcacgaagagcctcagagcaggtggcgggacctggggcttccctgggcagcccaggctcccaacggaaatagagtgggcagggcccgcgtgaatggcagcctggcactgcgtgttggctcctcacacataactgcgtctttatggctggactggcactggcgcactggcatccccaggtttctcctttctgggataggaggtgccacacagtgtggtggcccagtgatagaaagtcaccatcagcatcacagcactattctgggccatgtgctctacggcccggcaatgtctgctgagctgggcaggcatggtgcaagggaactgggcaggggccgggagtcaaggcttcgggcaagtcccctcgctggctgggaggaggggcagccagcgccacggcctggcagagatggaaagatggggcttccgcccattcatctgtgagcgggtcttggggcattggctctgtgttcagtgggtccaacacagcccccgtgaatctgtccactcttcctgcctcgctcccatccttcctgtgcctcctttcctctctgtctgcctctcatttcatgcaccttcatcacacctgtcctctgcgtgtcccagctcagggatgcagtgtgggtggaggacaagctagtgggatgagtgtgatatgggtggtcagtgcagaggaaggcatcctgcaggctgcgtgcttagcccacacagcagggggtgccctgcaggcagcacacactctgcctggactagagtgccaagcccccgaggcaggagcccagagctggacagggtcacagcctgcaagggcttctgggtcgtggtggaaggtgagctccatcctcaaagcagttggtcctgaccacagtgtgaagatgaatcacatagcctcactctaccgccaagtgtgggaaaaactattagctaatactagccaaggtgagactgatttgggcttaaaaaagaaaatggctaggcgtggtggctcacggctgtcatctcagcactttgggaggccaaggcaggaagattgcttgaggccaggagtccaagaccagcctaggcaacatagtgagaccccatctctaaaaaagaaaaaactaaaaaattagctaggcattgtggcacacgccagtggtcccagctgctcaggaggctgaggttggaagatcatttgtgccggggaggttctcccggcaagctgccaatcccccacatttacttgcaagtggcttcgaaagtaggactgtgctcagggccccagctgtggcataggaaggcctagggtggacaacggctgggctgcaagttccagccgatctttgcttgagtagggtcccctgaacttggtgacagattgggtgtagtgtgagaacggggttggttgtgatgctccgtggcctggagaggggaaggggaccctgaggaccaccacctgacggccaggagcattccggagctgctggaaggcagcaggcgtgggcttacacacgtacacacacacatgcacgaacacacgtgcacacgcacacaaatgcgtacacaaacacacacgcacacatgcacacttgaacacacaaacacaagcacacagaaacaaacatatgccgcacaaacacatgtgcacacaaacacacacagcaatgcaggtcacaaagccgcttcctcggggagtggctgtggagggcacagggccgccgtggggccgtttctcagcatttgctgcaggtcaggtgccttctgggcacagcagggcccagcgggagcctaagccgaatccactgctacggtttagacgagtccgggcttgtcaaaggggcagcgagccagaccttggcaggctgggcccacgatgcgggcaggacccctgagggacacgacccctccttggagggctgcaggggcaggtggcaggcctgggagccaagtcagaggggctgccctgaggacttggcagtggcctggtctccaggctctgctcccacaggctccagctctagtctcaggaggcagggaccacaggaagaggccaagaccctgcctgccactctgaacaggcagggcagggcaccatcgccagcagagagaccttgtctccctcagcttctgggagggcacagcctctctggcgccctggagaaccctgggcagcctgggtgctgaaaggccctgatgcctgctgcacaggggcagccagggcccaggcaggagtgcccaggggactgtgctggagctgcactggcaggagtcatgcccaaagagccatctctgtctctctctctcacacacacacacagacatactctcacactcacatactcacacacaaacacacactcgcactcacactcacacacactcccactcacacatgctcacactcacacacactcaaactcatactctcactcacacacactcacacactcacacaatcacactcacactcactcacacactcacactcacatattcacactcacacactctcacactcacttgctctcatgcacactcacaccccacacacacccactctctcacacacactcactcccactcacacacactctcacacacccacacacgtgctcacatacactcatgcccacatccactcactcacacccactcacacactcacactcacacccccacacactcacacacacacactctgcatcgccagccagctttccagaaccaccaggcgtggatgtactcaagccaagcagcccaagaagcctcagttgtgctgtggacagggctctgccgagctggagctcctcggtggcccagctggggcttggatgagtggcccgaggccactgtcatggataaccacaaaccgggtggctcaccacagaggacatggaccctctcccagtcctggaggccagaagtccaaatccaggtgtctcagggccacactccccccagaagctctagggaaggcttcttcctgcctctcccagccccggaaggctccaggcgtcctggacttgtggccacctcactccactttgcctctgcaatcacatggcttcttgtgggggggggggtacatgtgtgtgtatatgtgcaatgtgtgtgtatgtgtgtgtttctgtgagtgtatgtgtgggtatgcgtgtgcatatgtgtgtgggtgtgtatgagcatgttcgtgtgtatgtatgtgtgggtgactgtgtatgtgtggggtgtctgcatgtgtatgtgtgcaatgtgtgtgtatatgtttctgtgtgtgtatgagtgtgtcttgtgtgtgcatgtgtatgactgtgtgcatatgtgaatgtgtgtctgtgacgatgtgtgtgtatgtgggggtgtgcgtatgtgtgcatgtgtgtgtttctgtgtgtgtctctgtgcatggatgtgagtgtgggcatgtgtgtgtgtttctgtgtgtgtgtctgtgcatggatgtgagtgtgagcgtgtgtgtgtttctgtgtgtgtgtgtctccgtgcatggatgtgagtgtgagcatgtgtgtgtgtgcatggatgtgtgagcgtgtgtgtgtttctgtgtgtgtgtgtctctgtgcatggatgtgagtgtgagcatgtgtgtgtctctgtgcatggatgtgagtgtgagcgtgtgtgtgtgtttctgtgtgtgtgtgtctgtgcatggatgagagtgtgagcgtgtgtgtgtgtttctgtgtgtgtgtgtctccgtgcatggatgtgagtgtgagcatgtgtgtgtgtggcggggggggataacccaggataacccacatctcaagattcttcacttgatggcatctgcaaagaccctatttccaaataaggctgcattccggttccgggggttgggacatggacacatcggtggggacatttttagcctgcccctgggctgcaagtggacacgggctttgcccctgaggccttggggaaggggctgggacctcagccagggagacagtgggcatgagaagacgggatgggggccccaggcccagccaaaggggtcctcacttcagagctggccaaggagctgctgtcccaacagtggcaggagggaacctgggcaaggagggggcatggcccagaggcctgggagaggacggacctggtgactgggtaggggccaaggagccaggagagaaagcagttgtgggaggggagcgggactgaaggggctggaggcaggtggagagagagaggggtgagagtggggatgaggcggccaggtggggcggtgggcagccgctgagagcagggtgctctctgtggcttttgtttcccaggcagtcgtcggcaatgtgggagagtggggtggggacggaggcctggcgtgccctaaggaggcaggtccagggcatggtgggacaggctggcttgggacctgggagggagctgggaagcagagtggtctgggcctccctgggtttggctccctaagtactcccagtgcagaggacaggacttggtgtatgggagaactttctagcaaagctcccacctctttactgatggaggacccaagaggggctggccggtgagcaaggatcaccagtgacactggcagcatttgcctggcactcaggtgtcctcattcccaggcctgggccctccctctcagcctcagggctctgggctgggaaccaacagacacaaaccaaggagaaaggaccatccccttacctggccattagctgtttaggggccacaatttgctgaggactagggacttccatgacactttgttccttggccatctgaccttggcctcagtgggactcatcacaaaggtaggcaccatggccaactcttggctggattagccatgagcagtgccctgggggcccgggggaggaggcaaagtggtggggcaggtagcccctgcctcagattttctcccctgaacttgcttcttccccctggccagacagggcctgtgcagagtctggggtcagagaatagggaggggagatgcataaacacgcaacccaggcagcagctgctccaagctcagggagattcccccatgtggatagcagccatcagttaaatgaacagcctccatccctcagcatgttccctggtccccgagggaagacagtgacgcagcccaaagggactcttctctttgcttgtcagctctcacagccactcctaagcctttaagtgtgggtctccccagccccacacctgccctcccagagctgcccacacatgtctgctaagaggtgcttgtcttcagccgggacccaacccttgcccaagggatgctcctgctgggggccacgaaaggaggccagctcagcagcctgcttctgcctttgctcactccagagcagggcccttgggcctgggatggaaggacatgaccccagggagcctgccacagtgtgggaggccaagaaggaacgtggcctgaatgcgctggggaaaggagctcctctgccctcctgtggtgcctgagggcatgggggcagctggcctcccggccaggggccaaagtccagcttacaacctgctccgggtgggatccagtgccctctgggcctccacttccccatctggaatgtgggctagtaagaggaacgactccaagatggcagggctctggcgaaatggccagaacttagctcatgataagtttccagcatcattggggcttgcttcagtcttgatttttcccattcggggccatgggaagtcacaggctgtgtgtgtgtgagaagggggtgtccccatggcggctctgggcccggaggagcacacgccccaggctcaggaaaagctgcctcagagttggagtggaaggggactgcgggagtgtgcaaatgaatatgtgtgagagtgtgagtggggagtgtgtgtgtgagtgtgactgtgagtaactgtgtgtgagtgtgtgtgtatgtatgtgcccatgtgtgtgctcactgggtaagtgtgtgagttgtgtaggtgtgagagcatgtaaatatgtgtgaaccattgtgtaactgtgtgggccaccgagcttgtgtgggtgagggtgagtgagcacatatgactgtgaggatgtgtctgcgtgagattgtgagtgtgtgcatgagtgtgtgagtgtgtgtttgtgtaagtaggtgagtgagcatgagttcatgcatatgagcaggtgtgagtatgtgtgcgtgcatgtgagtgggtgtgagtaagcatgtgtgagcgcacacatgaccaggtgtatgagtgtgtgtgtgcgtgcgtgcgcgaacctcagctttccacggcaccagctgcttcctgtggaagggaggggcagtctgtgggggttgtgacggttccctggtctcaggggcagcagaagctttctgtccttttggtccctagcacagtggtgcctcctcaaagaggccttccctgagccgccagcagcctctttcatggctccccatcaatggggttccatagctccgaccccagcggcgtgagcacatttgccatccgacggccactccctgctttgtggtccctgctgtgtccccagtattcagctctggtctggcacacagcatgtccagggccctctttgtccaaggcaagaaagaatttgaggctgcgtccaggcctcttgcacctgcctcaggctcccgcccagagcctctacctgtgccccagcgagcattctctgctcgctgctcagaatgctcgcaaaggccggccctggggtcagaggcctccacagcccctggagctgggaagcctgggggtccaccggcaggcacgggggtctctttccaggtaggtgggaacgcgtgcttgtgggtgtggacaggtgtctgcactggggtttgtctgtgtgtctgtctccactcacaccggggatgtatgtgcccctgcgtgtctgtctctggtgcccacctgtgtgcagtctctgtgttctgcctaacggtggtgttcccgtgataaccgacggtgaggatctccggtaagcgccgcttcctctgggaagacgcatttggacgcccgtactctcaacaggtaatggagtttgcaggagaccaccaatgccttggagtccactgaggcaagacccaaggaccccacgctacacatcagccacccggctctgtgccccattttactgttggggagacgcacctagagggcagggtctggagaggtagtggcagcctcagtcgcaagctcagggtgctctctctgcactcacaggtgccatggtcccccagtttccatccccacccacccccactcggccagtgccctttgggggcaatgccaggccaggaagggcgggcaccctcgcgcgtcctggggacagaagggcgcgcaccgggcgcgtagctcctgagccccgaggcccctgcgccgcgcaccgccccccgcgcccgctccctcctccctccctcctcctcacccagctccctcccctcccccctccctccctccgcgctcagagctgcggttggagccgagcgcgccgcgtcgcccgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtaagtggtgctctgggcgcgcgggcgccgccggggtgggcgcgggcgcggcgcgggcacaaggcgcgggtggggatgggaggatgacccggcaggtggtgcggcggcaggtagggggacacgggtccccgcccgaggcacctgagccccgcgccgggcctgcgtgtccttgcggcactgcggccgcgcgtcaccccggggccccaggccggcgggcagcgccccgcaccctgcaccctgcgccccgcatcgcgcgcgcacgcgcatccgtgtctgaggaacaaggcccttgggggctgcgggccggggctcagggtgggcgcagccgggggcgcgggatctgggccgggagcccgccagtgcgcacgcaccttcccggagcctcgggcaccccctcccccccgcgccctcacactgtatcatccttcccctctcgccttcccgcaccgttccccgcacgcccacgcggctgcccagcagaccccaccgcggtcatgggcagtgcccacgagaagccgcccggggccgcacttaggtaacttctccatccctccaggaacggctgtctccccctcctcgcctgtgtgaccttggccagccagcttttcctgtggccgcctgcgttttctcacgggtgaaagctctggctttaagattctggaatttggaatggcaggtgcggcatctcccagagcctgagacgatgggcttctctctctgtgacctggtgtccttccttctgctggcccttctgggggttggtggctcagccagccggctgaggaggggtgggaggcagggcaggggcatggcgccggggcaggtcaggactggagggagtcttggagagcccgcggtgagggctccatgagggtttaggagagactgtggaaatgctccttcgctcactcaaggggcagggaagggaccagaattcctcaacgagatgcttgccatttcctggcgaggtcatataactttcaaagatgaagcccagggcctccgacctcaaaggagtccctgcctgctaaaggatcaagtccagcctgtccccaactggcccccatcctgaattccactggcaccctaaacgtcagccgacttcccctggctgacttgggcaccagtctggcaggcaccccctgcacctcctcccctcctttgcccactaggatctgtgccctcaccccctgccattgcccctcactagtcagtgaccatcttaaggcaaggactggctcttcatttgcacaggcctggcacagagtgggcacctggtttctgcatggcatattcatgaccttgacctcactgaatctgcagactcactgaacaggagaggcaaggcctggatttttgtccccatttttcagatgggatcattgaggcccccaagaggagaagggattcagccctgaattgaggccccttccttcatgagcagatggctagggacattcctatgaacctggtggggcagggaggcggggagaggttatcgtaataatcaaagaccagccccacttcctgagctccatctgagtctcacctcaaccacacgagtgaatggctgttttcatccccaacccccaccccccgccgccacttttcacagatgaggaaaccgaagccatgtggctcattaaaggggcactgggatgccgaggagagggctggggatgcctgggcccctgtgggacacagctgagacccagcagagggtcccagggtgaggtcagcccctcaagtctgcgccatcggaacgggctgggaacttgtggtccccggccattgattgtcactgctgcaggccccgaggcgggggacagccaaggacacagccagtctccatcagctccacctgggccgtgccctgcacggccaggtggtttgagtgcaggagtaggcatgctctcacacagcagggggtaacgggcagatggaagtggggcgggcgtgggagggggccttgcacagggccagaaggagagccggtccctgaggaaggaagcccctaaggcaaagagcatgccaggggacagccacaatgccaggtgatggagatgccccaatcggcccccgaggggcaaggaaggggccagaggaggctcgtgagggtgcctggggcttcagtgacagcagccccttacctgatggtctttgtgaccttggccaagtcccttctccattccagatccagggagggtgggggtgggcctgggggagctggagcttcagaggttgaatcattcactagcaggagaagccaagcctgtgagtcagtgagtgctctccatcccagaacgtctgctcccagcccagggatgcagccacggagtgccggggtcagccgtggaggaccctctgagaatgtcttgtggaaaggggcgccttgcctgcccggtagacaggatgagggcgccccagagccccaggggcttctgagagctgagtaccctctgggcctcttgcagccagcagagccaggcagagcttcttctggccttttcacctcctcccccacctcacagagcaagtcatcagcacatatgaactcccctctgattttaaactgatggcttgtgtatttcaccaatggccactgtctccatcagtggtcagtagcacatcaagtaatgtcaacaatgataatagttataatggcagtcactttatgtcagacactgagtgctgcacagacatttccttgcccacttaattgaaacaacaacaaatgattgcaagtgctgttatccccattttgcattgcggctgaggcccagagaggctaggtaacttgcccaaggtcacacagccagtaggtagcaaatccagggctggaatgtagtccatcaggctccggagtctggtctgtgcttgtagccattagttcctgtatctccagaagtgtgtgcggaagtcagcagagtagagtgtggttcgtgtgaactcactgtctcgggtactcccagccttgtgggctgaagccggggattcttgggaagaccttgcagctcagaagctgagccacctgcacctctgccccgtctacccactgagagaaatggacaacaggtggatttatatcagtctccagcaactcagggaccggtttagctctgcattcatggccccttcagggcacccggaagcactggcagtgcacgtaaatggcagctgatagatggggacctgtgccatggtactgaaggcaaacacttccctctaagcctcttgctgtgactttgcagcaagctccccagcaacgccccgggctgggtatgccaggcagagacctggagcatgcacagggctcctcccttccccaccctggctaagctggcagaagccaggccaagcagcgcctggctggaaagccctcccctgcctgggctccttctgttgggtgggcggtgctggcagtgggcctgggagcctgcggagaaggatcagagccacgcgtcactggggcagagggaagcaggctctcaaatgcaggggaattcgggcatcctggactgcccaaggttgggaaggagacaagtccaaggtcacatggctgagtaggtggcaggacttgaatcagagcaacaaggcaagggtggaaatgccaatggttggggaatcttgggactggcaggactcttttagagcacgaggaggtttccggagtcttggttccaaatcaaagttgtacaaagcgagtatgtccgtgtccttgaagagcaccttatttaaaggggtcctgagccagcctctcttgttctgtaggtgggtctctcagtaagcgagcaaccattttattccagtgagaagttctcccctgaggccacaggctcaaggcactttctccagctgcactgtccaagcagcgattttattagaatgcacttcctcaggtgcaccagccacatttcaagggctcaggagccacccaaggctggtggctaccgtcacagacagtgcagagagagaacatttccatcactcccgaatgctctgtcacacagagctgctctacaggaaatggaaacccaagtcctcacacggaccctgaagccacctcccacacccactccctggtggcacaaggccactaatgcagcagcttgggctcccccagagaaccatcctgaagagaagccccaaagagggctgactgctcacagaaatttgaagaggtgttctgtggtgggacaggctccagtctgagagcttaacaggtagggacagaaagtgccaggctgggcttgaacgggtcgttcctcagaatggatgagtgcattctattgtcagaatggcgccagctatgccagggggccacatcttattgatgtgatgggcatgagggacactgccctggttcactgtgtgccaggctctgtgtttgcttcaggggagacgacggaaagcaaaaagcaaacgcaatgcccttcctgccctcctggagcctttgtgctttgctcagtgttcaccaaagtaagagtgcaaacctggctggggccgggaggatggactgaggccacgaggccagccggtatctcccagggctcgggtccacaacctgagtccccgcccatcctgccctgaccccgcctcctcaggtagccacacatggctggtggctaccatatgggacagtgcagagactccgggatgtactgtcacacagagctgctttggagcaaatggagacccgagtcctcacacggacctagacaccccccaccaagcccactgccccatgcctccttggaaggcagtggccaagcatgtactctccaggggctgcgcagatacctagacaaacacagaccagggaggagggaaagggcctctgtcccagcagctcaccgtgctgtgggggatgcccagacctcgcctcgtgctgactccagtggtcctagcacacccagcatggggcaaaaaccagatccggccaccgcctggtccttattaggccccaccatatgcccagcgcactgcctgtgctcaggaaacagcagggaggagacgtgggtttttttttttttaattgatttcttcctatttaaaaacaatactcttaatatgctctctataggaaacgtataaaacacagagaagtcgaaaatgtagtaaagccatcctatcatgcaaatgtaaatccaacatctccatttgattcatttcacattgctgtcattataccatgggctcaattgtgtaatctgttttttacttcacataagcattttctttattaatataatcccttcctaaatgaatggtttttttcaaaatggttatagtttaattttttaagattataaaagcagtaagtgcttattgcaaaaagaaagaatgatcttgaaccatgcaaagaagaaatttgatcattcaacagttatttaccaagcacccgggatgtatcaggcggccttcagtaattacaatttttaatggctgaataatattctcccaagagattgtaattcgcttaattatttggctatttttggaaacccaggcagtcagatttattttgctcttatgcgtgagctctgctgaggagcctctgtcctgaggagagggcccaggcagaggtatcttctgccaaattgttctccaaaagggctttttcatcgcactgcatggtgtcgctcactgcaaccttgccagcattagatattttaatcaaacaaattgtcataagtatctaggtcaaaaatatgtactttactttatatgtctttaattgctgatgagggggcacgtttttcctcatgtttataagttgtcttttccttgtgaattatctgttcctcccttcatttttttttttttttttttttttccctgagacagtctcgctctgtcacccaggctggagtgcagtggcgcgatctcagctcactgcaacctccacctccagggttcgagccattctcctgcctcagcctcccgagtagctgggattacaggggcccgccaccacacccggctaatttttgtatttttaatagacccggggttttaccatgttggccaggctggtctcaaacacctcacctcaggtgatccacccacctcggcctcccaaagtgctggaatgaaaggcgtttattgaagtcttagtgtttcttctgtgggcttgaataaactgtatgcatgaaaaaacagtgacaatttaacagatttgttgcaaataatttttaagacctttgttctttgccatttttttttttcatgcaaaaggtaaacactttgttgctcacaattatttgtgatttcttccattgtttctaggcttagaaaatccctttcggaaatttgagagctgttcatttctgagttttccatgtgtcttcgtgtgtgtgtgtctgtgtgtgtgtgtgtgtgtgtattggggtggtgtagttgcatttttaagatacttaactctttaatttagggattagcaagctttttctgcaaaaggccagatggtaaatagatttccagtttgcaggccacatagtctctgtcccgactactcaactctgcatggtagcctgcaagtagccacagacaatgcgaaatgagggggtgaggctgtgtcccaataaaactttattcacaagaacactgggctgccagatttggcacttaagctgtaatttgccaaacctgttgaatccaaatgagatgtgtcttaggggatagtttgaggtgaggatctaaggtgcatcctttgcagattgctaaccagttgtccccatctctagtagcaaatcggttgttccctggctcatttgcacgcactgacactggtctgcagtcagacctggtgctggctgcctgtcctgacccacgggcccatctgtgtgctgctgtaccggtgatgtgcttttgcctcttgtacctggtatcatttaatacctgacctgccggccccacctcagcaatcctaaagcttgcttctctgtccagtggacttcagaaccactttgtcaagacccccttcctccctccccgccaagataaagcactgggtgatacattctctggacatcctcagagttccgaagccgcagatgagtccggtccccatggggtggggtggcggctggctctgtgcagatgctgtggatttgactctccgcagatgggaggcgggtgtgggcagtacagcgccatcctgagtgaaggcccccagctgaggatagccagacggccctgggaacgccacagcctcctgactgagaaacacgaaaacaaagccggcagtacaagagagcgcgggagattgggaagccactgtgggccggcagaagatgacctcaaatgacaggacttaggcctttctgctgctcttttggaaatcactgtcctgacactcagaattccctgcactccggcgtttcaaatcaaaccctgaaccgggttaaggcgcatggagtggccggttcgaaactgaacctacattcccacagattgcgggccaggggtgtgatggtggcacagggcgtgaccaaatgggaaggggccctttctccaggttggaccagcccggcagtaaccgcttggctccctcaaagagcagcaggagcaggagagtgtgtccagccccaattctcgggcagagcaagggctcaccaggcacaagggtccattccgccccccaccatgggcctcagctccatttctcctggaagcatccaggaccagacactgccacatcttggcttggagccacaggcccaggagagatgggctcaggagcagctggtcctggctcctctggctcctggggtctctgggtaccttcctgtagtcagagggcggctgccagcagatggtcccacgtctggtgcaggagaagagggagggctgtggacgggtagggcacgtctcccacctagtctcatctctccctcctggcctgtggttcatctgcccacaacactgtgaccagcagctaggcttggaaacctctgtcctggggagtggagcaagagtccccccttgtaacccatccatggggccagagggtaagaatgcgctgacctgggggccactgccccagacgcctgccctggtagcccctagggaggcactcgtggctgtgtctgtaggtgggatggggtgggtcagggctcccaggccaccgcctggccctctgcgccccatccacccttccccgaaggaggaagctgggctatagcacaatcgtgggagggggtatctgagatggagacgggcagggttggggtctcccctaagggaggaggggagggggtgagcacacagagcagaaatccaccccttcaggtcctgtccccagcccagctgtgctctcccggtgccttcccagtggggagagcaggcatctgtccatgagcacagagggggcgggaggaatggtgctgatgacagatgatgataagagggtcaggaactggaggagcagctggtggtgggagggtagggggagctgatgggctgtggggcgcactgagggagagactcggagccctgtgttggtgttgggtcccggcctgagagggggcctctgcctctgcactcccttcaggcactcctggagcacggcaggaacttggtggtgcttcctctgggctttgctggaaaagctttgggctcgtatgccgggttcctcgctcagaaatagtgtcttaggcaaaattcaaaaatgaaccagcaatgctcagttcacgcgattcagacagcagccaagcccttgatgaccttcgcgtcctgcagcctcggctgcagcttctgaggtaccctctctctgggcatcctcgccactggctcttcctccatcaccacatttggcagcaggcatcctgccccctcagctggggagagtggcacggatacttcggtgtgctcgttccttgggtctagatcacagaagggcaggcttgactcccatcttcagttggagcccccatttggaggtctgcctcccagatccttttattggcctctgaccttgacaccaatgcatccccccagcctgtactcccaaggactttggcctgcttccagaaaccaggatgccctctctactgcccctgccaggattcctaatggggccccatgggactcgttccctaggaggacacgtgtatgtgtcctggtagctccttatttagtcactgcctgtccaagctggaaggacttagcccagggcccacagccccatggcctccagctgcctgtaatttccttaattacctatttaggccccgacggcttccggtcctcagagctggctctgagattggaagcgggctgggacgggcaccgaggtaccacagcagagccgggccgacttggggcacctctcctcccatccacgtgctctctggctatgaagggctgggaggacagggacccggcttcccattggaccccaaacacgaggtctccgtccctttgtaggctagagtctttcacgctggccacagccacagcgtttctaggtccccatgccgtccctgccttcggggctgctgggcaggcccgggctggcaggaggggcgtggggagcacgtaggggcagggtagtggctggccaggctcacgctgctatgcagctcgcacacccgctgtaattggataattagtgtcattatgcttcctgctccctcgctctctccttctgcagctcttgccttctctggcaggaaacaaatgactgtcccccaaccctcagtgtagacttctggccccaatcacaaaggggcttccaacctccccgtgggatccagggacacccagcattgtgagggccgcctgtgtgggagacaggagcactgcgggagtccgggcaagcttggggaagcatccagagaggcacatgggttcagcccccggccgaacggaatgttctgacttcaccggtcgagcttggtcctgacctgtgaactctggggtccagctggagtccagctgaagacttcaggacaagcctcgggaggggagcgtgtggcgggaggggctgactcagcgaagagcattgccctgctcggcttcctggagatctcctgggcttgaaggaacctccgggaaaatgggcccagtcccctggggaccagcctcagggtgtgtgggcaggtggagccctgccttctcaccaacccagcaaaaaggaacgaggaccatttcgcagattaaaaagtgaaggcccagagagcttgagtgaccaaagccagcacctgcactctggaaccctgaggttgatggggacagatttcctgtccagtcactttgctgaactcttttcattggttctaatcacttgctcgttgcttttctgggcttttcagggcagtataacttggcagagcagcaatgtcgaatcctctggagctagaccacttgaggtcctgttggcctctgcttctggcttgccgtgtgaccttgagtaggctctctaaccactctgtgcctgagccgcatgtgctctttggtggggagggccaccccatgctatagaggctgctggcagagtgatagtcattctgcctctcatccgtggctctatcatctcccttctgcctcagctagaacttctaggacaatatcaccccccagggagctcaggggaaagtgggggtttggtaggtcctggagacctcagggaggcctcctggctctcccagaaccaggctggatttgggttaggagtgaacatttactcaggctatgggcttggcctatctaacagagacccagcataacagtggcttcagtgagagagaattgacttctttctcatgtaagagtctaggtgggcaacctagggccagcgcaacagctacttagccctcaggaatctgagctcctttgattgtgtcatacatggactccatgtgcaagatggcaacagatagatagctgcggccgcacctgtccccacatcagcattccagctggcaggaaggaggggaagggcagaggagaacacattccttctctttaaggacatggcccttgaattcgtccctgtcacttttgctcatacccagttggccaggacagagtcagatggtcatggttagctgcaagggagttgggggaatgtaatcattagctggatgacaagacacttagctgaaaattaaaacatgacgtaggaggtgggagagtagctagcaagtttctgccacacacctctgcggattcattaacacctcctcaagacacatttgagaagtggaaggtacccatcttgaggccaggctttccccaggtgacctggccagcccttctggggatggaatggggtcagtacctctgaagaagtgcagcaaaaagaggggccatttgtgagcaagagggcaggagcagtggtgatggcctctctccactgatctgctcctgtgccaccaaatagggtacccacctggctgggcaggatatgggtggtgttaaaagtcacagaggctgcagggtgggggtagggtgtgtggggaagggtctgcttgggtttccatatccagtaggggggtttcctggaagttaaaatccatacaagcgaactgctggctgattgggctggtcaaggcagtgaaactcctgcaatcacggcgtgtggcttgggcaccacgggaggccattcaggcccagtgtccaccaccctggacacagggcgaagtggctggtgggggctgcttgcgtgttctattgtggtggcatagacatcacctaaaatgtaccacgttcaccatttttaagtgtgcggcccaggggcagaagcacattcatggtgctgtgcagccatcaccaccatccagccgcagaacttgttcgtcttcccaaactgaagctctggccccgttcaaccccaactccccagcccccagcccatggcacccacccttccactgtccgtcccctcagatttcacagctctcctatgaggccctcacaggagtggaatcctacagtgttggcctctctgtgactggctccttctactgagtccaacgtcctcaagggtcagccatgttgaagcccgtctcagaatggccttactttgtaaggctgagtcctattctatggcctggatgggccacatggtgtttatccagctgcctatccatggacattgggttgcatccaccttttggctattgtgagtaatgttgctatgaacttgagtggacaaatacgtttgtgtccctgctttcaattctttggggcctaccccagcagtggggtgggtgggtcctatgggaattctactgctttccacagtggctgcaccgtcttccattctatggcggtgcttgtttgaatgagaattctgggccagccctggagcctctgaaggcaggcaaatgtgtggtctcgagcttgactagacacccagatcccccaggggttggggtgctttatagcgttctggtcctcccgcttctgaatgggaagctctggacccaagactctgtattcgtgaagttccctgagtggggaggggtgcccacccaggtctggcatgggctgccgtagattagagtagagcgctgggccacctaggggccaggagtgctgcagaagtgcatccacccaaaggcgcaggctgaatcgggcaacctcctgggctcctgccacctccagggtgtttctgtgggttccagaatcctccttgtctggacccttgttaacgaggacttccaatgcctgtgtctttctgcggcacccggcgccggacaggcggttgctttggctttgcacgcagctgccagtgggtccccaaggtggcccctccggggctgccctgcagggcagagcttcaggcaggtgggtgcatgcaggagtggggagggggcgccatggtgatggctattgtttttgcccaaagctgttccaggcatgagagccacttgtcatgtgtacagattgtaccaggaacagggggaggaaggaacagagcactgggggccggtggggggcagagggggagcctgtccctttaaatctgttttctcgggttttatttccttctcttttcccatcctcctccctccaccagcacaagtggagccgtgagggcccaggagctgcagcgacggtgcctctgaaatattaatgaggctgttctctgcctcagctccttccctcccccttccctggctgcatgcaggccttgtccttggaaccctcctttcccctcccaggtggtcgccaaggtgcgtcaagcagaggggagggggcaggggcgggcaggaaggagagggcctggcgcaagggcaggaagatgtggggaatcagggataaaaggggtctcccaggtgcacaccagccaccagcatctcgacctgcctaggatcatgccaggcccaggagagggcagggtggctgccagactgggcgccctccttccgtgccctctccccacctgctccccagctggtctaggggcccaccccgggcctgacctacgaggcctgggccacacctctcgctgttgccttggcttgcttttcctctctgggttctgccgggcctggcctgtgttctaggagcctggaggtggagagagatgggggactattgttttaaggaatccccgtagtgagtcacgtcgctgagtgatgggcccttctgaaaggcgggcccttgcttggtgggtctgtagggagcaggtgacggacagtctgccttcaggagggcccacggtggagggcatgtgcccaggtaggcccccaggcgtccacctcctgccctctgcccctgagttctgcttccttcttgcttcggggccacggcatcctgggcctggctctggcttccagatggtctgaatgcccaggagccgcatgttctcatcactgagggtccagtgactagggagtgactcgggagctgggacttcctggcagtacatgccccatcatccctgtggggatatatgtccacgcagaccccagaaactgaaggggtgctcgactggggtgcagtggggctgttttcaggaaagagaatggcgtgaatcccgatgcgtgcatcacctgagatctggaggacggtggtgggatctcgccctccatctgttctctcctccataaaggcggagcaggtggccgagtggaatgcagcctgggcctgctggggaggctttcaggggtgtcatcagagcgtcccagcaagggcggccatgacccacctcaagtcacatggaaggcagggctgggagaaccagggcaaaagcaggaggcttcctgagcctcagtttccccctctgtaaggcagggagagttctcctggccctcgtagggtgtttccaagggtgcagtgaaagaaacatgtctgtcaagagctggcatgcagatgtgggctcaaaactcagtgtgtgccatggggtcctgagaggggccccatgggagcgggggtgccccctacttagaaagtgccgagccttctggagcatgctgggctgcccagggcctggaggaagtccatgggggactaagctggaggtgccagcagagcccccaaagccagggagggacaacataggggaaagaggacccctgggtctctggtcaggtgggtttgagtcactgggtggggagtaggcactctgagcctagttgggaggtgagggtctctgggccctgctgaagagaagagtccagaaggcggttgagtaatgggcctggacttgggccatcccctccagcagcccctggaggcagcagccagggacccccctggctgtctcccaccacgaggccggccagtctgtgcggggatggtgcaaatgccggaaggtgcgaggccccctctgtggaggttctcatttcaatgaagccaattaaggtcagaaagatgaaagagcacagaaatggtatgttccctgcccttttggtgcctacagaccattctcggcagccagcccaggccggaaactctgtcaggcctgcagaactgataggcctagtcacttcggttcttggccatctcggcgatggctgctgtctttattgggcctcagggaggccaccgcccaggcttatatagaacccagaaaagcaaagtatatgccatttggtctgcacagcagccaacagtcgctctaaatgggccttactctaactgatggatcctgtctgccctatagcctgttgcattcatgaagacagtgagggttagcagagcaccccgaccccaccctgtcctccaggatggagactccacctcccaggactccaagttcctcccctgtgggccaggcccccattcactcattcctccaggcccccggccacatgcgggactgaccacgcggtagacttcctgccgactccataccacgtgtctcaaagagcttagggcccagctggtgggagacaagctcacagatcatcgcagcgccaagcagagtgaaataggaatgggtcgcgggattatagactcaggcgcaatcagttttggctggggaactggcagagactcctggagaatgttccacttgaattgtgactaagaggattcatcggaggtcagcaggtggagctggaacagagggcgtgcggtcggggctcagagctggcagggctgtgtggctggggtgggagtggggctgggaagtgctcagaaggaatctggccttttgcttgatggggatgggagactgaaacaggggctcgctggagtgatggtgcctgaaccaggaaagtggtgactcacagcagggtcatgaccagttgctggactagagagagacctaagaggtggtccacaggacgtggagcttgcttgctgaggggtggggatcctgcagtggggagggccagcagggccagccgaggagaaggaagttggccccgggaccatggcagaggggaggactgcctccttgcccactgccctccccatgagtcactgtgggtccagtcagacacagccatggctgcaccagtcaggagcagctgtacgacctggtatggttctgtctgggccaccgctgtggggtcaggggcagggaccgggtgggggaggacagagctggccttgggtatgccatggtcagaggagggaggatgagcacatgccaggggagggccaccaggcctcggtgaccgtgccacgaggaacccctgctctgaggaacaagcatttctgtcatggccgtgtgccacccaagagcctaccacacaagccattcactctgtcacccgctgggggcacagagcctgaacctgacagtggcacaaagttgctacatggtgggattgttgaggcatgaggtgactggagctcaggaaggcagggagaaggcgccctggcaggtgcaccgtcacaagcaaaggtcctggggtggggaggggaggctgtctcgagaagacgaggagtccaggtgagagccgaaagctgccattgctgccttgaggggtcagaagtgggacacccagctgtcctctggctctgccacttccccaagccagcctcagtttcccgcatcagaaaagcaagggcaattcgtccacacagcacccccagaaggagcccgcctcacctgggacagcttcgcttgctgtcctggccccctctcctcagctttcactccttctagtcttttccccccaatgcctgtccccagacgccttgcctcacctttgccccagctgcaaccccacagctcttggccctcgggcctgctgttctccctgtcccagctagagagggacggggttagttgaaacttgttgagcacctgtcccagcacatcaagccagtgccaggcatgtagtagctgctcggtgaatatgtgtcaggtgaccaactgcaagacagggcggggagaggtggggagagaggacggcacaggcacatggccatcattttgtccccacatctcccagaagtgaaggctgcttcatgtgcaatgtgtcgcgagagtaaacgcgcaggtgcccacgcttttcaaacatgggtcactgtggatggatgtttcgtgaagtatccaccagggcctctcctgagaataaggccatggacttggccgtgtctgctttggctgcctgagggctttctcccctttcttcagggctctgggccactcgtttccaacggatgcttctgagccaggagcttccccagagacgggggttcagggccctgctgagctgccaggagggctcttggctgatgtcaaggccaggccatgtgcactgaggccatttcagttccatgaggatgtgacaggcttagctcgggccgggaaggagcggagagagaggagctgcagtgggccccgccaaacactgtgatggctgcagaaggggcagcctgggccctagcggatccttgggtaaggtgacggggacagggagagggatgacaactttgcgatgctcggcagagtggggccagggccgtggcctggatgctttcagtgtggggagactttggctccttactttgtcatctggagggaagaagagcgtggaggggagtgggtggcaccatgctgtgggctgggacgttggcagactcaccagcgacctgtggctgctttggctttctcctgtgtaccctctcctcctctcctcctcagccactccctttatcccctccctcttctccctccctccatccccctttccctccctctctttgcctttccgtcttgtccctctctcccctcccctgtttcccacccttcctccgggcctcctcctttcctcgcccctggccccccaggtactctcagggccacagaaaccgtgagccactaaggccacaccagaagaccaccagggactcatggcatgcccgctgcacagggcgcatcttaaccaggcaagagcagggagtgaaccggagtgaacaagcgcaggactggtggtggggcgcgggcaagaccagccactgatcagtcccagcacgctgccctcacttcagcgtgggttcccgaatggatctggggggcagtgacagcctctgcctccagctagctagtgttaaccactgcagggtcctggcaggaggcatcgacacttcccctcccccacctgggcaagccctccaggttctgggcacccatggtgggcaggacccgggagtggcctggctggtggggcctggcagagcatgagggccactggcccagcctgggaggtgatttctgcacttcgagggtcatggcacagactgagtgaagatttgccgagaatattctggaagatgggacctcagttttgtctcaaccactcccctggcttcttctcgcctccatctccccaggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaacccttccgaggaacagggcagggcagggcagggaggaggaagacagccccatctgtatatttggggatttccggtgtgctcaaccctgtgttcacttaagggggatcagaacaggaggaagggatgcagggtgcaagccttcggagtttcgggtgaccggggcctctcctgggaagagagaggatggcctggggatggcacaagccatttgggtctggcaggaaggggtgaccgaagctgggtcacgggaggcccagagtgctgatcagaggtggcactgactggccacaggctgtcccaaagaggcacaagcccagggtagtgtcggtctcactgctgagggaggctctagaaagcccggtgagcactgtctagaaagatctggggcggaggcctgactatccctgtgggaggcaatgttccacccggccttgtgaggcctgcccagccctggttgctgcggtctgccatgaagcggggacccccaggagccaggcccagccccagattccaggagccacagcattctctggcgctgcgtgcctggcagggctgctggggctatcccagcctagtgccaggcctgttccccagccagtgcgggctgatttgatctgctgcccatctgggcaacgcctgggcccacccatctcctctgctcccagccgtgaggctccttggcacctccagcctcccgctctgccctcaccctcaacccagagactgttctcttgtggctccggcctcggccccgtctgtctgcaggtggcactcaggctgcagggaggagtgaagatggaggaggggggctgcgggccaggtcaggaactccagggtctgcctgggtctccctagctttgtgccctggagctgatgcgcccgtgacacccggcctcgccgccgcacacgccctcacggtgcagctgctgctggggctgatgccttggctctgctcccgagcatctcttgccttccctcctccttgcccagcccccgaggaggctgtggagggccatttatccacaagagctctggcctctcccagatcaaaggaagcagatgggcctcagctgtctgctcttcccctgtctgccaggccttgttaaatatttaaaatgtcaaggcccctgggaacctgcccgattctgccatggagctcaggagctcttgcgtgcctgtggaggcaggggcacggagaagggcaggtgcacaggtgggtggcttggcctctgacgggcttccaagcacctgggtccccaaggccacagtgcagggagccggccaggcctggatctgctgcccacagaatgagcagcagaggaccggcccctcccctcttcaaccctcaaggtcctcgggctggagctgtcgggcttgagctgtctgggtgccaggagcgggtgactcgctccccgcatcccctagcccggccgtgcacccggaccctggtgctcagacctgcctgcccctcagtcctcctcagacacaagggcctgagccacgggggcagctggctttgttgtgccccaagccccatgccaatcccctgacaaggtgggcagacgtggggctgcccaggaggcaggcactcccccgtggggcaggtgctttatggcgcatagtgcattgcgggaaggggactttatcttctggcggtacactcatcaatccactgccctccctgtcttgggagcactccaagaggattccagaacccatcctggaaaccgcgctgctgttgtcaggaaacctgggtctcaggctgaactcagaggtgggttcgcccgggaacctggccccgcccagtgcccctctgggctccacaggcagttctggaaaggagggggcggattcgctgggagccgacacgagatgctcctaatccaattctgatggcatctggcctctgctccgggcaggccgcccatctgtgtccatgccaaccggccagcccctgcccccatgccctggacctggactgccctcgggcctgctggggaagcatgtgctcagagccagaggggccgcagctgtgttcctcctccccgtcaatgggtgctgcagtggggcagccgtcgggaccccgagcccacaggaaggctaaggagaaacgagcaaggctacagctgcaagggcaggtcaaggccaagggagaggctggcgagggcgagggagctcctggggaatgggccaggggtcccggctgctctcagggacaaactgggcatgtgaggaggggcaggcaggagagagactcgcatggaggctccaggctaagggcagtggagaccccaggtgtctggggagccctcccctgctcctctccctccgcagaagccccacggttagcacgtgcttcttcttaagtcacttggggggtcttgtactccctagtactgtccccacctggcttagctcctgtaattccaggagacagtcccagtccagagcgaggtgcacacccctcagttgggtccctggtccccagccccctccccaccacccaggagctgaggtcgtgcgttaaccccaggctcccgattggggcaggctcgggcctcagcaagaggcctttggctcctgaagaaacctgagccaggggcagagaggcacggacagctgcggctcttctgggtggggaggacgccatgtggccgtcgcctagctggggtgaatgagccacggttgtgcgggcggcagcttctgttccactgcggccagggctacccctgcccctcctcagaagccccaaggttagcatgcgcctgttctccagtcatctggagggtcttgtgtgccttcccagacccactgtgagtgccccatgggctggggctgggctctctggtcatcccgtccctgcagcagatggcaggcgtgagcccagctgcccagggctgggagctgcaagctgctgtctgtccaccaggtgtcagtgtgggtctggtcacggccgcgacagcactgggcgccgggtgagcgcccgggagggctcctcgggatcagccggggctgagaatcctggggccaagggtggggccagaggagggtgtcatcccacatgcctgccccggtagaaggtggctgagtgggtgtccaggcccggatgccagtcacgcacgtaagcttccagtaccttcaggccaaggaagactgagaagtaagcgtcctcaaggatgacaagtgacagaattggatagggacaggtggctctgattgtgaaggcaaagccaatttgggggcttctgagtggctttgggtgtcattcaagtcgccatgtagacaagctgtgagccctggctgagggatcaaagttggtgctggagttgcattagaaccaaggctgctgggtcctgagggccctgtgctcaccgggtcctgtcgggcagcgtaggttctgtcctgacctgggccacaggccagagctctgactcatggttacagggccctctccacctccggcctcagtggccttgtctgcaccctgcagagagcagctgatgagcagcccagggtgggcagtgtctccccgacccctgcgaggccatgcagcccagaaaaggcttgaagacttcccagtcccctccctcagcaccgtgactccggtttggcttctccccgcctgttccccaccaggaacccactcccattcccgtgcctctctctctcctcgcgtgacaccgttcttcttctttgggtctctggacccaagaacttgcatctcccattagctctcatgctccctccccactgcttcttccccgagaaacttctggaaagtaagcctccgctccctgttgccagcagccacaggcaccctggagactgctgattcctcggcactggccgtgctcatgccccaatccctcgggccctgcccaccctctttgcaggctgtccctgcccccacaggttgggctgtgtgacactgccagtctttgggaccggctggccccatcttacagagctggggaggggggtgttggtgacaagcctgctcagggaattcataggctgggagctagagaggtgtttcctgacaggcacagagccctggcctagtctttggcatctggtgccatcccagcctcccctgattggtggccctccccatgtctccactaaagtcccctggacactcgctctcctccccaggggaccattggctatactcttctgtcctgtctcctagcaacccttgttgacctggacataccctgctgggtcccctctgtgcccccttgttgggtcctgtcccctgccttccagtgccccctcagcggtagtgtggaggtggccaggaaagcacagggacctgggacccgctggagtccaggagcctcctggcctgttttgtcatctgtgtgtcaggaggaggatggctagggactccccatgacagcagccagagagccgcatgctcactcccacgtgcacacccccagcagtctgcagaaaggctcctgtctagagggagagccaggcgctggccagacggccccagagggctgctgccaccccaggagcagtcagtcagggccacataggaggcctgggacacacaaggccgacccgtcccatcccatcctccccttctgtgcttccggggcaccatgcaggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaaggtaaggcccgggggcctgggctggaaggaggaagaggaatggggcttgagatgagggacggtcacaggatggtgatgtctcctccactgcttcccttctgtcctccgcacagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggtgagtgccctggtcttcacccaccctgtcaaggaagctcggctcctgcttctggggagggtgagccagaggagacccccagcacaggttctccccggtggcctgcgtgtcgtcacctgccttaggaggcgggaggtggcgggggtgggggaggtgggggaacacggggcagggcagagtggtttcagacacagcaggcccccgaagaatcaactgtccccacagcctccacggcgggctttcccccctacaaaggatgcaaatgtcctcgttccccagaaggaggagggctcctgagtccctttcccaggcggcccatggcacctgacgggacctcccctggggcagccgggaggaggcggtggggagaaaggcctctgcttcccggtgctctaggcgacctgctgccagccgacggcgtgctcatccaggccaatgacctcaagatcgacgagagctccctgacgggcgagtctgaccacgtgcgcaagtcagctgacaaagatcccatgctgctctcaggtgagggccaccctccgggccagcctggcaccaaggggcgtcagcagccgtgtggcccagcatcctgtccaggctgcctgctgggctcagcctccacctccaccagggccttccagcataaccttcaggttgggaatctgaagactccgcccgtcttgaggcctgatggtggcagctccagccacagggcgaggaagctggccctccaggcccgggagagtgctttgtgtcctgaatgggaagccccaagcggagaggcttgcaggggccagcacagcgctgtgcttctctcaatccagaccctcgacaatatccagtgggggtagtgttccctttccagaaggtttcagcatagtccggtgtttatcccagttggaaacgtagtgtgaaacgggacaggaaggctggaggccctaggtgggccctgtgggcctcggggtctcctccaagccagggaggaggcttcagcctagttttaaggtggacaccgcgtccctgcttccgggagaccctgggagacaggttgtgggcgctgaatgtgtctcccactgggtgatacaaattcctgtctcagtctctgtgttgctgttccaggcactcatgtcatggaaggttctggaagaatggtggtgaccgccgttggcgtgaattcccagacaggcatcatcttcacgctgcttggagctggcggagaggaggaagagaagaaagataagaaaggtagcgcagcagtgccgccagtccctggtgctggtggcggctccttccacgctgcccattctttctttgcgggccggtgccactgggggctcagggagagccagcccaagtgggtgggaggccgggccctctcttttgattctccgtggagactcctcttctgaggatatcccccctgagagccggcaggccaagggcccctccagtgccgtggacggggagtttccctgagaccaccatccccaaaggctccgggatcccatacctacctggacaggaatggcgttagagggacaggagctacggggagcctcatgcttaccctcagggcccgtgcccagtaaggtgccgaggatcccaggccagcgtgggaggcagccagggaggtgggggtcagaggtcagaggaggctgggacaggtgagggccgggcagcccaactgtgggtggtggccctgccctggggcttacaaagctaggcaagcccgagccaggagggcccattcctcgtcctgtggctggagctgccaccatcaggccctgcagcgggcggagtcctcagaccttctaacctgagtactattcagggaggccctgatggacaagattgaatggctgccacagccccttctggctgggcagccttgctctggcctggacttgccttctggcctctcctgcagccaaaacatggtagggagccacacccgcatgggaaagctctgcttcctgccagtgacctccagccagggccctggggccagtgcgcggggtgtgggggcgtgggggcgtggggcgggcagtcagggcccggggaaaaggtcagccctgagcccaaagctccctggaggcagcaaaggagtagctggatgaccctctgtggcctagaagcttcgacgagccctgcctcctggcagcctgggcctgtgtctccctgcaccggctcttctttgtggcaccaagtcctgtagggctcagtgcagtgtctcaccccagtgagtgccctgggggtgcgcaggcagatgggcagccctgggcctcgtctgggctgggctggagtccctaggcctctgtcctgggaagcccagctgcccctgcctgggctgcctcctcatgtcttgcacacaatggccctctcccatcgtccacgggaacccacgctcctctggagtctccagccgcccttctcaggctgctcaccttctctgtaccttaaatgagtgtgtccttcctaactgttccaggcctctcctttcttttttaaattgacaagaccattcagcccctcccaggccccacctggccctcctctccagcaccctcaggctgtcctacttaggagtcagagctagagggcttcctggaggaagagaaccctgagggggccctggagggagagcagcagctggccagctgggtagagggtaccagcaagaccagggggctccctgctcgccctccccgtctctcccgccccatccccattgtttggcgcagcctgccaggtacacgcttaggatacttgccttctacctgcacccaaccccctatttcttgtctcttgaccttgactcctatgcacctttctccaagtgtgcttctcctcctcaccttccccccactcctgtctcttctggcggggcccagccctcctcttccagcaatgctcatcccagacttccccctgcctccctcctccagaggcctcccagggcctgtgtgcaggctgggtccagagtccatgcttccttcgggcccccacggccccaaggctctgccatctcccctgctgtgctgtgcggtcatcgcactgccatcttgtgtccgtgggggtctcccctccctgcaagaagggccctctgtgcccacaggaaccctgggcggagagggcctgatcaatgccccacccctggctgagtagggtcggggggggggccctccctgctccctggggaccccggatcccaaccccaactgcctgggagtgcagatgtggcccccaggaagctcctctaactgcagctctcagaaggggtgactgtgcccaccacctgagcccctggatagggccacttggggcccagcctggccttgcagggctgctgtgtgccggggctcaggctggcactcctgtgctgcagccctgggttgaccaatgacctgaaagcgccccgcagagtcctagcgtctcattcctttgtccctttaaaacacacactggggccaggcacagtggctcatgcctgtaatcccaacactttgagaggtcaaggcaggtgaatcacttgaggtcaggagttggagaccagcctggccaacatggcgaaaccccgtctctattaaaagtacaaaaattaactgggcgtggtggtgtacacctgtagtcccagctacttgggaggctgaggcaggaggatcgcttaaacctgggaggtggaggttgcagtgctcaaacacacacacactgagctaactgctggacgtgactgcagggaaaaccaatccctaggcaagggcagctgggtgctgtctgcctggcttccaggggttaggagccatctaagtgaaccccttgagctggtttgcagggagcagacgtcccgacttggggaggttccagcttccgggaacctcccactgccagccatgtgtgacccagggcccttccaaggctggctttaggggttcactgtagggctgagcttaaggccgaaggggagccctgggcagaggtctggctcaggaatgccagtgttcatggtgaccgtgtgctgggaggtggtgacggggtgagcctggagaggacggggcatgaagaaggccaccagcaatcaggcccctcctccccaccccctctgccacgcggcccccaggctggtgtcctcaagccttcgtgtctgtcatccctcttccattgtaggcaagcagcaggatggggccatggagagtagccagaccaaaggtaacgggcgccgctgcttgggcacaacaagcttggagccctgggggtggggctggtggagggcacagtgttgggggaggttcacctgcctcggtggcaggagcaacacttggagaccaggtgagtgggctggctgcacagtcccgtcccagtgcagagggaggagagagcacacccctggggctgctcagggcatcctggccacagacactgctggcagctcagcccagccacctagaggagaccttagcccagcatgggcataaggatcacctgtgagtgggcgccccgagtccactctggccagatgagaaaactgaggcccagaagggctgactcacctgaagctctgggtcccagtcagtgtgtttcccaggccagcttcctttcagccaagcctgaggacctgggagacagagtggtcggctgagggccagaggcccggctctcctctcagccccggacagctggcaggtgccgacaccctggggccagcatgagcctggctgtgagacgcaggaagcaggagaaggggtgggaggagcggggaggaggccagccgtggcccacggaggacaggagatgtcggccaatgcagcagccagctctaggtgctggagtccatggggaacaaggcaggtcctgaccctcaggaaggtcacaggcagagatgacccaggcaacgccctgtgcggagctgggtttgggagggcagtggggggacagcccgatggctgcagccctgggttgaggaggtggcagcaggtggggcacaaagctggaggggcccagctgggtggggcaattgtgtcctgacgccactgggaagaggagccgtggcgaatggccttgggctggcaagtgaggaggagcaggaggaggcagaggtgatggcggtagtgccaagagccccagtggatcggggaccagagtagtgagggagaaagacgagtctgctctccccaggtcgctgcgtcggtcccggggcagaagagggaggtggggtggccaggattactctgggccgtggagtgggtgcggccagagcttggcagggagggagatgaggaagtgacagaagcagaggagtggggagaggagggagccggagtgggggacacaccaccaccatgtcgagggcagcaaggatgaggagcacaggacccaccagggaagaagggagaggagccgtctgctccaggggagaggcagggagggtgctggagggacagatggagcccgaacaggcgcagggctggctggtgggaggagagtgcatggggcttctgggcctccctaagggaggtaggaggtggctcggacaccagtaagcagatgagtcagctcagggttctggaagattcctcgggccacaggcctctgctctcaggtattatttggggcattccaggaccagtcaccctgtctgtgtgcccaaaagccttgtgctgtgtctgtcctcccttctcccgagagaaccatctctgtcccacctagaacagtgctggagccaccccacccaccccaagagggcctgggcttaggaggcgagagaagggaagctgatagacttggaaataggagagctccactgaatcccgtctcctctctatggtgtggcatgtctttcccccacaaaagccccttataacgccttctccccagccaggcactgaccttggccatggggttcctctgtgtgcagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcaggtagggacagcaggaggtggtgggcccaggccattgactgggcgtggaggatgctgggctcctggagatgagcccaggctgtgtagagcaggtgggaagggatgtggcaggtgatgtgtgggccaggcaggcaagggcacaggccaggccggcagtggccatcagggcctggcgcagcccttccctagtgagcagaagtcccaaaccctcgacgaaagcccgggtcacacactgagccactgcccatgaggtgcccctacccaaggctccaggctctgcccctggcaccctcaaaaggcagctgggggcatgcagggctggtaccccaacttctggggtgcagtgggggattgactcttgctagtcctccccagcggtgcttctcctgccatcagaccacaaagtccactccccaaccccagcagcactccagaagaggccacacagagcccccttgcaaacaggccccagctcacctgctgagccaaacctgggctgtttatcctgaaacgcaaggcaaatctacaaggccttcacaaatgcctccgagaccgtgtccatacctcttcttccctcttcctgtccccctccttccctcacccgtggcaacccctttcgtctcctccccgctctgtggcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaaggtaatcataaaacttacagttgatactgtttacagactcggaaactggggtaagaagtcattgggcgccttggtggcagtataaactggggacgtttgggatagctcaagggaggagaggaggtgccgagcagggacccagggggcagctttgctgatctgtcagctcaggtccctcggcatgagatgggccagaaagcaggcaggcggtgagatacccaggggttcagcatctgcacaatgtgggcagtaggacggaggggctgggaggcagcggggaagcggagaatcagcagagggcccgggacactgggaggcagtgggaggaggtggggggagccaggtgtggggtggtggggtggtggggtggtggggtgggagagctgcagggctggtgggtaactgagagggggctcgggcaggggaggtcccgggtgcgcatcccgcccccaccattggatgaggttgctgatgccttacagcctcgctattggctcagggctgaccaggtgcccagtgggcttagtgccacacgtggagctagctgagcagaacagagtcacgcgatgtttgtgttgacatctctcactcctccaccccaacaagcacctgggccaaatgcccacaccctcgccctttgcagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactagtgagctggggcaggagcgggcgggcagggccgggggcaggagcaggggagggtcctggccagggtgccaggtgagctgttgcaaggtgctcattaggcccccccttgagaacttttgcccatccctggcctcacaggtggctctggctgggaaactgcctgtagctaaggccgaccttcctctgctccctgccgcccacaccctaacaatgtggtgaccacgagggggcagagctggggctccaggggcagcatggagggtggtctcaggcccccagtgcctgctagccctcgtcatcttgcagcctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgagtgagcagcagggaggtgccggggtacgcacggagtttctgattctattgtcgtggtaaaagaggccgaacgtaaaattcaccatttcaaccactttacagtgtacagttgaatggcattaagcacgttcacaatatcatgcaaccgtcaccactacccagttccaaaacacctccatcaacccggaaagaaaccccaggcccatgagcagccctccccacgcccctccccagcctcatgtgcttcctgtctgtatggatttgcctgtctggacatttcctatcaagggactcatacactgtgtggccttttgtgtctggcttctttccttagtgtaaagtttttccgtttccctcagatattagaccttcctttctttttttgttttgttttgttttttccctcaagccatcctcctacgtcagtgtcccccgtagctgggattacatgtgcatgccaccacgcccagcgaattttcaaattttttgtagagctggggtctcctcatgttgcccagggtggtcttgaagtcttgggctcaagcgatccacccacccggcctccctaagtgctaggattacaggaatgagccactgccaccagcccgaacttccattctttctaaggctgagtaatatccattgtatgctaaagagcattgtgttggtccatccatcccttcatctgtctaccagcacgtctaccagcacgtgagtcgtttccaccttttggctgtcacgagtcacgctgctgtgaatattcacgtacaagtttttgtttgaacccatgttttcaattcttttgcgtggacatctaggagaggaatggctgggtcgtggtgtccacgaaactgttttccacaggggcagcaccgtttcacattcccaccagcgacataggagggttccaccttctccccatcttcaacagcacttattttctggtgtgacaatgctgatgggggccatccttgtgggtgtgaggcaatatctcctggtggttttgatctgtgtttccttgatgactaacaacgctgagcctcttttgctgtgctgactggccatttgcctgtcttccttggggaaatgtctgtcctagccctttgctcattgctgagttgggttgtttgtctttttattgttgggctgtaacattttttctgtattctggatcctagatccttatcagctatgcgatttctacacattctgtcccattctgtggcctgtcttcactctcttgatagtgtccttaggtgcacaaatgttttaaatcgtgatgacgtccagttgatctattttcttgttgttgcttagagatgatgaaaattttcttagagatgatgaaaattttctggaattggagactggtgatggtcgtgcagctctgtgactatactaaaaaccatcgaattatctactttaaatgggtggactgtgtggtgcgtgaattatatcccaataaagctattagaacaaagtaagggagagtgcacagcgtcacctccaaatgccctggcttccccactcccactcagccttcccggactccacacccttggccttggcgtctctgtccacaagtcacctcgctcctcatgactgccgtcccagggccctcagggcaaggtcctctgcaggacgcccagggctccccaaaggcccaggcccacgctccttcctgtgttctgcggactggaccaccaagtgcaccctgcctggccgccccacccacagcgctctcccagaactctgccaggtgcagcgctcactgccagggccaggaccacctcctccctggagccatccctgctggtgtgggggcctcagccctctttctgtgcttcttttttggtgggcactgagggacactgaggcactgcggacaaaaggcccagcccagcttcactcccccttactcccatgcctcagtttccctggtggcatggagatcacagaatacttatctctggggaggggtgtgagggttccgtgggtgaatccacatccataggaggctctccgtccacacagcttctgttatgatcatttccttcgtcaccagcctcccatgcagtggcagcacctggcactcacagccccactggcttcttccaccatgcccgcctctgtgaccctcggctcctttgctccctcctctccccacctgaatcctcccaagtcctgtcccttttgagaagctcctggagtcatgagcgctctactgaggctgtggctgcctggacgtggttatagcgattgtccacagacttcagtttttgcccaggttccacccgcttgccctatgaagtctgtggtggagctgccatgagccacatgctcctgcctccctcccggtctctcagcctgcagcagtgcatgagcgtcctggtgccctcaagcaacagaaatggattctcccccagttctggaggccggaagtccaaaagcagggcgtgggcagggccgaagcgcctccaaagcatctcagagaggatgcatcctgcatcctccagcttctggtggtggctgccagtcctcgcgttcctcagcttgcagctgaccctctctaatctctgcctgttgtcacacgcccttctccctgtgtgtctgtgttctcacacggggcactcctctctgataaggaccccagtccttgactaagcccccaatccagtgtgaccagcgctgttccttgttgttctctccccacctccacctcatctctgcccaccccctgcctaggtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtagccaccaccttctctgtgagctgccctggtaactgtgccctctgcccgagcttgtccggactggtaggggcggccttccttcacacacagctgctgcggtccctccgtagtacacttgagccccgtcctgggtgctctcaccctgacacccgcacaaaggctctgtcctgcctgctggaaagcccttcccgcttgacctatgggcccagctcaggctccaccttctaccaggtgagaaggtggcagtggcggagagaccgtcgacatttgggatctgatccacccaggaccgatggactggaggtggtgctgaagcctgaggggacacaggtttggggcacagggtgggcgtttattggttgagggtttggctggggctactctacggtcaggacgtcctgtggcgagctcacagcaaaggtcctggcgggaaagggagcccagaagcatatccccatatggacgatgccaccaggggagtccagatgaggggacctcgagggccgcgtggcagatgccatggccttgacactgggaagtcactttgttgttgaaagatcccagaccctggagagtgtggaggatggccggccccggagggagaatgcaaggcatggggtgcccctctgtctccccagggcctctgcatggcacccacctgtgtcacaagcagggccactgtgaccctgacaacttgtctttgtaggagccaccctgggggtgcaggtgcaacctgggaggagaagcttctgggctctccttcgggagacaggcattcatgtattggatcatgtagcaaaaacactcaattcaaagacagtgcgtctaaacgccagccatggctcatgtcaacagagcagccccgtgccccgaggagaacatggtcactgcgcccagagagggagcacctcgagcttgccctgggagaaaatgggtggtagcggaggacaggggacagaagtccagcgagggaaatgggccccgcaaaggcgggcagcggcatgagtcccgggccccactgagcctgggagagcagaaggagagggtgctggtgaggcgaagcaaggccacacttggggacaggagccatcgagtccctctgttggaccagggagcaactgaagcacagagcagaggaaggaatcttgccagaggggcctggggaatagggacagctcctttccagcttaagagtggctgagagagagtccaaggggtagaccacagtgacagggccaggctgcggaggctgggcagacccccacaaagactggccagcctggtggtggctgaggaggacgcacagaaggcccagcgaagtcctgggtgccggcaacaggcagtaggacacaagggcctcactgaaaccgccagggtgcttggagatgcggcacggctgcagccagaggagggcccgtgaggctgggccctggggagccataggaagcctgtggctggggtggtattgatgctggagctgggccggccgggggcactggcaacttctccagacacctggctggctgctgtgctgtggggccttggggagaaggcagggagcagggctgagcaggcgaggaaggacagcctggcctggccctttggggccatggggaaggaactgggctacacacactgggcctgaggagggaggaggcctgggttcgcagctgctggttttcaggctcgtcacggccacttggtggcagcagaggggtggcttccagacttttcagggacaggcattcgctggctcaaaggagaattgtcttcttgtggctcgtgatcttgttatccagcaccccaagatcctcagagagtacgaagtgtccccgaggctggcagtgaggccacttagtggtatatgctgcaggaaccattggatcaccctgtcacagcttagagtggggcccccagctgtctccctggcaaagatcacagcccccctgcccatggcctcagggggcgccaggattcagggactcccaggtcaatgtcctcccctggtgtctcccggctgccctacccctggctcccactcctgcgtgtctactccccaccgccgcaggctccccaggcctggcggctcggccacacctaggcttctacacttacccgacggtgctcacaagccccactgcctaggcttgacctcctcattcaggttcccaaactctgaacctggctcctcttctcctctccccctgcccgtctacctcagtggcatcagctgcctgaccctgtctctctgtccccgagcctgaagagccacatacctcttcatttgggaactgtcttccctgtccccccaccactgggacaatgccaccacctcccggccagtctcctggcttcccgctctcaaccccttgcaggctgttcgctttccactcagcactggggaacctctttctctttctccagaatctaatgtgatgcaggtggtccccaacttttaacaattttgtaacttggtgcaaaggtgatgcacattcagcagaaactttacttcgagtcccatgcttttccctttcagtgcaggattcaatgagttacatgagataatcagcactgtattccacaataggctttgtgttcaatgcttttgcccaactgtaggctaacacaagtgttctgagcacgtgaatcggatggctttactctcacctctgctggaccttgggccacctgcagatctgatggaggaaggggtactgcctcaacccaaaatacgtcttgcctcgatggccccgcccacctctcttgtctcttctaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgaggtagcacccggctgtctgccaccccagaccccccttctcctcaccccagccccctgcgtgcccgccttagctctgcagcgtccttgtgcttcccctccccagatagaacaggagcggctggacaaggtgtggcccaagctgagggtgctggcccggtcgtctcccaccgacaagcacacactggtcaaaggtagccgagcccccacacccctttcctggggtggccagcccgaggttgtctgcttcctgacaccaaaagccaggttcccaaacaggtccccagggcctgcctaggaagctgggtccatttgtcccattagcccagagcagcagggcaggggcccatgagggaaccagggttcggggagggctagtgactcactccaagtcacacagtgagtctctagaagcagtgggtctagagccagggacccaggattgtgtccccaggccctaaccagatccctatcctcccaccctggccctgtcactcagtgagatttgcttacttatttggggataggagatgatccaggtgacggggagcacagataattgggacagtcaggacggggtaatcccaaagggttttcacagccaacctacccccatagctccctgggcagggctacacagggttgtggtgacagatggccccagccctgccctgccctgatctgtcttccagggattatcgacagcaccactggtgagcagcggcaggtggtggctgtgacaggggatggcaccaacgatgggccggccctcaagaaggcggacgtgggcttcgccatggtaagccacctggtgcccgcccagctcaccacggcagatggggcctgcatctgtcccatggacattagctttgtaccaggaagtgggagccagtgtcggggcaggttacagagtgcctgaaggttctttctttcacatcctggccacttgggcctgcgtgggctctgccagtcgggggacatgtggttaaaggcatctgctgtgatgcccaaggtgacagtgggccccagacatactgtggagaggaaggggaatggggggtgggggctcatcactgatggcattgcccacccccgtcctctctaaatggactctcagccccagatgaggtgagcagagtccccagatgtgctcttcctctgcacttccttcctgttgctcacccactgagcagggtagccctgcagacgccacccacatggctggttgcggcccctcagtggccccacagccactgaacgcagcaacctggtgagcccctctccctgccctaccgaaaaggagtgtcacccagggaacccagcccagtccttcccagcacccgtagcccagaagggagctccagcccaagcttcgagaggtggcagctctcacggggccaggcttggggcagaggagaggactgcgcagcttggcacagctgcagctgcgcctccatgggacagggactcctctgcaaggagccgccccgcccagggtgtccccatgcaggacttcccagggctccttagccagcaagcctctctggagtgctaagaacagaccacgctgcttggtggccacgtggtggcagctgggctttatgtgtaaagctgtgttgatgccatgtcatcagcaccctctgtgtttatgagcaaagcccccccccccaccgtgacatgtgacaacttactgtttgtagtacaagaatgtgttgcattaaaaaaaagcaacaaaaaacagtgctgttcttggctttggggggcggggtgggatgttattcagaaggggagagcagggagccagcccaggcgggccaggtgatcaaggggggctggggaaggggcccccacaaacactctgtgtgagtgtgtgtgtcacccccccagggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggtgggtactgggggctgccatgccccagctaggacacctgggctcaggcctgagggccagattgtgagagtgagggttttgttttctttgctgcagattattttaattgagatcaaattcatatgccaaaaattcaccattttcaagtacataattcagcactcgaatttgtaggacattcaccacgttgtgcaaccattggctctatctagttccagaagattgtcatcatcttaaaaagaaaccctgtgctcttgagcagtcatttccccatttctcccccaaacatcccagcccccggcaaccactcacaggcttcctgggtctatggatttgcctgttccggacatttcattcctatgggatcaaataatatgtggcctcttgtgtctggcatctcgcttagcaccgtgttttcaggctcacacacaccgtagcatagggcaggactttctgccttttcatggcctcataacactccacggcacagactgccacattatgtatgtctgccctgatggacacatggctcgttcccactttttggctcttgtgaatggtgctgccaggagcatctgtgtatgagtttctgcgtgggctatgcgtcccatgggaaccctttctcaacagtcccattttccccattggtgagtgtccagattttcttcaccccgccttagaaagggggtgtttaaattgcctgctgatcaacttggtcttttcaaaacaattttttaaattgagataaaaaatcacataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggtaggctggccaggggcacccgggaggacttcaggacactgttgccaccacctcgggctcagattctgtctggtgtgtctccacctgtgtctccgcacccagtacggggtgggacgctgcacttcctgactggacagcacacaggggaaggagcagatgggccaggctagcaaccctgcagccaggcctgctggtggcctacagctctttcgcaagcctctcctcccaggccgctgagcagctgagaaacagttcatgtcttgacatcctgcccacggctgtgtagctgtgtagagtaggcagcttctacccagccccagagtggccacggtaaccctaggaacagaacagcccacatttaccctgtgaagattgctcctgtggagtgactggggtgccgtgctggaagctgtgaggtgggtggggggtgaccgcaagagagaggaagaggaggagggcgtccgaggaaagccagccttaagaacttcccttcttaatctcttccttcctgccctcaggctcagggtctggcccctggcccagaggggtctcaggactctggttggttgagcctggggtgggtgtggctgccttgggccttggccgtgagctggaagtggccatcccctgggacaagggacccatctcgggagctacacaccgaagtctcgctcctgagtaatgcgtcatgcgctgagatgactgtgcctgagtggggaatgttgctttccaggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcaggtaggaggggcggctccactcttggcctctgccacttgcaaaaagtggaggtggtgggcttcaagacccctcgtccacccctagtactggcctccccacctccactcccagaaggagccccaccccacctggctttcctgtagcccccgtcctctctgcatgtcggagagggccttcttcatcttccaaacattgccggccttgccctgggtgagcgcgctggcttccagaagggtttcgtgagccctcatcggaacgaagttttctcacagatgctggaaggagtcctccctggctccctctaggtctgccattcccatttctagcacttaattccttggcatgaggctgccataactccagaagtttcttttggagatgacctctgtgcccagtgctgacacactaacctctgcttcccacagtgctgtggacaggctggtcagccccactgtctaggaggggctaagtgttctaaaatatagtgtatttgtagaaaaattgaggtatagtaaggccaaaaggtcaagagacagttgccactgaaagacagtttatgactcagagaccccaagaggaggacacatgccacaccataggggcccacatgggagagcgccaggcaggaggtggggtgtgagagctgtggacaagagcctttgctgtggttccctcggggaggagcaggtgaggcagggctggtaggctcaggactggctaggttgcgtcattgcagcggttccagggcatacgggtgctccctggctgtctggtacctggtcctgggtaatgagtgcaaggggatagtggcccggaatgtgacagtccaacagaggacggggtcagtttgcatttggacagcttgcccctgcaaattggatgcctcccgaggaggcaggaggccaagacaaggtgacctcggcaggttctagggtcctccagaatgaggcatgtccagcgtgcccgcagggtgggtgtcacagcctccgtcttgctgaaaataggagcatggtcagtggagctgggccccactccgaggctggagtcagtaggtgcctggcacccaggggcgctgggggccatgcactgctctgtcatcacgcccccggccttgtggtcctctcgcaaggagcagcccgtgcaactgggggaaccaaccagggtggctgggtcttcaaggggttggaggacaagggtggctcaggagccgcggctggacctgcctctctcccacttgcccttcgcagattgtcatcgtccagtttggcgggaagcccttcagctgctccccactatccacagaacagtggctctggtgcctgtttgttggtgttggggagctggtctggggacaggtgagtgacagccctgcccctcatttcagactgccctgcagacagcttctgtgatgggcccacttgccctaaccctgcttcagagccttggggtcctcaccctaggaagcacactgagggctcaggcctgtgacacaccaggacccagggacaggacgcaagggaaggtgtcagcaaaagaatgcaaaggaacatggctgggatgtgacagggcccaggaaaactgcccgcagctcccctttctatgataagagccaaaaattgccccttccaattgggtgggtagcttgggaaatccccacatattttaaatcaatcaaacagcaccctgatcaataatccatggggcgaaaagaaagtctccagagaaattaggaaatattttgacctgatggaaaggacagagagtcccacatcgagctctgtgggctgcagctgaagccgcacactggcaggtttctaggaccccacaattagatcaggaagaaacagcctgggtatttaggatc

SEQ ID NO: 1176 - DNA, 4361 bp, Homo sapiens
cttccccgccccacggaaaggggaggagcttgggctgtttgaatggctttgggatggagcaggggagagagtggctccgtttgcctccccgctttggtgatgctgtgcgagcggcttcgggggccctggagacgtccgagtcactgagggtgggctgggactcggggcccgcgtcccatctccccgccgattggtccgccccccgtgcgagtgtaacacagccagcctcgaagacttccctctgagttggaatgataatgaccgaatcccgagaagttatagacttagaccccccagctgagacttcccaggagcaggaagaccttttcatagtgaaggtggaagaagaagactgcacctggatgcaggagtacaacccgccaacgtttgagactttttaccagcgcttcaggcacttccagtaccatgaggcttcaggaccccgggaggctctcagccaactccgggtgctctgctgtgagtggctgaggcccgagctgcacacgaaggagcagatcctggagctgctggtgctggagcagttcctgaccatcctgcctgaagagttccagccctgggtgagggaacatcaccctgaaagtggagaagaggcggtggccgtgatagaaaatatacagcgagaacttgaggaacgcagacagcagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatgcccttcctgttctccaagttccttcccttcccctgaaggacagccaggagctgacagcttcacttctctcaactgggtcccagaagttggtgaaaattgaagaggtggctgatgtggctgtatccttcatcctggaggaatgggggcatttggaccagtcccagaagtccctttatagggatgacaggaaggagaactatgggagtattacttccatgggttatgagtccagggacaatatggagctcatagtgaagcagatttctgatgactctgaatcacactgggtggcgccagaacacaccgaaaggagcgttcctcaggatccagactttgcagaagtcagtgaccttaaaggcatggtacaaaggtggcaggtcaaccccactgtggggaaatcaaggcagaatccttcccagaaaagggatctggatgcaatcacagacatcagccctaagcaaagcacacatggcgagagagggcacagatgcagcgattgtggcaaattcttcctccaagcctcaaactttattcagcatcggcgcatccacactggagaaaaaccgtttaagtgcggagaatgtgggaagagctacaatcagcgggtgcacctcacccagcaccagcgcgtccacacaggggagaaaccctacaaatgtcaggtgtgcggaaaggctttccgggtgagttcccacctggttcagcaccacagtgtccacagcggagagaggccctatggctgcaatgagtgtgggaagaacttcggtcgccattcgcatctgatcgaacacctaaaacgccacttcagggagaaatcccagagatgcagtgacaaaagaagtaagaacacaaaattaagtgttaagaagaaaatttcagaatattcagaagcagacatggaactatctggaaaaacccaaagaaatgtttctcaagttcaagattttggagaaggctgtgagtttcaaggcaagctggatagaaagcagggaattcccatgaaagagatactaggacaaccatcttcaaagaggatgaactacagtgaagtcccatatgtccacaaaaaatcctccactggagagagaccacataaatgtaacgagtgtgggaaaagcttcattcagagtgcacatcttattcaacatcaaagaatacacactggggagaaaccattcaggtgtgaggaatgtgggaaaagctacaaccaacgcgtgcacctaactcagcatcagcgcgtccacacaggtgagaagccctacacctgtcccttatgtgggaaagccttcagagtgaggtcccaccttgttcagcatcagagcgtgcacagtggggagagacccttcaagtgtaacgaatgtgggaaaggctttgggaggcgttcccacctggctggacatcttcgactccactcccgagagaaatcccatcagtgtcgtgaatgtggggaaatcttttttcagtacgttagcctaattgaacatcaggtgctccacatgggtcagaaaaatgaaaaaaatggcatctgtgaggaagcatatagttggaacttgacagtgattgaagacaagaagattgagttacaagagcagccttatcagtgtgatatctgtggaaaagcctttggttatagctcagacctcattcagcattacagaactcatacagcagagaagccctatcaatgtgatatatgtagagaaaatgttggccagtgttcccacaccaaacaacatcaaaaaatctactccagcacaaaatcccatcaatgtcatgaatgtggcagaggcttcactctgaagtcacatcttaatcaacatcagagaatccatactggtgagaaaccttttcaatgtaaagaatgtggaatgaatttcagctggagttgtagcctctttaaacacctgagaagccatgagaggacagatcccataaataccttaagtgtagaggggtctctgttgtagaatagctcttaattttagagaaaccttcctggagggaaaccatactcctataatgagcaaagtaacaacttcaagcatttttccagcgttaccatcaaactcacaaataggttgaaatcctttagttataactcagcctttaggaacaccggagaacccacaataatagaaatcttttcgtgttccccattgagaaatgctttagttagcatcttcatgcttggaaatctagacaagaagagaatccatggatggacatggtcgaggaattcggaaagcctgcagttgacattcagtcttcacttgaaactcaaaactgacactaggaacagcttcatgagttcagtagaagtaagctttatttgtagcttctgccttgtttgacggcgtatctattcagggaagcgcacagtaaaagaattccttagcatgatgtctgttttggtacctcagcaatgaaccttttctagaaattattattccaaccactagaataccctagtcactattcccactttgagcattaacccctttgaaaagaaatggacttaaagtatctctgttttggcaaaattcaggttcaggggctggatggtatgtgtttctgctgccttattcaatccaccacttctctgtgaaacactctaccttgtttttggtttgattctactgatgtcagggtttagccggtagaaggagtagttcagtttgtcaattcaggagaaactgtactggtcagtcacatcttacggcgaagggagagggaccttaggggagcagagaagacaggcaaagttgtggactgtttgatcttgtattacccacaggaatgagggcagctaaacccatagaaggagttggaccaaggcgaattacgagtcctggtcccagcagtatgtgtgctgacttctgggtgccccagaaatagacctctcctgtagagtggtgatatacagaatgagtttcagtttgcattgcagctgggattgaaagtaatcagtcgtgagcaggcaggcaggaggtcctgttagccctgccttccaggaaggttggggtgggagttttgagtgggaaagaggatgacatgtgtgagagagttctgagcctgtttgctagggagagtgagtgagtgctcttgggcactgctcaggccgtttctgctgacttgcctggcttacaataaatgcccaataaatatttgttgaccatatgtgttgtacactgtggtgccctgtccagtcccctctaccaagctgagacccccatccccagctgctctgagtttgggctgcaagtgctcacagctcttgttctccagaaactggagaattgccctcaggagatgagagccatctcacctcacccaggagtcacttcctctctacaccccaacacctggttcatttgattaaagcggagaaaactccagggtgctatgactgctctggcacccttggatcaggccaagctagactttttctgagccttcatccgtgctaagctctctcccttctctatcctgtttcattccctccctcaaaggcgtttcccaaataaatcacactgtcaatcaaaaaaaaaaaaaaaaaa

SEQ ID NO: 1177 - DNA, 1400 bp, Homo sapiens
agagacgtggcagcggagggataatcggggcggccggggctgaagggagaggcgcaggagccctggggagagtggtccctgcccttccgcgcctcgagccatcgctaccgcccttcggaaccagtgcagcggccgatcagtaaacacagagactggggatcgatcatggggctttgtaagtgccccaagagaaaggtgaccaacctgttctgcttcgaacatcgggtcaacgtctgcgagcactgcctggtagccaatcacgccaagtgcatcgtccagtcctacctgcaatggctccaagatagcgactacaaccccaattgccgcctgtgcaacatacccctggccagccgagagacgacccgccttgtctgctatgatctctttcactgggcctgcctcaatgaacgtgctgcccagctaccccgaaacacggcacctgccggctatcagtgccccagctgcaatggccccatcttccccccaaccaacctggctggccccgtggcctccgcactgagagagaagctggccacagtcaactgggcccgggcaggactgggcctccctctgatcgatgaggtggtgagcccagagcccgagcccctcaacacgtctgacttctctgactggtctagttttaatgccagcagtacccctggaccagaggaggtagacagcgcctctgctgccccagccttctacagccaggccccccggcccccagcttccccaggccggcccgagcagcacacagtgatccacatgggcaatcctgagcccttgactcacgcccctaggaaggtgtatgatacgcgggatgatgaccggacaccaggcctccatggagactgtgacgatgacaagtaccgacgtcggccggccttgggttggctggcccggctgctaaggagccgggctgggtctcggaagcggccgctgaccctgctccagcgggcggggctgctgctactcttgggactgctgggcttcctggccctccttgccctcatgtctcgcctaggccgggccgcagctgacagcgatcccaacctggacccactcatgaaccctcacatccgcgtgggcccctcctgagcccccttgcttgtggctaggccagcctaggatgtgggttctgtggaggagaggcggggtaatggggaggctgagggcacctcttcactgcccctctccctcaagcctaagacactaagaccccagacccaaagccaagtccaccagagtggctgcaggccaggcctggagtccccgtgggtcaagcatttgtcttgacttgctttcctcccgggtctccagcctccgacccctcgccccatgaaggagctggcaggtggaaataaacaacaactttattaaaacaccaaaaaaaaaaaaaa

SEQ ID NO: 1178 - DNA, 3241 bp, Homo sapiens
gcggccgccgggagggcgcgcggcgccggagacatgtccaggcggaaacagagcaacccccggcagatcaagcgttccctcggagacatggaggccagagaggaggtgcagttggtgggtgccagccacatggagcaaaaggccacggcacctgaagccccgagccctcccagcgcagatgttaactcacccccaccgctgccgccccccacatccccaggaggccccaaggagctggaaggacaggaaccagaacccaggcccacggaggaagagccgggcagtccctggagcgggccagacgagctggagccggtggtgcaggatgggcagaggcgcatacgggcccgactcagcctcgccacgggcctgtcctggggcccgttccatgggagtgtccagaccagagcctcatcccccaggcaggcggagccgagcccagccctgaccctgctgctggtggacgaggcctgctggctgaggacgctgccccaggccctgactgaggccgaggccaacacagagatccacaggaaggatgacgcactctggtgcagggtcaccaagccggtgcctgcggggggactcctgagcgtgctcctcacggccgagccccacagcacccccggccaccctgtgaagaaggagccagcagagcccacgtgcccggcccctgcacacgacctccagctcctgccccagcaggccgggatggcctccatccttgccaccgcagtgatcaacaaagacgtcttcccctgcaaggactgtggcatctggtaccgcagcgagcgcaacctgcaggcgcacctgctctactactgcgccagccgccagggcaccggctccccggccgcagccgccacagacgagaagcccaaagagacctaccccaacgagcgcgtctgccccttcccccagtgccgcaagagctgccccagcgccagctccctggagatccacatgcgcagccacagcggagagcggcccttcgtgtgcctgatctgcctgtcggccttcaccaccaaggccaactgcgagcggcacctcaaggtgcacacggacacgctgagcggtgtctgccacagctgtggcttcatctccaccacaagggacatcctctacagccacttggtcaccaaccacatggtctgccagcctggctccaagggtgagatctactcgccaggggccggacacccagcaaccaagctgcccccagacagtctgggcagcttccagcagcagcacacggccctgcaaggccccctggcctccgcggacctgggcctggcgcccaccccatcgccaggactggacagaaaggccctggccgaggccaccaacggagaggccagagcggagcctctggcccagaatggaggcagcagcgagcccccggcggcccccaggagcatcaaggtggaggcggtggaggagccggaggcggcccccatcctgggccccggagagcctgggccccaggccccgtcgcggacgccgtcgccgcgcagccccgccccggccagggtcaaggccgagctgtccagccccacgccgggctccagcccggtgcccggcgagctgggcctggccggggccctgttccttccgcagtacgtgttcgggcccgacgcggcgccccccgcctcggagatcctggccaagatgtccgagctggtgcacagccggctgcagcagggcgcgggcgcgggcgccggcggcgcgcagaccgggctcttccccggggcccccaagggcgctacgtgcttcgagtgcgagatcaccttcagcaacgtcaacaactactacgtgcacaagcgcctctactgttcaggccgccgtgcgcccgaggacgcgcctgccgcgcgcaggcccaaggcgccccccggcccggcccgcgcgccccccggccagcccgccgaacccgacgcgccgcgctcgtccccgggccccggagcgcgcgaggagggggctgggggcgcggccacgcccgaggacggcgcgggcggccggggcagcgagggcagccagagcccgggtagctccgtggacgacgcggaggacgaccccagccgcacgctgtgcgaggcctgcaacatccgcttcagccgccacgagacctacaccgtgcacaagcggtactactgcgcctcgcgccacgacccgccgccgcgccgaccggccgcgcccccgggaccccctgggccggccgcgcccccggccccctctcccgccgcgcctgtgcgcacgcgcagacgccgcaagctctacgagctgcacgcggccggcgccccgccccccccgccgcccggccacgcccccgcgcccgagtcgccgcggcccggaagcggaagcggaagcggccccggcctcgcccctgcgcgctcgcccggccccgcggccgacggccccatcgacctgagcaagaagccgcggcgcccgctccccggagccccggcaccggcgctggccgactaccacgagtgcacggcctgccgcgtgagcttccacagcctcgaggcctacctggcgcacaagaagtactcgtgccccgctgcgccaccgcccggcgcgctcggcctgcccgccgccgcctgcccctactgccccccgaacggcccggtgcgcggggacctgctggagcatttccgcctggcgcacggcctgctgctcggcgcgcccctggccggcccgggggtcgaggcccggacgccggccgaccgcggcccctcgcccgctcccgcccccgccgcctccccgcagcccgggtcccgtggcccccgggacggcctcggcccggagccccaggagccgccgcccggcccgcccccgtccccggccgccgcgcccgaggccgtgccgcccccgccggcgcccccctcctactcggacaagggcgtccagactcccagcaagggcacgccggcgccgctgcccaacggcaaccaccggtactgccgtctttgcaacatcaagttcagcagcctgtccaccttcatcgcccacaagaagtattactgctcctcgcacgccgccgagcacgtgaagtgagcgcccacactacagccgcagacgctttgcacgccccgctgcgatgcggggagggggccgcccccaggccgcacggactgccgctcctgggaaccccgccacgcacaggcctcggcggagggggccgcagggggcagcgcccgcctggacccttggcacttaataaagaagttcagtttgatgagca

SEQ ID NO: 1179 - DNA, 4507 bp, Homo sapiens
cagcggcagcagccgccgccgagatgtcccggcgaaagcaaagcaaaccccggcagatcaaacggccgcttgaagatgccattgaagatgaggaagaagaatgtccatcagaggaaacagacatcatctccaaaggagactttccattggaggaaagcttttccacagaatttgggcctgaaaatctgagctgcgaagaagtggaatacttttgtaacaaaggtgatgatgaaggaatccaggagacagcagaatcagatggggacacacagtcagagaaaccggggcaacctggagttgagacagacgactgggatggaccaggagagctggaggtgtttcagaaagatggggaacgaaaaattcagagtcgacagcaacttccagtgggaacaacctgggggccgtttcctgggaagatggacttgaataataattctttgaagacaaaggctcaggtcccaatggtgctgactgctggtcccaagtggttgctggatgtgacttggcaaggagtggaagacaacaaaaacaactgcattgtgtacagcaaagggggtcagctttggtgtacaactacgaaggccatctctgagggtgaagagctaattgcctttgtggtggattttgactcaaggctacaagctgccagtcagatgactctcacagaagggatgtaccctgcacgcctgctggactcaattcagctgcttcctcagcaagctgccatggcttctattttgcccacagctattgtcaataaggatatattcccttgcaagtcctgtggcatctggtatcggagtgagcggaatctgcaggcccatttgatgtactactgcagtgggaggcaaagagaagctgctccggtgtcagaggaaaatgaagacagtgcccatcagatttccagcctgtgccccttcccacagtgcaccaagagcttttcaaatgctcgagctctagaaatgcacctgaattcacacagtggagtgaaaatggaagaattcctgccccctggtgctagtctaaaatgcaccgtctgtagctacactgctgattccgtgatcaactttcaccaacacctgttctcccatctcactcaagctgccttccgatgtaatcactgccatttcggcttccagactcagagggagttattgcagcaccaggagctccatgtccctagcggcaaacttcccagagaaagtgacatggaacactctccaagtgcaactgaagacagcttacagccagccacagacttattgaccagaagcgaacttccccagagccaaaaggccatgcagactaaagatgcgagctctgacacagagctggacaagtgtgagaaaaagactcagctctttctcacgaaccagagaccagagatacagcctacaacaaataaacaaagcttttcttacacaaaaataaagtctgagccctctagcccaagacttgcctcatctccagttcagcctaatattgggccttctttccctgtgggccctttcctatctcagttttctttcccccaagatatcaccatggtccctcaagcttcagagatcttagctaagatgtctgaactggtgcatcggcgactgaggcatggcagtagtagctaccctcccgtcatttacagccctttgatgcccaagggggctacttgttttgagtgtaacataacattcaataatttggataattatctagtgcacaaaaagcattattgcagcagccgatggcagcagatggctaagtccccagagttccctagtgtgtcagaaaagatgcctgaagctttgagtcccaacactggccaaacctccataaaccttctcaacccagctgctcattctgctgatcctgagaatccacttcttcaaacatcttgcatcaattcttccactgtcttagatttaattgggccaaatgggaagggccatgacaaggacttttccactcaaactaagaagctctccacctccagtaacaatgatgacaaaattaatggaaaacctgttgatgtgaaaaatcccagtgtccccttagtggatggggaaagtgacccaaataagactacctgtgaagcttgcaacattaccttcagccggcacgaaacatacatggtccacaaacagtattactgtgctacacgccacgaccctccactgaagaggtctgcttccaacaaagtgcctgccatgcagagaaccatgcgcacacgcaagcgcagaaagatgtatgagatgtgcctacctgagcaggaacaaaggcctccactggttcagcagagatttcttgacgtagccaacctcaataatccttgtacctccactcaagaacccacagaagggctaggagagtgctaccacccaagatgtgatatctttccaggaattgtctctaaacacttggaaacttctctgacgatcaacaagtgtgttccagtttccaaatgtgatactactcattccagtgtttcctgcctagagatggacgtgcccatagatctcagcaaaaagtgtttatctcagtctgagcggacgaccacgtctcccaaaaggctgctggactatcacgagtgcactgtgtgcaagatcagtttcaataaggtagaaaactatctggcccacaagcagaatttctgcccggttactgcacatcagcgtaatgacctgggtcaactggacggcaaagtgtttccgaatccagaaagcgaacgaaacagccctgatgtcagctacgaaagaagcataataaaatgtgagaaaaatgggaatttgaagcagccttcccccaatggaaacttattttcatcccacctagcaaccctgcaaggcttgaaggtctttagtgaagctgctcagctcattgctacaaaagaagaaaacagacatttgtttcttccacaatgcctttaccctggagcaataaagaaagcaaaaggagccgaccagctttctccatattatggaatcaagccaagtgattatatttctggttctcttgtcatccataacactgacatcgagcaaagcagaaatgcagaaaatgaatctcctaaaggccaggcttcctcaaatgggtgtgctgcgctgaagaaagattctctgccattgttgcccaaaaatcgaggaatggtaatagtgaatggtggactgaaacaagatgagagacctgctgccaacccacagcaagagaacatttcccagaatcctcagcacgaagacgaccacaaatctccctcgtggatctctgagaacccattagctgccaatgagaatgtctcaccaggaattccctcagcagaggaacagttgtctagtatagcaaaaggtgtgaatggttccagccaggctccaaccagtgggaaatattgccggctatgtgatatccagttcaacaacctttcaaactttataactcacaagaagttttattgctcatcacatgcagcagaacatgtcaaatgaactaactaaacatcagtcacctttggtatcagtgtttagtatgttgttctaaccagtccagaaaaaaaaataagctgtttgaattacatctgggcaatcaggagataattcattatggctgagttgaagacttaaggtgtaatttcattacagtccattagtaaagtgtattattggtgccattttcaaaaaaattaatttattttaccagcagtattcatagctgtggttatgttattttttatttaaaaactttatattaaagtcatttgtaatgttattgtatagttattgtgtagcacatatggtttgcactgtatagtagcttttaaagaaaatagtcacaatacagaaaagcattttagaaatagcttcaaaagcacttgtgtatcttgattttttcttatatgctgttgcagatatatgtatatgctaaaatataacttgcaaagatgttctaaatacacatgctataagttcgccttaagatttcaattcttggataatcaggctctgtttgcactttatattttagcagatacagtctcttagtcactaggctttgcatttgtatgtagctgtatgtttccgtccattttcttaatcctgaacctgtatgttaaatgaagatggcaatttttttcttgtatagtacttgtattttctttcgctgatgcagctctgtctcaatttttaaacctttgctgttaaatgcaatactttataaagaatgaacaaaattactggaagcagtattgtaagtaatgaggtagtattaatcagttttatcttttgaaaggcacagtctaaatcgaaaccctaaactcaatgctgcaagtatgaatttaattcatatataagatctatttaaatataagagtagcaatactgcacctggtgatcacaaagataatgttctacttctgatagaaataatttctcaacaaatgttgttactatgcatgtatatggatggaataaaattccagattgttggagaaaaaaaaaaaaaaaaaaaaaaaaaaaaa

SEQ ID NO: 1180 - DNA, 4746 bp, Homo sapiens
gttctccgctgaggaggagcggggcagaggagggaggcagcgggtgagagttcagagttcagcagcagcagcccgagcccatgattcccatatgccctgtagtttctttcacctatgtgcccagccggctgggggaagatgccaaaatggcgaccggcaactactttggattcacccacagcggggcggcggcggcggcggctgcggcccaatatagccagcagccagcttcgggtgtagcctattctcatccaactacagttgctagctacactgtccatcaggctccagtagctgctcacacagttactgctgcctatgcaccagcagccgccacagttgcagttgccaggcctgctccagtagctgttgcagctgctgcaacagctgctgcttatggaggctaccccactgcacacacagcaactgactatggttatactcagaggcaacaagaagcaccaccaccaccacccccagctactacacaaaactaccaggattcatactcatatgtaaggtccacagctcctgctgtagcttatgatagtaagcaatactaccaacaaccaacagcaactgctgctgctgtagctgccgctgcccaacctcagccttctgttgctgaaacttactatcagacagcccccaaagcaggttacagccaaggtgcaactcagtatactcaagcccagcaaactcgacaagtgacagccataaaaccagccacaccaagtccagctaccactactttctccatctatcctgtatcctccaccgtacagccagtagcagctgcggctactgtggtgccatcctatactcagagtgctacttacagtaccacagcagttacatattctggtacgtcttattcaggttatgaagcagcagtgtattcagctgcatcttcctactatcaacagcagcagcagcaacagaagcaggcagcagcagcagctgctgctgctgctgcaacagctgcctggacagggaccacctttactaaaaaagcaccattccaaaataaacaactgaaaccaaaacagcctcccaaaccaccacagattcactattgtgatgtttgtaagatcagctgtgctggaccacagacttataaagaacatttagaaggacagaaacataaaaaaaaagaagctgcattgaaagcctcacaaaataccagcagcagcaacagttctactcgtgggactcaaaatcagctacgttgtgagctctgcgatgtgtcttgtacaggagcagatgcgtatgctgcccacattcgtggtgctaagcatcagaaagtggttaagttacacacaaaacttggtaaacccattccatcaacagaaccaaatgttgttagccaagctacttcttcaacagctgtatctgcttcaaagccgactgcctctccttcaagcattgcagcaaacaattgtactgtgaatacgtcatcagttgcaacgtcttcaatgaagggtcttacgactacaggaaactcgtctcttaatagcacatctaacactaaagtatcagcagtgcctacaaatatggctgccaagaaaacatctacccccaaaataaattttgttggtggtaataagctgcagtcaacaggaaataaagcagaagacataaaaggaaccgaatgtgttaaaagtactcctgtcacttctgctgtgcagattcctgaagtaaagcaagacacagtgtcagaaccagtcacacctgcatctcttgctgctttacagagtgatgtgcagccagtgggccatgattatgtggaagaggtacgaaatgatgaaggaaaagtaattcggttccattgtaaattatgcgagtgcagctttaatgatcccaatgctaaggagatgcacttaaaagggcgaagacacagacttcaatataaaaaaaaagtaaatccagatttgcaagtagaagtaaagcctagtattcgagcaagaaagattcaagaagagaaaatgaggaagcaaatgcagaaggaggagtactggcgaagacgagaagaagaggagcgttggagaatggaaatgagacgttatgaagaggacatgtactggaggagaatggaggaagaacaacatcattgggatgatcgccgccgaatgccagatggaggttatcctcatggtcctccaggcccattaggccttctgggagtccgaccaggcatgcctcctcagcctcaggggcctgcacccttacgtcgtcctgactcatctgatgaccgttatgtaatgacaaaacatgccaccatttatccaactgaagaggagttacaggcagttcagaaaattgtttctattactgaacgtgctttaaaactcgtttcagacagtttgtctgaacatgagaagaacaagaacaaagagggagatgataagaaagagggaggtaaagacagagctttgaaaggagttttgcgagtgggagtattggcaaaaggattacttctccgaggagatagaaatgtcaaccttgttttgctgtgctcagagaaaccttcaaagacattattaagccgtattgcagaaaacctacccaaacagcttgctgttataagccctgagaagtatgacataaaatgtgctgtatctgaagcggcaataattttgaattcatgtgtggaacccaaaatgcaagtcactatcacactgacatctccaattattcgagaagagaacatgagggaaggagatgtaacctcgggtatggtgaaagacccaccggacgtcttggacaggcaaaaatgccttgacgctctggctgctctacgccacgctaagtggttccaggctagagctaatggtctgcagtcctgtgtgattatcatacgcattcttcgagacctctgtcagcgagttccaacttggtctgattttccaagctgggctatggagttactagtagagaaagcaatcagcagtgcttctagccctcagagccctggggatgcactgagaagagtttttgaatgcatttcttcagggattattcttaaaggtagtcctggacttctggatccttgtgaaaaggatccctttgataccttggcaacaatgactgaccagcagcgtgaagacatcacatccagtgcacagtttgcattgagactccttgcattccgccagatacacaaagttctaggcatggatccattaccgcaaatgagccaacgttttaacatccacaacaacaggaaacgaagaagagatagtgatggagttgatggatttgaagctgaggggaaaaaagacaaaaaagattatgataacttttaaaaagtgtctgtaaatcttcagtgttaaaaaaacagatgcccatttgttggctgtttttcattcataataatgtctacattgaaaaatttatcaagaatttaaaggatttcatggaagaaccaagtttttctatgatattaaaaaatgtacagtgttaggtattatttgaatggaaagacacccaaaaaaaaaaatgtgctccgactagggggaaaacagtagttccgattttttcccattatttttattttattttctggttgccctagcttccccccctatttttgtgtcttttattaactagtgcattgtcttattaaatcttcactgtatttaatgcaggatgtgtgcttcagttgctctgtgtattttgatattttaatttagaggttttgtttgctttttgacactagttgtaagttactttgttatagatggtatcctttaccccttcttaatattttacagcagtacgtttttttgtaacgtgagactgcagagtttgtttttctatatgtgaaggattacaacacaaaaagttatcctgccattcgagtgctcagaactgaatgtttctgcagatcttgtggcatttgtctctagtgtgatatataaaggtgtaattaagacagagttctgttaatctaatcaagtttgctgttagttgtgcattagcagtataaaagctaatatatactatatggtcttgcaacagttttaaagcctctgcataattgataataaaaatgcatgacattcttgtttttaatagacttttaaaatcataattttaggtttaacacgtagatctttgtacagttgactttttgacatagcaaggccaaaaataactttctgaatatttttttcttgtgtataagtggaaagggcatttttcacatataagtgggctaaccaatattttcaaaagaacttcatcattgtacaactaacaacagtaactagcccttaattatggtgacagttccttattggtgtgtgtgagattactctagcaactattacagtataacacagatgatcttctccacacaccccatcacccagataatttacagttctgttaacagtgaggttgataaagtattactgataaaaaattatctaaggaaaaaaacagaaaattatttggtgtggccatcttacctgcttatgtctcctacacaaagctaaatattctagcagtgatgtaatgaaaaattacatcttactgttgatatatgtatgctctggtacacagatgtcattttgttgtcacagcactacagtgaaatacacaaaaaatgaaattcatataatgacttaaatgtattatatgttagaattgacaacataaactacttttgctttgaaatgatgtatgcttcagtaaaatcatattcaaatttaaaaaaaaaaaaaaaaaaaaaaaaaaaaaaaa

SEQ ID NO: 1181 - DNA, 5811 bp, Homo sapiens
gtccgtccggttcttgctatattgccccaggctggtctcgaactcctgggctcaagccgttctcccgcctcccactgcccgcctgtcactgccgtctgttccctgagctgtgctttacgctgggaaagacatagaagaactattaagaagatagaattgttttgctgcgcagtacagcaacagtggatgttcaagattaagattagagtcaagttgtgtgattaagacaggagctgtgactgatgagaattaaaggccatggatgaagatgggcttgaattacaacaagagccaaactcattttttgatgcaacaggagctgatggtacacacatggatggtgatcaaattgttgtggaagtacaagaaactgtttttgtttcagatgttgtggattcagacataactgtgcataactttgttcctgatgacccagattcagttgtaatccaagatgttattgaggacgttgttatagaagatgttcagtgcccagatatcatggaagaagcagatgtgtctgaaacggtcatcattcctgagcaagtgctggactcagatgtaactgaagaagtttctttagcacattgcacagtcccagatgatgttttagcttctgacattacttcagcctcaatgtctatgccagaacacgtcttgacgggtgattctatacatgtgtctgacgttggacatgttggacatgttggacatgttgaacatgtggttcatgatagtgtagtggaagcagaaattgtcactgatcctctgactaccgacgtagtttcagaagaagtattggtagcagactgtgcctctgaagcagtcatagatgccaatgggatccctgtggaccagcaggatgatgacaaaggcaactgtgaggactaccttatgatttccttggatgatgctggcaaaatagaacacgatggttcttctggaatgaccatggacacagagtcggaaattgatccttgtaaagtggatggcacttgccctgaggtcatcaaggtgtacatttttaaagctgaccctggagaagatgacttaggtggaactgtagacattgtggagagtgagcctgagaatgatcatggagttgaactgcttgatcagaacagcagtattcgtgttcccagggaaaagatggtttatatgactgtcaatgactctcagccagaagatgaagatttaaatgttgctgaaatcgctgacgaagtttatatggaagtgatcgtaggagaggaggatgctgcagcagcagcggcagccgccgccgtgcacgagcagcaaatggatgacaatgaaatcaaaaccttcatgccgattgcatgggcagcagcttatggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttatttccattcacacgaaagactatcctcaccggtgtgagtactgcaagaaaggcttccgaagaccttcagaaaagaaccagcacataatgcgacatcataaagaagttggcctgccctaacaatacttctacagaacgtttgtagagatattggccttgaagcagaaaattcattttaaagccaatcagtctcattcacatacaatactgtatattgatttatgctgtgtacaaatagaattattacttctagttgacttttttttaaatatacattttgctcagtagtgtgttctgaattctattcagtttgtttaataaatagggaaaactggcaacatgctagttacttttaataaagtaatccctgattctataccgaagttttatatcttagaattttatatttatttaaatatttaccttgcttaccttgatggtactcttctaagaccattaacttaaggtaactttatattggtaactctgaaagtattcatgttgactcatttttttccccatacatttctcacaataaaattgtcagagacatctactaatataaatgggagattttacagtcaggtctaattatcataacatggaagtcatttacttgtcttgcttaatattttcagaccacttgacagtgaaagtttccatttgagctgttgcgtccctggctttgctgagtaaagagcagtggctgggttcgtgtttacttttcaaatatacttcttttggctttctttggattatttacatcttttgtcagcgtagcaaacttttagaaaaccttattgaaaaactgtgcttgctcatgttgtattttgattattctgtctgtgcggcttcatcttggaatggttgtgtgctacaaatgacacttactgaggactgcattttggaatctcctagaggtaactcatggcttataggatcttttgcaactttatgtatgtaaatgtaccctgaattatatatatacacatatatatcatgtacctgtgtgtattgcttattttacatatttatacacacaaccccaagtagtagttgtttaaaatctataatgaaaagtattaaatttacaataacatgaaagatccagggatgcatgagagagcattttgtaagtcatgctcttcagagagactactcaggtgaagaattagaaggaaaataaggacactagtatttttaaagagtaaagatattttcttttaaatatctttggtaattgaaacatagaggttaagatgtttctaggtagaatgttttcatacaatttcacctccatgtctttatgtttttctgaaaagcaaatgagtatccagacatgactcccacagttctctttgagaagcctgagagggaactctgtcttacctagtgagggggatggaaaagaagtgatggctctgtggaccagagaacgggtgctaattatgacttcacactcggcaagttcaggctgatctgttatttctcagttacagttagcaaactttaaaaacttaacactcaagttggctttgattaaaaggtaaagatgtgttttaagtggataaggaaagtctgaggccttatttggaacatcactaagtcttccacaggttttttgtttgtttgtttttttttgttgtttttttttcttaagacggagtcttgctctgttgcccaggctggactgcagtggtgtgatcactgcaacctctgcagctcactgcaacctctgcttcctgggttcaagcaattatctgcctcagcctctcgagtagctgggattacaggcgcccaccaccacgcccggctaattttttgtatttttaatagagatggggtttcaccatcttggccaggctggtcttgaaccctgacctcgtgatccacctgcctcggccttccatagtgctgggtttacaggcgtgagccaccgtgcccagacaccacataggtctgaatcagtgtcatacattcataaaacaaactcggttaattagaacttggttatgttaagacgaatctgggagaacagaaaacagtttttggggtcccttcagttggctattggtccgtatgcatctagcacattgtaggagatttagaaattgtcttcccacccgatagctgccttgtcacctcattatggtgctccatcccctgtgtgcttaggtttttacctttcatctttctctttgccattgatgtttgtattcaagagttatatttttagggttagaaatcaaaatatttggtgtttggcaaacctctgaagtgctagactgatttagtctagttttaaaccaagtgctttaggcaggtgtgaactccagcccaaatgccagtcaaagtcaaggcatgggttttcctagcctatcttataggaaattcctgtaccttcttggcccccataatgtgttttttttttttttttttttttaaactaacttacaattttgtgatccgtgattcattgccctgcgattcttgaaagctctgtctgtttttttgtgagaacctttaaaatctcccttaatttttattttcccagaaataatgtaaaaacacttaaatgaaagtggaaatgtattaattttaaatcctataaaattaatacagaaaatataaatgattgggtcatttaactatatttttttaaataaactgaaagataaagaacacaacacttcacacattttatatttctcttacatactccggaatcatacacagttctttttaaagcacaacattaaaacctttaaaaggtatttaagggtttggtcaagtgaatatgataaaacatacttgtctgtataaagagaaaatgaaattgtagtcactgttatgtactgacattagttacaacctagttttaattcttaaaacaattttgattagcaaagctaaaaaaaaatggatgtttcagttaaatgttttaaagaggtacagatttttacaaggacataatataagttattgttctgtagaaatatcctattaaatattgtatgtccctccctctgtacactttgtaaagaaagtaaaatacataaaaagaaaatcatatagggatgtgtgacattattgtaattgtgtacttgagaataacgtgcaaaaataaaaatcagaatattttcctgttattgaatgtttagtctatttgataccagtactaagttaatgctttttctcaaggaaaaaaaatgtacagtttttgtaaacctaataaacatcaaaagcagtggatta

SEQ ID NO: 1182 - DNA, 5259 bp, Homo sapiens
gcctagtgcgcgcgcagtaacctgtttgtggcctggtcggcgtcccgtagggcgccctcccgcgctaggccggccggcgtggcgctcggcgccgaacaggccccgaggaggccgcagttaggcctagtgattatccagttgccctgagcggctgcggaggtgcgctccataagcgggcagggtgggaaaagttcgcccgtttgtccggaaggcagttgatggacctggggtcgacaccactgcggacgcagggcacggcacgggggcgagaaggcgaaggctgcaggcgtgaggagctgtgactaatgagaattaaaggccatggatgaagatgaatttgaattgcagccacaagagccaaactcattttttgatggaataggagctgatgctacacacatggatggtgatcagattgttgtggaaatacaagaagcagtttttgtttctaatattgtggattctgacataactgtgcataactttgttcctgatgacccagactcagttgtaatccaagatgttgttgaagatgttgtcatagaggaggatgttcagtgctcagatatcttagaagaggcagatgtatctgaaaatgtcatcattcctgagcaagtgctggactcagatgtaactgaagaagtttctttaccacactgcacagtcccagatgatgttttagcttctgacattacttcaacctcaatgtctatgccagaacatgttttaacgagtgaatccatgcatgtgtgtgacattggacatgttgaacatatggtgcatgatagtgtagtggaagcagaaatcattactgatcctctgacgagtgacatagtttcagaagaagtattggtagcagactgtgcccctgaagcagtcatagatgccagcgggatctcagtggaccagcaagataatgacaaagccagctgtgaggactacctaatgatttcgttggatgatgctggcaaaatagaacatgatggttccactggagtgaccatcgatgcagaatcagaaatggatccttgtaaagtggatagcacttgtcctgaagtcatcaaggtgtacatttttaaagctgaccctggagaagatgacttaggtggaactgtagacattgtggagagtgaacctgaaaatgatcatggagttgaactacttgatcagaacagcagtattcgtgttcccagggaaaagatggtttatatgactgtcaatgactctcaacaagaagatgaagatttaaatgttgctgaaattgctgatgaagtttatatggaagtgatcgtaggagaggaggatgctgctgttgcagcagcagcagctgctgtgcatgagcagcaaattgatgaggatgaaatgaaaaccttcgtaccaattgcatgggcagcagcttatggtaataattctgatggaattgaaaaccggaatggcactgcaagtgccctcttgcacatagatgagtctgctggccttggcagactggctaaacagaaaccaaagaaaaagagaagacctgattccaggcagtaccaaacagcaataattattggccctgatggtcatcctttgactgtctatccttgcatgatttgtgggaagaagtttaagtcgaggggttttttgaaaagacacatgaaaaaccatcctgaacaccttgccaagaagaagtaccactgtactgactgtgattacactaccaataagaagataagtttacataaccacctggagagccacaagctgaccagcaaggcagagaaggccattgaatgtgatgagtgtgggaagcatttttctcatgcaggggctttgtttactcacaaaatggtgcataaggaaaaaggggccaacaaaatgcacaagtgtaaattctgtgaatatgagacagctgaacaggggttattgaatcgccacctcttggcagtccacagcaagaactttcctcatatttgtgtggagtgtggtaaaggtttccgacacccgtcggaactgagaaagcacatgcgaatccataccggcgagaagccataccaatgccagtactgtgaatataggtctgcagactcttctaacttgaaaacacatataaaaacaaagcatagtaaagagatgccattcaagtgtgacatttgtcttctgactttctcagataccaaagaagtgcagcaacatactcttgtccaccaagaaagcaaaacacatcagtgtttgcattgcgaccacaagagttcaaactcaagtgatttgaaacgacatgtaatttcagttcatacgaaagactatcctcataagtgtgagatgtgcgagaaaggctttcacaggccttcagaacttaagaaacatgtggctgtccacaaaggtaaaaaaatgcaccaatgtagacattgtgactttaagattgcagacccatttgttctaagtcgccatattctctcagttcacacaaaggatcttccatttaggtgtaagagatgtagaaagggatttaggcaacaaaatgagcttaaaaagcatatgaagacacacagtggcaggaaagtatatcagtgtgagtactgtgagtatagcactacagatgcctcaggctttaaacggcacgttatttccattcatacaaaagactatcctcatcggtgtgagtactgcaagaaaggcttccgaagaccttcagaaaagaaccagcacataatgagacaccataaagaagttggtctgccctaacagtgtgtctacaagcttgtaaagatgttggccttgaagcagaaaattcattttttaaagccagtcttgttcacatccattactatacattgaattatgctgtgtaaaaatagaattattgcttctagtccacttttctttacattttattcaatacgctgtcctgaatcctattcagtttctttaatagatgaggaaaaatagcaacaagcaagttgcttataataaaataatttgtgattctatactgaattttcagtcataaaagctttactatttatttacatatttattcatgttcatggtactcttctaagacaaaatcagattgataactatgaaagtaacatttttgacccatttcctcctacacaagtgtttcacattggagacatctgctaatataaatgggaggttttactgtcaagtccaattagcaaaacgtggtaataatttttttgtcagtattttcagattacatgataaaattttacatttgagcttctagcattgattaatataggatattgaccacgtttatgtttaaatttcattttgttcagcagacaaaatgtacttcccttaactttcattaatagtgtttacatcttttgtcagcacagcaaacttttagaaagtaatagttttacttatttttatcttctgttttctctttgtactgctttgtcttgcattgtgttccaacacatgagacttactgctcactgaattttggagtcttttagaggtaaattgtggactcaggattttttgaaacttggtgtgtaactctaaatcttgtatatgcatctttgttgcttattacatatttacacacacaaccacaaattttaaacttatgatgaaaatttacaataacctgaaagatccagagatgtatgagagcattttgtaacttgttattcagttactaaatttgaggtgaataattaaaaagaaaaggacattaggagagtgaaaatcttctcttcaaataatctttgatagataaaaatggaaggtaagatgtttctagatagaatgttttcatacaatttcagcttcatatcataaatttttctggaaagctatttcagacatagatttcatagtatttttctgagaatcctgtgaaggaacgctgtctctttgcaaagtaaggaggactaagggaaaatgatggtaccatgtaacagaatgagagctaattccaaattagcaacttcatcctgctttctattttacattgagtaaagttttaaaaagacaacagtcaagttgattttgattagaagataaaagtacataatgaaaatccatggccttatttggaatatatatcactttccaaattttattatttatttgagagttaataagttaatgttattaagcagttaataatttatatgtatggatataatataaaatgaattcatataattaaaaagaatttggttaataagaatttggagaatggaaaatacatttttaggttccttaatttggctgttggtacctgtgtatttggaatattttaggggattcgaattttttttaacccacattacagctaccttctagctttagtatggtagtgcttcattcaacttttgctgtcaggtttttattttcacctttttctgtgccaccaattcaaaagttataggattaggaaatataaatttatatttggtgattggcagcctctgaaatgttagattaatttgatctagttctaaagtgctttagtcatatatgaatttaaacctagtaccatccaaaaccatgtaatggattttaagaatctgttaggccttcttagcctttatacatgtccctacctgatttttactgtccttcatgatcctgttcttgaaaacttcagtttgtatttgagaatcctttaaatctccttccaatttgttttctccctgaagtaatataaaaggaagtatttaagtgaaagtttaagagttttaaaacattctttaaaattaatacagatagttagctatttatcttttaaaaataaactaaggtaaaaaacgtgacactttacatatttcatatttttcatatagtctggaggtatacacagttgttttgtttttaaccacggtattgaaacctttaaaaggtaattaagcatttggtcaagtaaatatagaacatttgtataaagaaagaaatgaaattgtgcttaatgttatatactgttattatttgcaggctggttttaattcttaatttgattagcaaagctaaaaaagtggatgttgaagttgaaagttttaaagaggtacaaaatcttacaaggacataaattattatttggttgaaaaatagcctattagatattgtatgtcccttcctctgtacaaattgtaaaatacttaaaataactatgaagaattcatataggaagtgtgatactattgtaaatgtgtatttgagaatatgcaaaaataaaaataatattttactgttaataaatgtttacttgtatatgaaaaaaaaaaaaaaaaaaaa

SEQ ID NO: 1183 - DNA, 4937 bp, Homo sapiens
acaggtcagagttgactccctgaaaagtgcagccggtttgaaatgcaagatggcggcggcgtggcgctgagaggcgcggcggcccctgcaggagaagacagactgctgctttggacctgttggtaatgatggcctgagctaaacatctaactagaagggatacccttccatttcaaagaacagaatgctaaggaagctgtggcaagtgattggagttgtgcttcaaaaatttcagaaattcagcagtattttatctgccaacaataagctctttacttgattgcaccatgagaaagctgctaatgagacttgttgagcacaaaaatggacttgaagaaccaaaagccattgttttcaaatgaagaacactgaacagttttaagcctcgatgctttttaatcaccactgagcttttcctcataacatcagaatggcaagcaggcgaaaatcaacaacaccttgcatggtccttgccagtgaacaagatccagaccttgagttgatatcagatttggatgaaggtcctcctgtgcttacacctgtagaaaacaccagagcagagagtatctcaagtgatgaagaggttcatgaatctgtggattcagacaatcagcaaaataaaaaagttgaaggtggatatgaatgtaaatattgtacttttcaaactccagatctaaatatgtttacttttcatgtggattcggaacatcccaatgtagtgctaaattcatcctatgtttgtgtcgaatgcaattttcttaccaaaaggtatgatgcactttctgagcataatctgaaatatcacccaggagaagagaattttaagttgactatggtgaaacgtaataaccagacaatctttgaacaaacaataaatgatctgacttttgatggtagttttgttaaagaggagaatgcagagcaagcagaatctacagaagtttcttcttcgggaatatctatcagtaaaactcctatcatgaaaatgatgaaaaataaagtggaaaataaacggattgcagttcatcataactcagttgaggacgttcctgaagagaaagagaatgaaatcaaaccagaccgtgaagaaattgtagaaaatccaagttcttcagcttctgaatctaatacaagtacttccattgtaaacagaatacatccaagtactgccagcacggtagtgacaccagcagcagttcttcctggattggcacaggtgataactgctgtatctgctcagcagaattctaatttgattcccaaagtcttaatccctgttaatagcattcccacctacaatgctgcattggataacaatccccttttacttaacacctacaacaagttcccttacccaacaatgtcagaaattacagttctttctgctcaagcaaaatatacagaggaacagatcaagatatggttttcagcccaacgtttaaaacatggtgttagttggactcccgaggaagtagaggaggcaagaaggaaacaattcaatggaacagtgcatactgtacctcagaccataactgttattcctacacacatttccacagggagtaatggtttaccatctattttacagacatgccaaatagttggtcagcctggtctggtccttactcaagtggctggaacaaacaccttgccagttacagcacctatagccttgacagtggcaggcgttccaagtcaaaataatatacagaaaagtcaggtacctgctgctcagcctactgcagaaacaaagccagcaacagcagcagttccaacttctcaaagtgtcaaacatgaaactgcattggtaaaccctgattcatttggcattcgggcaaaaaagacaaaagagcaactggcagaattaaaagttagctaccttaaaaatcagtttccccatgattcagaaattatcagacttatgaaaataacaggcctgacgaaaggagagattaaaaaatggtttagtgacacaaggtacaaccagagaaattcaaagagtaatcagtgcttacatctcaacaatgattcctctaccaccattattatagactccagtgatgaaaccacggaatccccaactgttggtactgcacagcctaagcaatcctggaatccttttcctgactttactccccaaaagtttaaagagaaaactgcagagcagcttcgtgtccttcaggcaagttttctcaacagctctgtacttacagatgaagaattaaataggttaagggcacaaaccaaacttaccagaagagaaatcgatgcttggtttacagagaagaagaaatcaaaagctttaaaggaagagaaaatggaaatagatgaaagtaatgcaggtagttccaaagaagaagctggagaaacttctcctgcagatgaatctggtgcacctaagtcagggagtacaggcaagatatgtaaaaaaacacctgagcagctgcacatgcttaagagtgcatttgtccggacacagtggccatcaccagaagagtatgacaagttggccaaagaaagcgggcttgctagaacagacatagttagttggtttggggacacccgttatgcttggaagaatggaaacttgaaatggtactactactatcagagcgccaattcaagtagtatgaatggtctgtcttcccttaggaaaagagggagagggagacccaaaggacggggaagaggaagaccgcgtgggcggcctagaggaagcaaaagaattaacaactgggacaggggaccatcactcataaaatttaaaactggaactgcaatacttaaggattattacctgaagcacaagtttcttaatgagcaagaccttgatgaacttgttaacaaatcacatatgggctatgagcaggtcagagagtggtttgcagaaagacagagaagatcagaattaggtatagaattatttgaggaaaatgaggaggaagatgaagttattgatgaccaggaagaggatgaagaagaaacagatgatagtgacacttgggaacctccacgacatgtgaaacggaagctgtctaaatcagatgactgaaatctgcctaaaacgttgaaggagaatcaattcttcaactcaagatgtctgatttactgtgaatttgcccaatctttgatgacattgaaaacgttttggggcatacacactcaaaaagcaggatccaatacccaaaagaaatggaacttaatgttgtgccaaagttaaactactgcagttggtggaagttctgcaatgtaaatagaacactaattaaaaaacaacttgtaaaaatgcaatttaaattttaatacagtacatttttcttctaatatgatggagacattctgaatcttagactttctgagggggtttaatgaccactagagcttgtcctcatattcagtccagtttaatactgtatgtctagtaagatgggctatatattgcctctattctttgagatgtgattaagcttagaactttgaccaaaaattttacagtaaaaattgttagaaatgggtaaaaaaaaaaaaaaaaaaaaaaccctgatttattactatgtcttatttatcagaccctgcactaagattaaaagttgtgcatgggcttatacaatttcaaatgtaaaaacagcctatttatatatgttgaaacaataagattttatggtttcactggcccttaataattggatccttcattaaacacatccatgaataccactgtttctactgttacttgttccattagaagctgatttgctttttattaaactgcaggaaattaattctgaagaaggaaaagaaactgacatggtaatttggatagggtgaagctttgaaataaatactgcaccaaaaatgtgaaaaagaatcacgtagtaaatgtatacttagtgttttcttacaatcgtggaaatcagaaatgtttatacaggtgtcagatcagaatttttaagagttatctttcagtgaaattttataacagtttcagtgaatagagaaaaaattctgaactgatcataatgagttaaaagttagcttttcacttatgaatcatgggagtgttaactgttaactcttgccgtatcaggagactgaaagttcatactaatttacaaactttgtaaagactggtgctgttcattcatattgggaagaaccctttcttttgtgaccataggaccatttttcaaaatgcgctttcttcgtagaagaaatgttcagtttaattagctttggattttaacatgtttttctgaatgaccagatgtaggcttagccagtttattttctctaatttaatggataataaatattaagctcttggttaaatgtttttcagccattgaaaatgttatgaaaaagccttgaatatgcatgctgctttcatttttataaactttttattttttaactatagctttattagtaattccaaaatgctgcaatgtagctgatttcctcactcagacagctggctttgtgggtggcttttttcatactactgttaacttttttaaaaaagaagcaatgtaaagaccgtaatgcactaagctttttttttttcttttacacgtttaaaaacttcttaaagcactctgtaatataatgattaaattgctcccttttataaacattgctaatgtggtctgagttttgtttgacaataattttaatgttctcaaaatttgaaatgtcaagtattagaaatgaagcctttgaatatagttgtttcccttgcaatatgttaactctgtgtagctgtatataactattaatttccctcatctcttttataggcctgataaaactcttctctgacgtttgctagcttttaaatatatttatttgacagagcaaaagaaccctcttctggttgattgtgaccttgaatacaaaataaaagtagtgattagtagtttaaaaaaaaaaaaaaaaaa

SEQ ID NO: 1184 - DNA, 4373 bp, Homo sapiens
ttttggcgtagattccccactgatcgaggcattttttttccctttttttttcctttttttttttcttttaaaaattttggccatcgttctccgtacgggggctttttctgtctgtctgtctggctggcaggctggctttccccctctttcccacggagcccgagccgggcgcccggtggggagtggggagtgggtggggggagccagcagagttccattttggaacgcccgtgccgcgtctccgcgttcccagcccgggtccccgcgttcacagccccagcgcaggtctggatgtaccgactgcttttggaataaaaagattcccaggatgtgagcaacacgggaccgatatgatgcttcctggtgtgtttagtggttggtgccattccaattttctgtgctgaaatcattctgaaaactcaaacagtagacttcagcacacaaggaaagccaaagccatttgagggggaataaagccaaaagcctttcaccttattcgttccaagaatctcaccgccccctccttatccccctccaaaaataagccattgcacacagacaggcagcatggctagcaaacgaaaatctacaactccatgcatggttcggacatcacaagtagtagaacaagatgtgcccgaggaagtagacagggccaaagagaaaggaatcggcacaccacagcctgacgtggccaaggacagttgggcagcagaacttgaaaactcttccaaagaaaacgaagtgatagaggtgaaatctatgggggaaagccagtccaaaaaactccaaggtggttatgagtgcaaatactgcccctactccacgcaaaacctgaacgagttcacggagcatgtcgacatgcagcatcccaacgtgattctcaaccccctctacgtgtgtgcagaatgtaacttcacaaccaaaaagtacgactccctatccgaccacaactccaagttccatcccggggaggccaacttcaagctgaagttaattaaacgcaataatcaaactgtcttggaacagtccatcgaaaccaccaaccatgtcgtgtccatcaccaccagtggccctggaactggtgacagtgattctgggatctcggtgagtaaaacccccatcatgaagcctggaaaaccaaaagcggatgccaagaaggtgcccaagaagcccgaggagatcacccccgagaaccacgtggaagggaccgcccgcctggtgacagacacagctgagatcctctcgagactcggcggggtggagctcctccaagacacattaggacacgtcatgccttctgtacagctgccaccaaatatcaaccttgtgcccaaggtccctgtcccactaaatactaccaaatacaactctgccctggatacaaatgccacgatgatcaactctttcaacaagtttccttacccgacccaggctgagttgtcctggctgacagctgcctccaaacacccagaggagcacatcagaatctggtttgccacccagcgcttaaagcatggcatcagctggtccccagaagaggtggaggaggcccggaagaagatgttcaacggcaccatccagtcagtacccccgaccatcactgtgctgcccgcccagttggcccccacaaaggtgacgcagcccatcctccagacggctctaccgtgccagatcctcggccagactagcctggtgctgactcaggtgaccagcgggtcaacaaccgtctcttgctcccccatcacacttgccgtggcaggagtcaccaaccatggccagaagagacccttggtgactccccaagctgcccccgaacccaagcgtccacacatcgctcaggtgccagagcccccacccaaggtggccaaccccccgctcacaccagccagtgaccgcaagaagacaaaggagcagatagcacatctcaaggccagctttctccagagccagttccctgacgatgccgaggtttaccggctcatcgaggtgactggccttgccaggagcgagatcaagaagtggttcagtgaccaccgatatcggtgtcaaaggggcatcgtccacatcaccagcgaatcccttgccaaagaccagttggccatcgcggcctcccgacacggtcgcacgtatcatgcgtacccagactttgccccccagaagttcaaagagaaaacacagggtcaggttaaaatcttggaagacagctttttgaaaagttcttttcctacccaagcagaactggatcggctaagggtggagaccaagctgagcaggagagagatcgactcctggttctcggagaggcggaagcttcgagacagcatggaacaagctgtcttggattccatggggtctggcaaaaaaggccaagatgtgggagcccccaatggtgctctgtctcgactcgaccagctctccggtgcccagttaacaagttctctgcccagcccttcgccagcaattgcaaaaagtcaagaacaggttcatctcctgaggagcacgtttgcaagaacccagtggcctactccccaggagtacgaccagttagcggccaagactggcctggtccgaactgagattgtgcgttggttcaaggagaacagatgcttgctgaaaacgggaaccgtgaagtggatggagcagtaccagcaccagcccatggcagatgatcacggctacgatgccgtagcaaggaaagcaacaaaacccatggccgagagcccaaagaacgggggtgatgtggttccacaatattacaaggaccccaaaaagctctgcgaagaggacttggagaagttggtgaccagggtaaaagtaggcagcgagccagcaaaagactgtttgccagcaaagccctcagaggccacctcagaccggtcagagggcagcagccgggacggccagggtagcgacgagaacgaggagtcgagcgttgtggattacgtggaggtgacggtcggggaggaggatgcgatctcagatagatcagatagctggagtcaggctgcggcagaaggtgtgtcggaactggctgaatcagactccgactgcgtccctgcagaggctggccaggcctagacagggaagtctgttagaactgctgtgctgatcaacgggacgctccgtctttgaagaaagaagagatggtctctccccagccatgggccacccttgccagtgactccaagtggaactacttagctcgcgtgtgcctggagggtgcgggaagtccagcgactctcagacgcacctcccagaggaccggtgggaattgttcatagtgccaaagtcctactactgcgttttcaatgggtccttgtacatagtttgctcctctgccctagccctcacctcttgctatactggaaccgatttgtacaatgtgggaattttgttacctttttaatcaagggcaacttccttttccagcactaccattgtaaggtttttttcaggagggagggctaaccaccttgcttttctcttttctctttttcttttttttatttttgttttattaatttggggaaaggggtgttagcattagtgccatgatatctactggattttaagtagggagactttatttttaaaggtaggttgaaatttgggagatttctcggcaggaagggctgaaatccaggcccctgtctcaacttggagagaggtgacagacggcagatcttccaaatcaaattcctttccagttcttcccctggctgcctttttgggggtccctgccttagccccacacaaggctttctgaactgccaagaggggatctggcttctcaactgctcggcctcttgggccaggctgtgcccagccagccctgggagaactgggtagcaggtggctgacttctttaagcacctttctaaataccagcagaagaggctcccgcctctgttagcatgatcagtactattgtgacattaaaacaacaacaataagatcttcctatctggagggtacagaggtgaatggctttggttttcatttctcttcttcactgccttttctcggtgtggtatttgacaagattttagctcaaagcctcaccatgaattgattttttttgtttgtgtgtgtgtttgttttgggacaattttagatacctgagtgcactttttcagttagtcctaacttttaaaagaaggaaaaccaagagacatatctggtgtacgtgttgcagtatgaactctggttgcaatccctccccgtcccacactgccccccatttgagtacaccgcacaagtcaaacgctaggaagtttgaataaaaccaatttttctaacttgttgctcatttgttgtaactcaataaagcaaagactaaacatttttataacctttaaaaaaaaaaaaaa

SEQ ID NO: 1185 - DNA, 5231 bp, Homo sapiens
ctatcagtctcgcgctcaccgcccggctgaggaggtgaaagtttctccccaggaagataaaccgcaaaagacaatattgtgcatgatttgcgccttttctttggctttttctttctttcttcacccccccacccacttttttttttttttttttcaaaaagcagagagggaaaaacggagagtgaaggagcgaggaggcgagcgtgagagaaaggagagagagagaaaagaaagggcgaggggctagtggagaagtaaggaggggcgcgctgcgcgaggcggagagagggcgaagcagtcgcggcactggcgctcacattcctctatgctacaaatccaggaggaagtttttttttagggggctgagatgctccatgcctttccccgggcagccttgacgcgcggccctctcggcagagactgagcggcgagaaagtgcgagccgggccggcagaatctgcctggcgggcgctggagcctgcgttactcgcggcccgcagccgtccggctactttgcgtttggcccggccagcgcccgggcgcgccgcgccattgcctgcaggctaggacttcgcgaggtgggtcgactccccctccctcctcctcttcttcctcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacggccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctcttccccgggcttcacgagcaggctgccggccacgcgtcgcctaacgtggtcaacgggcagatgaggctcggcttctcgggggacatgtacccgcgaccggagcagtacggccaggtgaccagcccgcgttcggagcactatgctgcgccgcagctgcacggctacgggcccatgaacgtgaacatggccgcgcatcacggcgccggcgccttcttccgctacatgcgccaacccatcaagcaagagctcatctgcaagtggatcgagcccgagcagctggccaaccccaaaaagtcgtgcaacaaaactttcagcaccatgcacgagctagttacgcacgtcaccgtggagcacgtaggtggcccggagcagagtaatcacatctgcttctgggaggagtgtccgcgcgagggcaagcccttcaaagccaaatacaaactggttaaccacatccgcgtgcacacgggcgagaagccctttccctgccccttccctggctgtggcaaggtcttcgcgcgctccgagaatttaaagatccacaaaaggacgcacacaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttcgctgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagactgatcacacacgtatacacaacattactgaaagaaccctgcgaatcaaaacaacccccacacagaccccgcaatccttttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctccgtgattgtggtaggaatttcttcttcacccaccagcaacctgctgcctcttctgccagtcttaaagggtctccagaaaagctctccagtctcccttgccttccctttctgtcactgcaggtcgtataaacgtgataaatgaatgctaccctgctggctctccgagagagtgtaattagtatttatatcaaaatttatgaaacaaattttcggccgcagtataatttaaatgacctttgcagatgtagaataacaaccataaaaataacaggaatagattgcacaggcgacatcaatattaatgtagacgaattgtcagaagctcaggggctcgctctgcaacattgcaaatgaacttgcagccgagggttccgctgccccctagattaaattccccgggctgaaactgagttgcagatttacaatatcatattttaaattgctgtcttcaattaaaccatttatgaccataactaattttcaggatgtcgatgcatgcttttccaggccttccttctttgtacaaaagtaaatgtccataaagcgtttcacttatattcttcaaacatgatgctaatttaaattaattacttcctatgatatgttattattcctatgattttgccactgttattagttctctcaaaaatacatctagggaagaggattattttaagtaatttgattatctttctatctcttttatttatttctcatttacttaagaaattcgttccattggttggcattgatacagtaaatttgtaaatgaggagacaatataaaaaatctaaattacttgtgcttaatgactgtagcagaatgccttttctctaaatcagattgtctttcttgcagtttagtttgatagatttgcaagctatgctgcttccatgaagttagctgcgctggtaggaacgcaggcttctttgtctctggttgtagcttgcatgatcgccccattaggcagacaacgtagccggagatcacaaatcaggcccttggctgtagttgctagtgtgtggaggtgcagagcaggtggcagaaactgacctcactgggcaagggtggccatggacctgattctttaatgcactctatgtgttcaggaagccacaggccatatttgactctgagaaagaaaacaagaggaaaaaccccacaaagtataacaaccccttaagatacatctattttaaagtgaaattaatttttcagtttataccattggccaattacaagataaaaatgttcaatttctttaagaatcctttgttgacttgtcttttcatctcttgctatttatatttgtcactgtttcaacaaagtcttatttgctgaggaaggactttgctgcacttactgtaccacatcaaacactggggagggtggtgtttaactttttaaaaaatgttattctgattataacaataatattggcttttttcatgaaaagagcgccaccttgcaaggtttagtgagatttatggaagttgaatacctaagcaggaattgctgctagctccaaaaatttgcgaagcaaaagctagccccaattggtttggaagtttgaaactgattaacagatttgcatttgaagtgactccagacattaggtccagacattagttaaaaatagaaagaggaataaagacatctcttctctctagaaaagataacaccacaattaataatccttcccactttcattgagatcagcttgtctgataacctgatatgagtgtgataatgataaacatgataatagtggtacttttgtaattttgctggtgcatttaagaagatagtaaatgatgagttcatcttttcttcgaacattcctattcctagatgtagtttacctcaaattgggaattataactgtctaatttttgttgtgtacctgatgccccttttgctttaataccacagtgtaacaattaaatatcacactatgacatatgatttaagtaggatattttaaagataaattttaggggtaaatgtttacttcaaaatgactccatatttcaaatatctgtttagactgtgaaggccaaataatttttaagaaaacatttgaagagtagtgtgtttgcatttgtgaataatcttactcacagcaagtaaacgtaataaaagccaacatttaagccaa

SEQ ID NO: 1186 - DNA, 2698 bp, Homo sapiens
atgctcctggacgcgggtccgcagttcccggccatcggggtgggcagcttcgcgcgccaccatcaccactccgccgcggcggcggcggcggctgccgccgagatgcaggaccgtgaactgagcctggcggcggcgcagaacggcttcgttgactccgccgccgcgcacatgggagccttcaagctcaacccgggcgcgcacgagctgtccccgggccagagctcggcgttcacgtcgcagggccccggcgcctaccccggctccgctgcggctgccgctgcggccgcagcgctcgggccccacgccgcgcacgttggctcctactctgggccgcccttcaactccacccgggacttcctgttccgcagccgcggcttcggggactcggcgccgggcggcgggcagcacgggctgttcgggccgggcgcgggcggcctgcaccacgcgcactcggacgcgcagggccacctcctcttcccgggcctgccagagcagcacgggccgcacggctcgcagaatgtgctcaacgggcagatgcgcctcgggctgcccggcgaggtgttcgggcgctcggagcaataccgccaggtggccagcccgcggaccgacccctactcggcggcgcaactccacaaccagtacggccccatgaatatgaacatgggtatgaacatggcagcagccgcggcccaccaccaccaccaccaccaccaccaccccggtgcctttttccgctatatgcggcagcagtgcatcaagcaggagctaatctgcaagtggatcgaccccgagcaactgagcaatcccaagaagagctgcaacaaaactttcagcaccatgcacgagctggtgacacacgtctcggtggagcacgtcggcggcccggagcagagcaaccacgtctgcttctgggaggagtgtccgcgcgagggcaagcccttcaaggccaaatacaaactggtcaaccacatccgcgtgcacacaggcgagaaacccttcccctgccccttcccgggctgtggcaaagtcttcgcgcgctccgagaacctcaagatccacaaaaggacccacacaggggagaagccgttccagtgtgagtttgagggctgcgaccggcgcttcgccaacagcagcgacaggaagaagcacatgcacgtccacacctccgataagccctatctctgcaagatgtgcgacaagtcctacacgcaccccagctcgctgcggaagcacatgaaggtccatgagtcctccccgcagggctctgaatcctccccggccgccagctccggctatgagtcgtccacgcccccggggctggtgtcccccagcgccgagccccagagcagctccaacctgtccccagcggcggcggcagcggcggcggcggctgcggcggcggcggccgcggtgtccgcggtgcaccggggcggaggctcgggcagtggcggcgcgggaggcggctcaggcggcggcagcggcagtggcgggggcggcggcggggcgggcggcgggggcggcggcagctctggcgggggcagcgggacagccgggggtcacagcggcctctcctccaacttcaatgaatggtacgtgtgacgggtcggggcctctctccctctccctgtccccaccccagcgcagcagccctccccgcagctagcagcgagggcaccttgtgatcatgttgttaaaattatgaatctgatttttatgatgatgaaaattttaccagcagaaggattttttaaagttttttttttttttttaataataatctaggcatgaagagcaaaaatatcccttccggagtctttgaagctgaaaatataaaacaaataaaaaataaaaaaataaaaacccacaaaaatgttgaaccaaacctccctgctaatctccatgcccacgttctttcccaccctgttcccagtcttctgacaaactgtgtacatagcggactcctcctttctcctccgaggtggttttaaaggctttttggtgtatagaagtttgtccatttgtaaaactccggattgcgttcctccccgccttccgccccttcccttccctaaagtgatgggctttctcttttctctttttagtttacccggtttctttttaagtaatgtggaagaaaatggtttattttgtattgtggtattgaatattgtgttcctttttatgaggcaacctgattgtaaacttcatgtaactatagactggaaaaaatgagccgtgccaaagtctcccttctgtttcttcagcacattgacccatagcacacacatacacaccaccaccaacaacgcttgtgaatgtatttttctgttagctgggtttacatgtgatgttttagtgcttttgcaagttcaatttgttagttcctgtatgaaagattgtgggggaaaaataaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagattttttatttgaaggttttaagtggtttgatcatttcttgtgatgttttgagagtaatgcatacagaaatataataaaatgtgttgaaactgcaaaaaaaaaaaaaaaaa

SEQ ID NO: 1187 - DNA, 3939 bp, Homo sapiens
gcggcgagtaacgagcctgcctactgcccgctgcccgcctgcccggccgctagccggctccgccacttggcgcagcccagcccggaggccggtacccagggagcctcctggccccgcggttctgtgcactcggggagaggaggggtgcccgggacaggattggcaaactccgccctccacttactattttgcttatttttctttgtgcgcgcctgttagtttgttaaaccagatctagtccgagtcttttctcctcccttctcctccctcctcctccccccgccaacaccccctccctgctctttcttcccctcctccctcctatccctctgcaggagactcttgcagtgacggaaagttgcagcccctggtagcgccttgggggtctccccgcagtgtccaaccgccgccacccctttccgactacggcacttcggagatctcctccttcgccggtaccctctctcacttcggccggatcgcctgtgcccagaacgtcccacccatgacgatgctcctggacggaggcccgcagttccctgggctgggagtgggcagcttcggcgcgccgcgccaccacgagatgcccaaccgtgagccggcaggcatggggctgaatcccttcggggactcaacccacgccgccgccgccgccgccgccgccgctgccttcaagctgagccctgccgcggcgcacgatctatcttcaggccagagctcggctttcacgccgcagggttcgggctacgccaacgccctgggccaccatcaccaccaccatcaccatcatcaccacaccagccaggtgcccagctacggtggcgctgcctctgccgccttcaactcaacgcgcgagtttctgttccgccagcgcagctccgggctcagtgaggcggcctcgggtggcgggcagcacgggctcttcgccggctcggcgagcagcctgcatgctccagctggcatccccgagccccctagctacttgctgtttcccgggctgcatgagcagggcgctgggcacccgtcgcccacagggcacgtggacaacaaccaggtccacctggggctgcgtggggagctgttcggccgtgctgacccataccgcccagtggccagcccgcgcacggacccctacgcggccggcgctcagtttcctaactacagccccatgaacatgaacatgggagtgaacgtggcggcccaccacgggcccggcgccttcttccgttatatgcggcagcctatcaagcaggagctgtcgtgcaagtggatcgacgaggctcagctgagccggcccaagaagagctgcgaccggaccttcagcaccatgcatgagctggtgacacatgtcaccatggagcatgtggggggcccggagcagaacaaccacgtctgctactgggaggagtgcccccgggagggcaagtctttcaaggcgaagtacaaactggtcaaccacatccgagtgcacacgggcgagaagcccttcccatgccccttcccgggctgcgggaagatctttgcccgttctgagaacctcaagatccacaagaggacccacacaggtgagaaacctttcaaatgtgaatttgaaggctgtgacagacgctttgccaacagcagcgaccgtaagaagcacatgcatgtgcatacctcggacaagccctatatctgcaaagtgtgcgacaagtcctacacgcacccgagctccctgcgcaaacacatgaaggttcatgaatctcaagggtcagattcctcccctgctgccagttcaggctatgaatcttccactccacccgctatagcttctgcaaacagtaaagataccactaaaaccccttctgcagttcaaactagcaccagccacaaccctggacttcctcctaattttaacgaatggtacgtctgaggacaaacacaaaccctgttaattatagaatggaccaaatacatttttaaaagaaaactgagaccaatcagatggaaatggagttttaaggcaagaggccatatatagggctacatcttgttaattgcaattgtccaggaaggttttgggcaagatccaaaagtagccatgcccttttctcaggatagaaaatatgttttggcatttgaagcattttttacaaaatctttacactactttttcttccccttcctcttgctctctgcacaccccattcttaaactcctccaattcattttaacacttgtcctgtttcttgagaggaagttatagaaggcttgttggtggtggtgatgttaaactgatggaaattctttttcgccttagtggtgattgtttaaactctcacagtcttaaaccgtgccaaagtcctgttatgtcttgaacttttcctcaaagcattacacttgtgaatgtatttttgtctaatagggtcgaaactgttgttcagtattttttcaggctgaggatgtgatgttactctacacattgtgacgtttagtatacagttgccttttgtaataactttttttttgtaaatacatatccattgatgccatatttatcgtttgtaatttaattattgctacaagtgccgggaactgaacaatatttatggataaatgttttctaacaaattctgtacagcttttgattataactgctttagcattaaaaattgttttgaaagaagaacacaatttacaattttggaaccactgactcctttctcttgttttgtaacagccttcttctacaaagaggagatgtgagcaaattaaatcttgtttgttggtatttataactcactcagatcccttttttaattgttaaattatttttctattacagtataaattccttacagtgtcagtttccatctgggaagactctcctttctttatctctatctcagatggttgtttaactgcgagtttaaatgtgtttgtcctggattttcggcatgcaaatcaaatattactgatcaattcagttagtggccatgacatctcaatcttgtacttcaaagactgagaagctggatttaatcatccctgccctacatatataaacataaggtaacctactgaattttatgtcccttagttctttattaccttacataaaaatgaaaattgcggcaggatgcatgtctgtctgttctatctagagatcacccatatacctatatatgtttgtatctatgacttatctaatctgcctatcaatctatctagtagctatctatatattttcaaaagatagcttatgtctaaaacagtggtgatgagtaaggccagttgagcattgcttacttatggttaaagtgcttcttaaaagaaccatagtccatttacaattttggaaggcaaaggctgatttgtttgctgtatatagttcaattcataattatcgcaattatccataacatttatatagcggtgtaataactgcagcagttctgaaatgatgctatgggaaaaaaattgcaaaatatgtatttttaaagttcatgatttgtaggcaaagatgttaagagcattgtttccattaaaatcaataacaatgaaaaacggttgtttgctttgtgataaaatgttaacaatccatttaatcttcagtgaagcaactcatttggacaaacagttcttttacagtggttatatggaaaagaaattgattgctattttggggggctggagtgggtagagtattgagaccttttttattagggtgctgtttgttattgagagcccaatctctgcatgaataacagaaaggtggacataaggaattgtaaagtatttagaatgtattgaataggcttaagtacctcctttaaggggcaatgctctaggtttttggtggcagtcaatttggtattatatatgatcattttcaattctagaattttgtttattgttctttttgaagaaataaagtcttggcacatcttatttatgttataa

SEQ ID NO: 1188 - DNA, 4089 bp, Homo sapiens
gcaggaaacgcgaacggctccagttcaaagccacatgcaccaacgtgacatataagccattaaaatatcatcctgacggctcatttctgcttcatcatacattccctaactgcttcctgaaagctggaaaaggagaagtgaaggatgaccgcctcgctggaaccacaaaagagaggcttggaggggtttgtggtcccctctcagccaccccgaaatgatgtgcagaaatgaggcgatcctggcaacaggtggagtggggctcaaagtcagaaaatgagatacaagacatccttggtgatgaggaaacgattacggctttaccgaaacactcttaaagagtcaagtagcagctctggacaccatggcccccagctcaccgccgcctccagcccctcggtgttcccgggcctccacgaggagcctccccaggcctcccccagccgtcctttgaatggactcctgcgtctggggctccctggagacatgtacgcgcggccggagcccttcccgccagggcctgcggcccgcagcgacgccctggcagctgccgcagccctgcatggctacgggggcatgaacctgacggtgaacctcgctgcgccccacggtcctggcgctttcttccgctacatgcgccagcccatcaaacaggagctcatctgcaagtggctggcggccgacggcaccgcgaccccgagcctctgctccaaaactttcagcaccatgcacgagctggtcacgcacgtcaccgtggagcacgtcggcggcccggaacaggccaaccacatttgcttctgggaggagtgtccgcgccagggaaagcccttcaaagccaaatacaaacttgtaaatcacatccgcgtgcacacgggcgagaagcccttcccttgtcctttcccggggtgtgggaaggtctttgctagatcagaaaatctcaaaatacacaaacgaactcacacaggcgagaagcccttcagatgcgagttcgagggctgcgagcggcgcttcgccaacagcagcgaccgtaagaagcattcgcacgtgcacactagcgacaagccatacacgtgcaaggtgcggggctgcgacaagtgctacacgcaccccagctcgctgcgtaagcacatgaaggtgcacgggcgctcgccgccgcccagctctggctacgattcggctacaccgtctgccctcgtgtcgccctcgtcggactgcggccacaagtcccaggtggcctcctcggcggcggtggcggcgcgtaccgccgacttgagcgaatgatgtccaccgcgttgctcgcaaggtaatctcgctccgcgcagctgagcgccccgcatctcgcgcctgctacatcaaagggcccgcgcacaaagcagtgtttcttcgccacggtgcatcttcatggtaagttaggatttctatggcaatgtgcaagtcgcactgaaatcctgaaaggccaagcctggagcccgtccaggcttttcattaaggacataatatttacgtctaacagaccttttttcttgtgtatacaagtatatatttttgtttgacgcggactaaatcattttcatttaatttccggtaaacaaaacccacgcgaatgggcacttgtacccgatcataataaaaatggataataatgtgaaggaagaaaagagccgcttgaatcgccgctcagccccctttgtttctgctttctgcggtgatcagagggcgcgtttgggtttgatggcgagtttctaaaggcgaggaaatggtttgtaagaggggaaagaaaaggagaaaggtctaatcaagctcgggttgttcaaagagtcgggttttggggttgaaagtgtgagtttgacggtgcatcagcatgccgcgttaggctcgccatggaaatacgcgcggggagcggccgcttcaaaggcggcacacttcactacagacactctattaagatacatttgcgctgacctttgctttcacgccatttaatactgtcactgcgctctccagtatatacttcctttctagaacccgacttgcccacgtttaggggttcactctgcaccctgatgtgggaggctttggcgcaggggacactttcaggaaagggaggagcacaaggactctgtgcatcttgactgcaccccaaagaggctccaggatcaggagtgaaagattttaaagcagcctccgaagcttaacaaatgagcattccaagctcagttttgtgcaaatcgcctttctgactcttgagtaggatggaggcttaaatttaatggcgacttggggggaagggagccaccctgggggagtctgaggagttcagactgtgcccttgggaatttccactctggctttccgtgccactcttcttcctttccatcccaaaagtctcttgcggcccctgaaacttgtttctttctaaggcagggtgtgtggtacccttaggcctggactagtcctagatgcaaactcaagagcccaaggccaaggggatgtggggaagatggcaggaaagttagaagtccatgttcccttaattgtcttgttgtttattttatccaagtaccccagtgaataggggaaaaataaacacagtgaaaaaaaaaatcaaacagtggagtcttctttagtgccagtccttgtggttgaataaaaaggatggtccgctttctattgagctgagaaatctttgaagtgggagttattatctgagacattcctgcttgtcgtcctaacaacgctgatgaaacgtaaaaggttctttgtcagcgatttgttctcctctctgtcaaactccctctgccccgttagtttcaaaccgtttctaaagagataaaaatcaaacttcttttaaaacaatatccacacactgcatcaatacataactttaggtctaagtcttgctaagggataaacaaaagcaatgcctagacatcagggtcagggcctggtctggtgaagtatgcagaagttggggggccctcgggacaagctttgggacatgaggaaaagaatgcagagagggtgcaagcagaatacataccctaagtccataattgtgtttctgcttctttctgctctggtttgcattcaatcagcccaagttgggtcacatagatgggtttcctttgggtacccctcaggctcctaatattcttgcccaggatccttggaacttaagaatgcagccaagcaattgttaatatctcctgctccttcaaagccacctctgctaaaaatagacccattgtgtgtttcttctcactagcagcaatcaacaagccctttctgccgttaataagaaggagaatagctgaaggagagagatattttattaatttcctgtttccttcagaatcttggcaattgaagtttagaaggtttggtctacaacacagtgatcgaaaatgcatgtaaatgcccatccttcccttcattcacgtgtgaagttgttcattttatattgtgcccagcaaagaaactttcacccagttcaggtttccccaaaactcctgtggtggttttaaaggtggtttaaataaataaggatgtgctggtccccctactctgtgtgtgctgaataaatggcttgtaaagaagtttttccaagctgtaacccatgctgttattatagttgctgcaaaatgttcttcctgatattgattttatttgttaactgaaggtctccatatgtttgtttatattgctaatttatgagaaaatgtaataattgcaatgaatgtgaattatacagacaggcaaacattttgtaatcataattcacatatacacaaaagcctggctgaaatctttagactatttgtaccctctctacccacactgtttgtgatttatcatctgtctctttagtgtcagttaaattatgaactaacttgaaaataaaagttgtttgactgaaagtgattgttgaatgaacaacaaagttgaaagccatggcttgatcttgtaaatatataaatgtaaatgatattaaatctgtgattccttttccctccaaaggcttttgtgtacatggcgctgcatttggctattttctttggaaataaataatgtgatgtttctcttcctcttttg

SEQ ID NO: 1189 - DNA, 4607 bp, Homo sapiens
gcggccgcaagcacgggggcgaatccccgctgggtcgagggcctgaacgggagccaatcgagcagccgaggctactgccaatcacgcggctccctccaatcccacccgtgccatttccaaaatctcggtcccactgtgcagctcaaatgtggtgttcactctgccaatcgctggaggatagagtgggaacaggaataagcagagttaagaggccaggacaaaagaagttaaagagcgcccaatacatacatgtttttgaaggcgggcagagggaataaagtccccccagtgagggtctatgggcctgattgtgtagttctgatggagccccctttgagcaagaggaacccgccagcgctgagattagcggatttggcaacggctcaggtccagccgcttcagaatatgacaggcttcccggcgctggccggcccgcccgcccactcccaactccgggccgccgtcgcgcacctccgcctgcgggacctgggcgctgaccccggcgtggccaccactccgctcggacccgagcacatggcccaggcgagcacgctgggcctcagccctccctcccaggcgttcccggcacacccggaggctccggcagccgccgcccgtgctgcagccttggtcgcgcaccccggcgcgggcagctacccctgcggcgggggcagcagtggcgcgcagccctccgcgcccccgcccccagcccctcctcttcctcccaccccttcaccccctccccctcccccgcctcctcctcctcctgccctctcgggctacaccaccaccaacagtggcggcggcggcagcagcggcaaaggccacagcagggacttcgtcctccggagggacctttccgccacggcccccgcggcggccatgcacggggccccgctcggaggggagcagcggtccggcaccggctccccccagcacccggccccgcctccccactcggccggcatgttcatctccgccagcggcacctacgcgggcccggacggcagcggcggcccggcgctcttccccgcgctgcacgacacgccgggggccccaggcggccacccgcacccgctcaacggccagatgcgcctggggctggcggcggcagcggcagccgcggcggctgagctgtacggccgcgccgaaccgcccttcgcgccgcgctctggggacgcgcactacggggcggttgcggccgcagcggcggccgccctgcacggctacggagccgtgaacttaaacctgaacctggcggctgcggcggccgcagcagcggccgggcccgggccccacctgcagcaccacgcgccgcccccggcgccgccgccgccgccggcgcccgcgcagcacccgcaccagcaccacccccacctcccaggggcggctggggccttcctgcgctacatgcggcagccaatcaagcaggagctcatctgcaagtggatcgaccccgacgagctggccgggctgccgccgccgccgccgccgccgccgccgccgccgccaccgcccccggccggcggcgccaagccctgctccaaaactttcggcaccatgcacgagctggtgaatcacgtcacggtggagcacgtgggaggccccgagcagagcagccacgtctgcttctgggaggactgtccgcgcgagggcaagcccttcaaggccaaatacaagctcatcaaccacatccgcgtgcacaccggcgagaagccctttccctgccctttccccggctgcggcaaggtcttcgcgcgctccgagaacctcaagatccacaagcgtactcatacaggggaaaagcctttcaaatgtgaatttgatggctgtgacaggaagtttgccaatagcagtgatcggaagaaacattcccatgtccacaccagtgacaagccctactactgcaagattcgaggctgtgacaaatcctacactcacccaagctccctgaggaagcacatgaagattcactgcaagtccccgccaccttctccaggaccccttggttactcatcagtggggactccagtgggcgcccccttgtcccctgtgctggacccagccaggagtcactccagcactctgtcccctcaggtgaccaacctcaatgagtggtacgtttgccaggccagtggggcccccagccacctccacaccccttccagcaacggaaccacctctgagactgaagatgaggaaatttacgggaaccctgaagttgtgcggacgatacattagaatttattattaataataataagtgaaataataagtgggagtccttggaccacatcctaacctgagacaatgccgagcctgagacaaacccgtgactcagacttgccaccgggtctaattagccctatttattcagtatgaaaccctatggtgtttgtacatttaattaatttaattaagatatttgggcttttttttttttttttcttaaaaaacaaacaaaaaacaaccaagctggacttgtacattgcaggaggatggggctgggggcaaattgtaccaaggaaaatgaatggagagattagttaatggcgatacacactgccgatgcaatatatatatatatatatatatacatatatatatatattattttttttaaaagggggagaaaaagagcattaagtcagaacttaacacagcaccaaggccctctgcatttcccagagtgcctctcaaatgcctttgacaccataccatgggctgcttttgagcctccttgttggaccctaattctgccaaggcctcttgattgtaaaccacacacctgctgcattgccaacagatcctgttccgtacctgtgtccaaaaacatttgtaaaaaccctttgagtttaatatttgtaatttttaatttccactcttttattactgatcttagcttaatacaatatttttatacaggattatttcttcagtatcctactgtgtgattttaaaaaaagatgcagcaaccttaatatatctccatatcttgtgctactgtgattgttcaagcaaaagtggagagaagaaaagctgctgcaaaagacaactgtgaaactgtgatattttataaaatagaagaaattcaagtgctttctttttcctatatgtttttttttttttatctgaattctcagatactgcctcctaactgtgtccaaacttcttgtgtaataaagagattctgttttcgatcctaagttctttgggatgccaacattcacagtcaagtcttgaggaggtgtgatgatggcatcatgcctatttttttggaaagctgttgtttttaaaacaggccaacacctcttttatactgttgtatcagccttttaaaaagtctatttttcaatgcctgaaactgcattttaatgcattttcttccacctgagcactgagcacaccaaactggaatccatttgaaaatgacagtgtgtgaagtgtatgatttacattaaaagaggggagggagttgccatacatattaaaaatttttaaaaggtttatagttaccaccaaacactgatgaatgtgtgacctttgccagagctgtcaagctaggataaaaaaggtcaaggacctaggacaataactcttagtcgatttattttcggttggtacaacacatctcctgtgcaaaatgtagtccatcagaaacatcctacagatacactaaagagcactaatttatccttagagaccccgaagacaccccctccccagggtttgtagaaatttgttttgtgtgctgtgagtggttgatgtagtcttgtcattgttaataacttgtatgtgaacactattatttgtacagttgaattaatttattttcagacatcatcctttttttttttctttcctggaagagttcaaagcacaccaaagaattatattatacattttggtgaaagattgtcatttatgatccatggtttatttaaaaaaaaaaggaaagaaaatggaaaaatatatttttaagcttacttgaatgaacaacgtaatgtgaaaaccaagactcttcctgcatgtcttttttgcattgtgttgataagattatatatagtttatagatatattatattactagtacagtgcatggtgctgtcacttggaaagcctttcaatgttgtcttcagattgttgtgatgaatatgaaacatgcagaccctcctttataaagaaaaagaccttaaaacttgaatatgagataattttacattttaaaagtttatttgattttcatattattcactttcaaagccctttcaaatagaaaaggtatgaacttttggggggataatttatgtatcgtaaacttattagaacaaaatattcctgatgtataatgagttgttttatttatacaactttttcaatggtagtttgcactattctttattatgctacaggtttatttattatgaaacaaaggaatatgtattttatgtattttaccatgcataggttaactctttgccacagatttattggttcttgatacacctaaaataaaaaaaaatgtgtacctccaatagagagcaagcaagaatgattatgaagtaacaaatttaataaaggtattcttgttattattaaaaaaaaaa

SEQ ID NO: 1190 - DNA, 4128 bp, Homo sapiens
gtgttttcctccaggctaagtccatcttccggcttgggcagacgctgccgcggaatccttgactctagttttctgagtcgattgtgatcatggctgctgagtctgatgttctgcatttccagtttgaacagcaaggagatgtggtcttgcagaaaatgaatcttttgagacagcagaatttattttgtgatgtatcaatttacattaatgacactgagttccaggggcacaaggtgattttggctgcttgctccacttttatgagagatcagtttttactcacacagtcaaaacatgtcagaatcaccatcttacagagtgcagaagttggcagaaaattgttactgtcttgctatactggagcacttgaagttaaaaggaaagagcttttgaaatacttgactgctgccagttaccttcagatggttcacattgtggaaaagtgcacagaagctttgtcaaagtatctggaaattgatctttctatgaaaaacaacaaccaacacactgacctgtgtcagtcttctgatcctgatgttaagaatgaagatgaaaattctgataaagactgtgagataattgaaatttcagaagatagtcctgtaaacatagatttccatgttaaagaagaggaaagcaatgctttgcagtctacagtagagagtctgacatcagagagaaaggaaatgaagtcaccagagctgtctacagtagacataggttttaaagacaatgaaatttgtatccttcatgtagaatccatcagtacagctggtgtcgaaaatgggcagttttcacagccttgtacctcttcaaaagcaagcatgtatttctctgaaacacagcattcattgatcaattctacagttgagagcagagtggctgaagttcctgggaatcaagatcagggcttattttgtgagaatactgaaggaagttatggtacagtgagtgagattcagaatctggaggaaggttattcactgaggcaccagtgccccaggtgtcctcgaggctttcttcatgttgaaaactatctgcgccaccttaaaatgcataaactattcttatgcttacagtgcggaaaaacatttacacagaagaaaaatctcaaccgacacatccgaggacacatgggcatacggccctttcagtgtactgtgtgcttgaagacatttactgccaaaagcacacttcaggaccacttgaacatacacagtggggatcggccatacaaatgccactgttgtgatatggatttcaagcacaagtctgctctcaaaaagcacttaacctctgtccatggcagaagcagtggtgaaaaactatctaggcctgatctcaaaaggcaaagtctactataattataatcacagacttgttatataacgtttgtattattctattacgcaagtctttctgtagagatgcagcatttgtaatatttcatccccccaatctttgtttcttatattttgtcggcttacacataatcattctttctgaacttctaacagttccaaagttatgggaggcacagtaaagctgatgggattctgtctcatctcataccttacatataagtctcagtagtatccctagagaaatagtgttcctctcttatatattcttgattctagtgacaaaggatccagcagtatttgcagattccgatttggagtctctaggtaattgatttaagtataaaatccaatcatataaaaactttaatgaattaggataacaagaagagaaaataaaggtaaaaacactattacctgtttctagtcactttagaacagatggcactaaaaaaatttttttttaactttttaccagctgttcttggattccaaactaaacaccaagatacttttcattttaaaatgtataaagtaacaattcagattcacttgggaatagcagaatttttttatacagggttaataatccttaaaatacttttatttccatgccttattagtatacatacttaagaaatggttcattgggcccgagtttcttgattttatttaatacaatcggatttaataattttgtggccagtaaaattataccattggcatgaagctgtgaaaaatgagaaattctacctttaccagggatatctgttctactgttttaaaagttcctctctattttattttttatttaacatgaagtaaaattgaaatttcttcttggtgtatagttctgtgaattttaacagaaagatttgtgcaccactactgcagtcggtacagaacagttccttcactcccaatagctctcttatgctgtccctttgtagtcagctccttctagctctaatcctggcaacagttctccgtcactattattttgccttttctggactgtcatataaacagaatcttatagtacgttccctcttgaaatgctttttcacccagcataatgactttgaggttcatccatgtcattttaaattttgaattggcaatatatattctagctgttactagatgagcaatttaaaaaggtgtagctattagtgttgtattttttcatttacattaatgtaatttccattcactatgtgttgataaaaatcttaaccatccctagagttttatatttccaaaaatatgccaaaaggaaaactatgactgtatgattattttagcgagagtcatatttgagatggtgttctgagccatagttctctaacatctccgtctacatataacacaaaacttttataaattattttaacaaagattaaaatatactgcagggcaaataatattctctaaaacacaggaactgcttttcgtaaagaagactgactagatgcatctttctttgaagctgttctagtcctcctctagttaacttagctttatgtagaatttctactgtatttaatttctattgaagcccttctgtattttaaaatgtaatatactttgtaccatttataaaaattgtgtgatgaatgaatcacatgttcgttgttataagtgttaacctttttttgacaattttgtgggaaagacattctccactgaattttaactttccttgagactttcaagaatgcaggtctcgtttgatgaaaaaaccgacttcataacccaatgttactagttagcgacattgtgctgaatttctccttgaactttttaactttatatgtaaaataactttgatcttggtcatttgaaagatcatttccaggtctaaaattccatgattttgtatttaattcttcctgagaacagaagaggggaaagcaagagaggacggttttgtgtctttatgaactttgttacttaagtactccattggagacataatttttctaattagtggatctttttccactggaaagtgtgatagctcattgctaatttttcattcatagttcattgcttccatttgacctaagattggccatttgttggtgtgaaaatattttcttttcagaaatagtttactagtgattgaagtacttttcttatttttgcttcctattataaaatggcgtggggggaagggggaaggatggagatgggaggagagggtaaaagaatagtactctgattttttaagaattagtatctactatcttggatatttgaaaaaaaattggttgaaactatgtttaagttttatgtgtgccttgtaagattgttgtaaaattttttgtgagcactttgagatttttgctgggggaggggtgttttgtgaaagtgatggttattatttatattatttattcctgttcagtagcacggaatgatctccaaacattcctaggagagtgtctgtttgcatgatatgtctaaaaattttcaggaaaatggaatctttttttaaagttcaggtatgacaaagtatagaatttattcatttaacatattcacatttagtttatgtttctgatatgacagaaaaatgaaaagtgtttgagttcagcctcttcatttactccatttacatataaaagatcttgaaaaggtagttgttacttcgttgtcagagaaaaacacttgccctttttcctgggatgtaactatcttacatgtttacataagaaataataaactggaggtgggaatggaaaaaaaaaagaaaaaaaaaaaa

SEQ ID NO: 1191 - DNA, 2113 bp, Homo sapiens
ggtgcagaagtctgggcagctgcgggaggagaggtttgggaggcgcgggagatgtccaccctgggctggtggcgccgccgggcgccgggcgccatgagggtgcgctaggcggctgttcgtgcccgaggctgcgcagcactgagctttgccttcttgatcttccgtccttcttggagacgactggcgagaggaagagggactaggtccaaacgctaggtggctgggtccagccggagacccgcaccaaggaggagatcatcgagctcttggtccttgagcagtacctgaccatcatccctgaaaagctcaagccttgggtgcgagcaaaaaagccggagaactgtgagaagctcgtcactctgctggagaattacaaggagatgtaccaaccagaagacgacaacaacagtgacgtgaccagcgacgacgacatgacccggaacagaagagagtcctcaccacctcactcagtccattctttcagtggtgaccgggactgggaccggaggggcagaagcagagacatggagccacgagaccgctggtcccacaccaggaacccaagaagcaggatgcctccgcgggatctttcccttcctgtggtggcgaaaacaagctttgaaatggacagagaggacgacagggactccagggcttatgagtcccgatctcaggatgctgaatcataccaaaatgtggtggacctcgctgaggacaggaaacctcacaacacaatccaggacaacatggaaaactacaggaagctgctctccctcggtttccttgctcaggactctgtccctgcagaaaagaggaacacagagatgttagacaatctgccatctgctgggtcccagttcccggacttcaaacacttaggaacatttctggtgtttgaggagttggtgaccttcgaggatgtgcttgtggacttcagcccagaggaacttagttcccttagtgctgctcagagaaacctctacagggaggtgatgctggagaattaccggaacctggtctccctggggcaccagttctctaaacctgacattatctcacgcctggaagaggaggaatcatatgcaatggagacagacagcagacatacagtgatttgtcaaggagagtctcatgatgatccattggaaccacaccagggcaaccaagagaaacttttgactcctataacaatgaatgaccccaagaccctcactccggaaagaagctatggcagtgatgaatttgagagaagctctaatcttagtaaacaatcaaaggatcctctaggaaaggatccccaggaaggcactgctcctggaatatgtacgagtccccagtcagcatcccaagagaacaaacacaacagatgtgaattttgcaaacgaacctttagtacgcaagtagcccttaggagacacgaacggatccatactgggaagaaaccctatgaatgtaaacagtgtgctgaagccttctatctcatgccacacctcaacagacatcagaagacccattctggtaggaagacttctggctgcaatgaaggtagaaagccttccgtccagtgtgcgaatctctgtgaacgtgtaagaattcacagtcaggaggactactttgaatgttttcagtgcggcaaagcttttctccagaatgtgcatcttcttcaacatctcaaagcccatgaggcagcaagagtccttcctcctgggttgtcccacagcaagacatacttaattcgttatcagcggaaacatgactacgttggagagagagcctgccagtgttgtgactgtggcagagtcttcagtcggaattcatatctcattcagcattatagaactcacactcaagagaggccttaccagtgtcagctatgtgggaaatgtttcggccgaccctcatacctcactcaacattatcaactccattctcaagagaaaactgttgagtgcgatcactgttgagaaacctttagtcacagcacacacttttctcaacattattggcttcctcctagagtgttgtgagtgtgagaaggcctttcactagccccaccttgttaacaacttgaacattcatcaaagtgtggtaaaaaaaaaaaaaaaaaaaaaaa

SEQ ID NO: 1192 - DNA, 2627 bp, Homo sapiens
ttccattggaaactgattgggcagatttgaaaattaagctttcacaatcacaatttttatgagagttcattcagttttggagaagtcgaggaaagaattgggaattgaaattttgatgtggcctgataggatcaggtggggcttttgataggaagtgagtgttttgggttgtttcttgactggattatgatgcggaatacagcgggtagagggccgattaagttttagtcattagtgtagcttttcagtatacacgccttttcattttcagtccctttcagaagaaaagaccacaggcatcagaaatcaatcaacttgctaatttatgccagattccactggagatctgccttcccaagactttactgactggtgaagaacaggaaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcgcaagagaagtcccatcaatcaataaggaaacgctgactacgcagaaaggtgtagaatgtgacggatctaagaaaatacttccactgggcatagatgatgtatcttccttgcaacactatgtacaaaataattctcacgatgataatggatacagaaaattagttggcaataatccatccaaatttgtaggacaacaactgaaatgtaatgcctgtagaaagttattcagttcaaagtcacgccttcaaagtcacctgaggaggcatgcctgtcaaaaaccctttgaatgtcatagctgtggaagagcattcggggagaagtggaagcttgataaacatcagaaaactcacgcagaggaaaggccctataaatgtgagaactgtggaaatgcctacaagcagaagtcaaatctctttcaacatcagaaaatgcatactaaagagaaaccctatcagtgtaagacatgtggaaaagccttttcctggaaatcatcctgcattaatcatgagaaaattcataatgccaagaaatcctatcagtgtaatgaatgtgagaaatccttcaggcagaactcaaccctcattcaacataaaaaagttcacactggacaaaaaccctttcaatgtacggactgtggaaaggctttcatttacaagtcagatcttgtgaaacaccagagaatacacacgggagagaaaccctataaatgtagcatatgtgagaaggccttttcccagaaatccaatgtcatcgatcatgagaaaattcacactgggaagagagcttatgagtgtgatctatgtggaaatacctttatccagaagaaaaacctcattcaacataaaaaaatccatactggggaaaagccctatgaatgtaacagatgtggaaaagccttctttcagaagtcaaaccttcatagccatcagaaaactcatagcggagagaggacctatagatgtagtgaatgtggaaaaaccttcatccggaaattaaaccttagtttgcataaaaaaacccatactggacaaaaaccttatggatgttctgaatgcggtaaagccttcgctgacaggtcataccttgttaggcaccagaaaagaattcactccagataggagccccatgcacttaaaaaaacatgggaagatatggttgcctggaattgtcaccccagaattccatgttgaaatggcctctaatttggaggctatttttgaaggtagcgaggacttattatcacagtatcctttgaaaacccattcggcatactcactcagcaaatgtttattaagtataaatatttattagatgccttttgtgtaccaggaactcttaaacactgaagatgtagcaataaaccaaatgtgctaaaaccctgatggagttttattccagtgaataatgaccagtggtatccatatctttaaaaacgtttaaaagactatacttttggccaggcgtggtggctcaaatgcctgtaatcccagtactttgggaggctgaggtgggcgcatcacctgaggtcaggagttcgagaccagcatgaccaacatggtgaaaccctgtctctaccaaaaatacaaaaattagccaggcatagttgtgggcacctgtaatcccagctacccgggaggctgaggcaggagaattgcttgaacctgggaggtagaggttgcagtgagccaatattgcaccattgcactcctgcctgggcaacaagagcaaaatttcatctcaaaaataagataaaataaaataaacaaataagacagcactttatacttttagggatgatttctataattcatgagtggagaggtttctctagaggtgtaggggactggaaaccacatccaggaagtacagctttctctcctgagcatgaaggtatcttggcatttcttcactgcaattgccatttgccttttttgtttttc

SEQ ID NO: 1193 - DNA, 3162 bp, Homo sapiens
gcgggaaagaaagcttgccccagaggacttaaacaggcaagaaggacttggttaaagactattgcaatagtcaacttccaatacaacagcagctggagatttatagctaacgggctgggtgaaggagttaaaggatgctaaattactaagaggaagtgatgggcagtaggggctgagcaaagataacttctgacatagtcaaaccaactccctctcagaagaacctgatgtttcctgactgctttctccttcctcagccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatcctactatattttttcaatggtcttttttttttgtattatacagaattactgattcattgaaaaattattttatttattgcaagtctaaatttatcctttttttctttcctgattatcctaacaccatttattcaataaccttgtccattttcatattttttttattgactatttgatggtaagttacatttttattcacataaagcttggatatcaggtcagtgtttttttgtttttgtttttgtttttgtttttttgagatggagtctcactgtcaccaggctggagtgcagtggtgcaatctcggttcactgcaacctccacctcccgagttcaagtgattttcctgcctcagctccccagtagctgggactacaggcgcccgccaccacgcccagctaattttttgtattttcattagagatggggtttcaccacgttggccaggatggtctcgatctcttgacctcgtgatccatctgcctcggcctcccaacgtgctggaattacaggcatgagccaccatgcctggcccagtgtttgttttttaaatttatatatatgtatctatgtctcatcctgtttatggtcaataactgttacttttaagtatcctttaatacctgtaccttttgttttagaagattgtttactttccttttataaaattatactctccattttagcaaaacagctttccctcatcataatgtagataaaaagaaaaaaaggatatggttacctgtaatcttaccaatcatagataatcactgtcaaacttttggagcaaatcctttaatactatctctcattgttttggaaacaaggtgtgattatgctatactataaccagcccttaatattttttgtctgtaaatatgttgttaccattttattggctttatagtattcacctgtctttatcaaaccccaattttgtcaaatattaaaaattttgccattataaaaaaaaaaaaaaaaaaaaaaaaaaaaaaaaagaaaaaaaaaaaaaa

SEQ ID NO: 1194 - DNA, 4479 bp, Homo sapiens
aatcaggcatgcagctggagcggactggacggcttccgggtttggcggggtctttgtctctcgctgtagccggagctccaggttttgctctcacttctctgtgtcttctgctcctaggggcctagcctgtgtggccctctgacctgcagatattgggagatccacagctaagacgccaggaccccctagaagcctagaaatggatgacccgaggtatggaatgtgtcctctcaagggagcaagtggatgccctggggctgagaggagtcttctggtgcagtcttattttgaaaaggggccattgacgtttagggatgtggccatagaattctctctggaggagtggcaatgcctggacagtgctcagcagggtttgtataggaaagtgatgttagagaactacagaaacctggtcttcttggcaggtattgctctcactaagccagacctgatcacctgtctggagcaaggaaaagagccctggaatataaagagacatgagatggtagccaaacccccagttatatgttctcattttccccaagacctttgggcagagcaggacattaaagattcttttcaagaagcgattctgaaaaaatatggaaaatatggacatgacaatttacagttacaaaaaggctgtaaaagtgtggatgagtgtaaagtgcacaaagaacatgataacaaattaaaccagtgtttgataactacccagagcaacatatttcaatgtgatccatctgcaaaagtctttcatacattttcaaattcaaacagacataagataagacatactagaaagaaacctttcaaatgtaaaaaatgtgaaaaatcattttgcatgcttttacacctaactcaacataaaagatttcatattacagagaattcctaccaatgtaaagattgtggcaaagccttcaactggttctcaacccttactacacacaggagaattcatactggagagaaaccctacaaatgtgaagaatgtgggaaagcatttaaccggtcctcacaccttactacacataagataattcatactggagagaaaccatacagatgtgaagaatgtgggaaagcttttaaccggtcttcacaccttactacacataaaagaattcatactggagtgaaaccctacaaatgtacagaatgtggcaaagcttttaaccggtcctcacaccttactacacacaggataattcatactggagagaaaccctacaaatgtgaagaatgtggcaaagcctttaaccagtcctcaacccttactacacataagataactcatgctggagagaaaccttacaaatgtgaagaatgtggcaaagctttttaccgattctcataccttactaaacataagacaagtcatactggagagaaattctacaaatgtgaagaatgcggcaaaggctttaactggtcctcagccctcactaaacataagagaattcatactggagagaaaccctacaaatgtgaagaatgtggcaaagcttttaatgagtcctcaaaccttactacccataagatgattcatactggagagaaaccctacaaatgtgacgaatgtggcaaagcctttaaccggtcctcacaactaactgcacataagatgattcatactggagagaaaccctacaaatgtgaggaatgtggcaaagcttttaaccgatcctcaacccttactaaacataagataactcatactggagagaaatcttacaaatgggaagaatgtggtaaagactttaaccagtccctaagccttattaaacaaaataactcatactggagagaaaccctacaaatgtgaaaaatgtggcaaagccttttaccagtcctcaactcttactaaacataaaaaaattcatactggagggaactcctgtgactgtgaagaatatggcaaagcctttaataaattctcaattcctaacagacataagataattcatactagagagaaattctacaaaccagaaagatgtgacagtgctttgaaaacacctcaaacttttcaaaacataaatcatagtgttgagaaatcctagaaatgtgaagaatgtgataaagttttaaatggttgtcacacttgattgtaggtaaggtaagttatactggagaaaacttctacatgtgtgaacagtgtgacaaaacttttaactaatgctcacaccttcacaggaaagcatttatacttgagaaatattgtacaaatataaagactgtgaaaaagccattaatacatgctcacatcttactcaacatcagagagttcatactcaataaaaacataagtgcaactactgtcaaaatatctttaagaaaatataagcttttaaagtgaagagtattttgaagaagaacattgtagtagaattgtaatatgtttacttgtatcacagatcttactgtacacgttttgtattagaggaaacctctgaagcagttgctcaaactttgttcaatatcagggaatttatattgaaaaaaactgtgcgaatgtaataaagttggaaaaatactttttcaaaaactacagcttagaaaacaccagagagttcatactaaaacatatttttgcagatacaggaaaaattttttaaaaattttaatcattaagtctgtaaatatcagagaatttacagtagaaatatgtaaggcactgatgcttcaggtattttactaaatcagagtgctgagtatagaaaataatctaaaactaaaattggtaaaatatttgtatataactttaaaagtagaaattttttgcagttattgcattcaaagtatgcttaactttttgaaaaaattagattttttgaaaagtgagtaataatgtaattcaactcttaaattatttcctgccttttcttcactcctatttacatgtgaaagcatgtgatcaattgttgctgcatcagatatgagagattcttttttattaggtgagcattatttataaactttgctatgaaaaagacattaaaatatgagatgtatgatgaaaatctaagtgaagagacttttatggttaacttataatattaagcaatgtgtgcgttaggcattcagagtaatattctgcattatgagaaaacttaatttcatttataagtaaattaaaattagtatattttactaatacttttatataaaatgcagtatattttttaaatttcagattatatgtgatgttaatatattcaacctttttaacatgttaaatactattgtgcattcagtgaagtgttattatgccacagacattaacctattccaccttactcaagggtgtacgtaaaacatggtaacagtatactatttggtaacataatggattaacatctctagtaatctcttttgctagtggctttgactgcaaataagttaaagaatattatttctgtaggttaaatttttgtttttattttattttatttttgagaggtagtcttgctctgtcacccaggctggagtgcagtggcacgatctcggctcactgtaacctccacctcctgggttcacgcaattctcctgcctcagcctcctaagtagctgggattacaggcacccaccaccatgcccagctaatttttgtattttagtagagacagggtttcataatgtaagtcaagctggtctcgaactcctgaccttaaatgatttgcctgcctcggcttcccaaagttctgggattacaggcatgagccaccgtgcccagccaaatgtttattttatttaaatttatttttcttaattatttggggtacataatatgagtatatattcatgcaatatatggcatattttgatacaagaatacagtatataataatcacatcagggtaaatgaggtatccatcacctctagtatttatcctttgtattacaagcaacccagttttatacttttagttattttaaaatgtaaaattaaattgttattgattacagtgttatttttatggtcataataaaagttatgtagaagtataataaaatccctacatttctgaggcctgaataagtatttttaaagttttctaatatttattttttgagcatgtttcctgtctgcctgcaaacacatgcagacatttagttttgatttacatatagttaaatatatgttagtctaaagataaaccttaagtgtaagaaaattatagagtgagtttgtgtgtatgaatttgtacctgttttccgaagaaaaaagcaatactgaacaaaacaaatcattttaacaagatgactactagaaaactaaaagcctcaaaaatgctaaaagaaaatgtattctctgctttgtattgaatttattactgtacattctgtggcttatagttctgaatctccccatgaaaattctgtttatacttgcctggtactcatgatagacccctaattattttgtatcttttttcatataaatattttacagattatgaagtaaaaaaaaaa

SEQ ID NO: 1195 - DNA, 1389 bp, Homo sapiens
gaattcgggagagaactacagaaacctggttttcttgggtgaaggtattgctgtctctaagccagacctgattacctgtctggagcaaggaaaagagccctggaatatgaagagacatgagatggtagctaaacatttagttatgttttattattttgcccaacacctttggccagagcagaacataagagattctttccagaaagtgaccctaagaagatatagaaaatgtggatatgagaatttacagttaagaaaaggctgtaaaagtgtggttgagtgtaaacagcacaaaggagattatagtggacttaaccaatgtttgaaaactaccttgagcaaaatatttcaatgtaataaatatgtagaagttttccataaaatttcaaattcaaatagacacaagatgagacatactgaaaataaacattttaaatgtaaagaatgtcgcaaaacattttgcatgctttcacacctaactcaacataaaagaatccatactagagtgaatttctacaaatgtgaagcatatggaagagcctttaactggtcctcaacccttaataaacataagagaattcatactggagaaaaaccttacaaatgtaaagaatgtggcaaagcctttaaccagacctcacaccttattagacataagagaattcatactgaagagaaaccctacaaatgtgaagaatgtggcaaagcctttaaccagtcatcgacccttactacacataatataattcatactggggaaattccctacaaatgtgagaaatgtgttagagcttttaaccaagcctcaaagcttactgaacataagttaattcataccggagagaaacgttatgaatgtgaagaatgcggcaaagcttttaaccgatcctcaaaacttactgaacataagtacattcatactggagagaagctgtacaaatgtgaagaatgtgacaaggcctttaacctgtcctcaacgcttactaaacataaggtaattcatactggagagaaactgtacaaatgtaaagaatgtggtaaagcttttaaacagttctcacaccttgctatacataatataattcatactggagagaaactctacaaatgtgaagaatgtggcaaagcttttaactcatcctcaaaccttactgcacataagaaaaatcgtactggagagaaaccctacaaatgtgaagaatgtggcaaagctaacctatcatcaacccttactccacataagacaattcatatttgagagaaaccctgcaaatgtgaagaatgtggcaatgcttgtaactaaatctcaaactttactaaacataagaaaattaatactggaaactttacaaacctgaaagatgtgacaatgattttgaccccgaattc

SEQ ID NO: 1196 - DNA, 669 bp, Homo sapiens
tgtcagtgtgattcatgtggaatgagtttcaacactgtttcagaattggttatcagtaagataaactatttaggaaaaaagtctgatgaatttaatgcctgtgggaaattgttactcaatattaagcatgatgaaactcatactcaagagaaaaatgaagttttgaaaaataggaacacactgagtcatcatgaggagactttgcagcatgagaagattcaaactttagagcacaattttgaatacagtatatgtcaggaaaccctccttgaaaaggcagtattcaatacacagaagagagagaacgcagaagagaataactgtgattataatgaatttgggagaactttgtgtgatagttcatccctcttgttccatcagatatctccgtcaagggacaatcactatgaatttagtgattgtgagaagttcttatgtgtgaagtccaccctttctaaacctcatggggtatctatgaaacactatgattgtggtgaaagtgggaataatttcaggaggaaattgtgtctgtcacaccttcagaaaggtgataaaggagagaaacactttgaatgtaatgaatgtgggaaagctttctgggagaagtcacatctcactcgacatcagagggtgcacacaggacagaaaccctttcaatgtaatgaatgt

SEQ ID NO: 1197 - DNA, 1136 bp, Homo sapiens
gaattcccaagccagagctttccagaagtctggacagctgatcacctgaaagagaggagccaagaaaatcaatctaaacatttgtgggaagttgtattcatcaataatgaaatgctgactaaggaacaaggtaatgtaataggaataccatttaacatggacgtaagttcttttccttccagaaaaatgttctgtcagtatgactcatgtggaatgagtttcaacactgtttcagaattggttatcagtaagataaactatttaggaaaaaagtctgacgaatttaatgcatgtgggaaattgttactcaatattaagcatgatgaaactcatactcgagagaaaaatgaagttttgaaaaataggaacactctgagtcatcgtgagaacactttgcagcatgagaagattcaaactttagaccacaattttgaatacagtatatgtcaggaaaccctccttgaaaaggcagtattcaatacacggaagagagagaatgcagaagagaataactgtgactataatgaatttgggagaactttctgtgatagttcatccctcttgttccatcagatacctccatcaaaggacagtcactatgaatttagtgattgtgagaagttcttatgtgtgaagtccaccctttctaaacatgatggggtacctgtgaaacactatgattgtggtgaaagtgggaataatttcaggaggaaattgtgtctgtcacagcttcagaaaggtgataaaggagagaaacactttgaatgtaatgaatgtgggaaagctttctgggagaagtcacatctcactcgacatcagagggtgcacacaggagagaaacactttcaatgtaatcaatgtggaaaaactttctgggagaagtcaaacctcactaaacatcagagatcacacacaggggagaaaccttttgaatgcaatgaatgtgggaaagcctttagccataagtcagccctcacattacaccagagaacacatacaggggagaaaccctatcagtgtaatgcatgtgggaaaactttttaccagaaatctgacctcactaaacatcagagaacacacacagggcagaaaccctatgaatgttatgaatgtggaaaatccttctgtatgaattc

SEQ ID NO: 1198 - DNA, 224 bp, Homo sapiens
actggagagaagccctttgcatgtaagggttgcaagaaggcattcgatcagaaaataaccctgattcagcacgagggagttcacactggtgagaaaccttatgagtgtagaaggtgtgggagcccctcagctggtgtggaaacttcgttatgcatcagaagccacacactcaaaaggcacccatttaagcatagggctagccactatcaggctcactacacccc

SEQ ID NO: 1199 - DNA, 1674 bp, Homo sapiens
ggcctttgtctctcgtgcccgcacgtgcgtgtctcggtcagtagccctgcgcttctccttcactctcggcggttcaggaggctctgccgcagccggggccctcctgtgacctgcatgtactgggggattcgcagggaggatgtcgggacaccccggaagctgggaaatgaactcggttgcctttgaggatgtggctgtgaacttcacccaggaggagtgggctttgttggatccttcccagaagaatctctatagagacgtgatgcaggaaaccttcaggaatctggcttccataggaaacaaaggggaagaccagagcattgaagatcagtacaaaaattcttcaagaaatctaagttcatttcagatacatcagagaaatcacactggagagaaaccctatgaatgtatggaatgtgggaaagccttaggtttttcccgttctcttaatagacataaaaggattcacactggagaaaaacgctatgaatgtaagcaatgtgggaaagccttcagtcgttccagtcaccttcgtgaccatgaaagaactcatactggagagaaaccctatgaatgtaagcactgtgggaaagccttccgttactccaattgccttcattaccatgaaagaactcacactggagagaaaccttatgtgtgcatggaatgtggcaaagctttcagttgtctcagttccttgcaaggacatataaaggctcatgctggtgaagaaccctatccatgtaagcaatgtgggaaagccttcagatacgccagttcccttcagaaacacgagaaaactcatattgcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatgactataagcaataaggtaaagcattcaatttttccatttctttttgaaaacttgaaaggactcactgaagaaaatccatatgaatgtttaaaatgtggtaaggcctgcagttgttccagtggtatttgatggtataacataactcattctagagaaaaactttatgaaggtatcgaatgtgagaatgccttcatttatcctataactcactcagagacacatggtaacacatactccagattgaccttataaataaaagaatgcccaccagattgaaatcctagaaatacagaaaattctgaattttaacaattactttaaaggtcatgtgaaaactcccactggaaataaatcctgtaaatgtaaatattatggaaaaccttatggaaaataattatagtacaattctcaagaaaattcactatgtgaatgagatgttttaggagctataaataaattgaatatattggttgctcatttttgaagagagtctctagaatatagattttcacttcttttg

SEQ ID NO: 1200 - DNA, 348 bp, Homo sapiens
acatatcacatgtgccaatttcattgcaggtatgtaaataatcatagtggagagaaactctatgaatgtaatgaacgttctaaagccttttcatgtcccagtcatctccaatgtcataaaagaagacaaattggagagaaaacacatgaacataaccaatgtggtaaagcctttccaacacccagtcatcttcaatatcatgaaagaacccatactggagagaaaccttatgaatgtcatcaatgtggtcaagcctttaaaaaatgcagtcttctccaacgtcataaaagaacacatactggagagaaaccatatgaatgtaatcaatgtggtaaagcctttgcacaa

SEQ ID NO: 1201 - DNA, 295 bp, Homo sapiens
tatgaatgtaatcaatgtggtaaagcctttgcacaacacagtagtttaaaatgtcattacagaacacatattggagagaaaccctatgaatgtaatcaatgtggtaaagccttttcaaaacacagtcatctccaatgtcataaaagaacacatactggagagaaaccctatgaatgtaatcaatgtggtaaagcattttcacaacacggtcttctccaacgtcataaaagaacacatactggagagaaaccctatatgaatgtaatcaatatggtaaagcctttgcacaactcgg

SEQ ID NO: 1202 - DNA, 2040 bp, Homo sapiens
tgctctaaagcaaatgttatcactgagtcattgccatctgcagaatcagaacctgttgaaattgaggtagagattgccgaagccattgaagtggaagatgaaggcatcgaaacattagaggaagtggcttctgccaagcagtccgtaaagtacatacagagcacaggttcctctgatgattctgctctagcactgttggcagatattaccagcaagtaccgtcaaggtgacagaaaagggcagattaaagaagatggctgtccatctgaccccacgagcaaacaggtagaaggtattgaaattgtggaacttcagctgtcacatgtgaaggacttgttccattgtgagaaatgtaaccgttcatttaaattgttttaccattttaaggagcacatgaaatcacactccactgagagtttcaagtgtgaaatatgcaataaacgatatcttcgagagagcgcatggaaacagcacctaaattgttaccaccttgaagaaggtggagtcagtaagaagcaaagaactgggaaaaaaattcatgtatgtcagtactgtgagaaacagtttgaccattttggacattttaaagaacatcttcgaaaacatacaggtgaaaaaccttttgaatgtccaaattgtcatgaacgatttgctagaaatagcactctgaaatgtcacctcactgcatgccaaactggagtaggggcaaaaaaaggaaggaagaagctctacgaatgccaggtctgcaacagtgtgtttaacagctgggaccagttcaaagatcacttggtaatacacactggagataaacccaaccattgtactttatgtgatttgtggtttatgcaaggaaatgaattaaggaggcatctcagtgatgctcacaatatttcagagcgtctagtaacggaagaagttctttcagtagaaacacgtgtgcaaactgaacctgtaacatcaatgactattatagaacaagttgggaaggtgcatgtgctaccattgcttcaggttcaggtggattcagcacaagtgactgtggaacaagtccatccagatctgctccaggacagccaggtgcacgattcacacatgagtgagcttccagagcaggtccaagtgagttatctagaagtgggccgaattcagactgaagaaggtactgaagtacatgtagaggagctgcatgttgaacgggtcaatcaaatgccagtggaagtacaaactgaacttctagaagcagatttggaccacgtgaccccagaaatcatgaaccaagaggagagagagtctagccaagcagatgctgctgaggctgccagggaagatcacgaagatgctgaggatttagagaccaagccaacagtggattctgaagcagaaaaggcagagaatgaggacagaacagctctgccagttttagaatgaaattacacatgaatatatttttaaatttacttgttgggtttttgaactgattatgggcagtttgactgtccttaattaagcctaacagacaagtggaccaaagttaagctgtttcctgttgtgctgaactgttgtccgttgaaacacattgattcccctccccctacttattgccacagaggagggatcttttccataactgaaggggagttttgagaagtatatttctggaaacttaaatggattatattcttattatatagttgggtacgaatgtatctattttcattgtggtaaaagttcttccttttctctttcccaggtcatgttcttcctcaaattttttccatattgtaaaatcaaacttaaatcattagaatacaagtttatgtattctaatgcatgttagaaaattgaataatataggaaacacaaggctgcatgatgaaaagtgcattgttactgtgcagttaaattttggcttctggctttctttagtttgaacaaacgttcttgtctaccccagtagtcacagatgccatctttgcaacagaaagagtggtggtggcaaaatttctagaatgttctttagagcacactggggtaccggat

SEQ ID NO: 1203 - DNA, 3048 bp, Homo sapiens
gagccaatgaaagctcggaccagtggcaagtccgagctgtcattgagaggcgggacttccggcgccgccattgcggtcctcattttgctgctggtgggttgggctacagcaggcctctggagccacaccagggcacgggagtgggtgcagggaccgtcaccgcgccttcacacgcaccatagtgcccggctaattactctgcttttatgagccaaggtgttcccgaaagtggagccagcgccacgcgtctccagggtctccatacccagccttcgtccctgcggtgcccagaggccttgcgcgcattttgcatttgggaagacaggtcctgagtgcgaccgtcacccagcggaagtgtgagggttcggcccagcggcagggctagccctgggcctcctgttatggccctgcccagcccacaggttctaatggggttgccagcgttgctgatgggcccggcgcagcatacttcttggccctgtggctcagctgtccccacattgaagagcatggtaacctttgaagatgtggctgtatacttctcccaagaggagtgggagctccttgatgcagcccagaggcacctgtaccacagtgtgatgctggaaaaccttgagcttgtgacctcacttggttcttggcatggagtagagggtgagggggcccatcccaagcagaatgtttctgtagaagtgttacaggtcaggatccctaatgcagatccttccaccaagaaagctaactcctgtgacatgtgtgggccattcttgaaagacattttgcacctggctgagcatcagggaacacagtctgaggagaaaccctacacatgtggagcatgtgggagagacttttggttgaatgcaaaccttcaccagcaccagaaggagcacagtggagggaagccctttagatggtacaaggacagggacgcacttatgaagagctctaaagtccacctgtcagagaaccccttcacttgcagggaaggtgggaaggtcatcctgggcagctgtgacctcctccagcttcaagctgttgacagtgggcagaagccatattccaatcttgggcagcttccagaagtctgtaccacacagaaactcttcgagtgcagcaactgtggaaaagccttcctgaagagctccactctccccaaccatctgagaactcactctgaagagataccatttacatgcccaacaggtggaaatttcttagaggagaaatcaatccttggtaataaaaagtttcacactggggaaataccccatgtgtgtaaggagtgtgggaaggcctttagtcactcatctaagctgaggaagcaccagaaatttcacactgaagtaaaatattatgagtgcattgcatgtgggaaaaccttcaaccacaaactcacatttgttcatcatcagagaattcactcaggagaaagaccttatgagtgtgatgaatgtgggaaagccttcagtaacagatcacacctcattcggcatgagaaagttcacactggagaaaggccttttgagtgcctgaaatgtggaagagccttcagccaaagctccaatttccttcggcatcagaaagttcacacacaggtaagaccttatgagtgcagtcaatgtggtaaatccttcagccgaagctctgctctcattcagcactggagagttcacactggagaaagaccgtatgaatgcagtgaatgtggaagagcttttaacaataactccaaccttgctcagcaccagaaagttcacaccggagaacggccttttgagtgcagtgaatgtggaagagacttcagccaaagctcccatctccttcgacatcagaaagttcacactggagaacggccttttgaatgctgtgattgtggtaaagccttcagtaatagctccaccctcatccagcaccagaaagtacatactgggcaaaggccttatgagtgcagcgaatgtaggaaatccttcagccgcagctccagcctgattcagcactggagaattcacactggagaaaagccttacgagtgtagtgagtgtgggaaagcctttgctcacagctccactctcattgaacactggagagttcacacaaaagaaaggccttatgagtgcaatgaatgtgggaaattctttagccaaaactccattctcattaagcatcagaaagttcatactggagaaaagccttataaatgcagtgaatgtgggaaattctttagccgaaaatccagccttatttgtcactggagagttcacactggagaaaggccttacgaatgcagtgaatgtgggagagcctttagcagtaactcccacctggttcgtcatcagagagttcacacacaagaaaggccctatgagtgcatccagtgtggaaaagcctttagtgaaagatctacacttgttcggcaccagaaagttcacaccagagaaaggacttatgagtgtagccagtgtgggaaactcttcagccatctttgtaaccttgcacagcataaaaagattcatacctgagtggagccttatggaagtggtctttgtgagaaaatcttcagccaagtcaaacttcatgcagcagaatccccataccagaaaaattacctacatgtactgctaatgtggaaaagccttcagaagctactctgtttctgaccagcccaggaacctttgcagggccatctcacccatgcagcataaggcagaagccatagtcactttccatcttgcctggatccaaaaatttgcagcagtcctgtcctcatgcatggggaaaacagtaccctgagccttccttcctgtgttctctagggattcaggactgtgctcagctgaaccgatgctggttgaggggccttgagggaaatctaatttgagctcaggaagatgcacattccttgtggatgtggtcaagtctgtgtttaacccctaagatgtgtccattgaggccacaaatcaccctccactggaatcacctaccttgcctgcactaactggtgataataaagaccttattgatcaggtcaaaaaaaaaaaaaaaaaa

SEQ ID NO: 1204 - DNA, 2718 bp, Homo sapiens
cgccgagcatcctgggaggtgtggtccgggcgctgtgccgaggattcggggtagtgtagtcctggcgccccgctggaggagctccccagctggtggctggagcgaccccttgttctttggtggcgctgatctaccttctgagatatcatccttcttcagggagataaggaaaaaaagccacagggtcccggagagccaggggaatgcttcaaaagttctgctgcctgagagtaacgtcacagtaatggaacgggaagattctggaatctgtgtccccacctagacaacgattatactggcaggatctatcaggtgtacctattttggaactctggagtctagttgaaggcctccagttcccagggggaaggaagcatggaggtgtgtcctccatttggaagtagtgctaagaaaattaaaagaataaaactgggcaggggcatgagaataggatgcaaagatgaatttttggactgagtggccaagaagctccatggtgagcactcacagtctaaggctggaagtttaatgaactgttttctacatttcacaggcacacatggcattcagggatgtggctgtggatttcacccaggatgagtggaggctgctgagccctgctcaaaggactctgtacagagaggtgatgctggagaactacagcaacctggtctcactgggaatttcattttctaaaccagaactcatcacccagctggagcaagggaaagagacctggagagaggaaaaaaaatgttcaccggcaacctgtccagatccagagccagagctctacctcgatcctttctgccctccgggtttctccagtcagaaattccccatgcagcatgtgctgtgtaatcatcccccctggatcttcacatgcttgtgtgcagaaggtaacatccagcctggggatccgggcccaggggaccaggagaagcagcaacaagcctctgaggggagaccctggagtgatcaagcagaaggtcctgagggagaaggtgccatgcctttgtttggaagaaccaagaaaaggactctgggagcgttctccaggccaccccagaggcagccagtcagctctcggaacggcctcagaggggtggagttagaagccagcccagctcagacagggaaccctgaggaaacagacaaattgttgaagaggatagaagtcttaggatttggaacagtcaactgtggagagtgtggactgagcttcagcaagatgacaaacctgctcagtcaccagcggatacactcaggggagaagccctacgtgtgtggggtatgtgagaagggcttcagcctaaagaagagcctcgccagacaccagaaggcacactcgggggagaagccaattgtgtgcagggagtgtggacgaggctttaaccggaagtcaacgctaatcatacacgaacggacacactccggtgagaaaccttacatgtgcagtgagtgtgggcgaggcttcagccagaagtcaaacctcatcatacaccagaggacacactcaggggaaaagccttacgtgtgccgggaatgtggcaaaggcttcagccagaagtcagctgtcgtgagacaccagaggacacacttggaggagaagaccatcgtgtgcagtgactgtggcctgggcttcagcgacaggtcaaacctcatctcccaccagaggacgcactctggggagaagccctacgcctgcaaggagtgtgggcgatgcttcaggcagaggaccacccttgtcaaccaccagaggacacactcaaaggagaagccctatgtgtgcggggtgtgtgggcacagcttcagccagaattcaaccctcatctctcacaggcggacacacactggggagaagccgtatgtttgtggggtgtgtgggcgaggctttagtctcaagtcacacctcaacagacaccagaacatacactcaggagagaagcccattgtgtgcaaggactgtggccggggcttcagccagcaatccaacctcatcagacaccagaggacgcactcaggcgagaagcccatggtgtgtggggagtgcgggcgaggcttcagccagaagtcaaaccttgttgcacaccagaggacgcactcaggggagaggccgtatgtgtgccgagagtgcgggcgaggctttagccaccaggccggtctcatcaggcacaagcggaagcactcgagggagaagccctacatgtgcaggcagtgtggactgggctttggcaataagtcagctctaattacacacaagcgggctcactcggaagagaagccttgtgtgtgcagagagtgtggccaaggctttctccaaaagtcacacctcaccttacatcaaatgacacatacgggggagaagccatatgtgtgcaagacgtgtgggcggggcttcagcctcaagtctcacctcagcagacacaggaagaccacgtctgtccaccacagactgccagtgcagcccgaccctgagccgtgtgcagggcaaccttcggattccttatactctctctgaaggcaaagatggggacaaggactaagagtcagaatgttgacactttgatgaaatggagtagagaaatgcattctgtaagtggtcaaaggacatttgactgtttactttctccacactaagtcttctccatgttttgtggccttcggttgtaataaacttggcttctttatacatctgtaaaaaaaaaaaaaaaaaaa

SEQ ID NO: 1205 - DNA, 2248 bp, Homo sapiens
cgaactgtgatggcggcggccgcggtgatgggcccggcgcagatcctctgtggttgttgaattgtaacaagagagagaactctggctgcctgagagggcatgactctagtcacagcaggaggggcttggacaggccctggttgttggcatgaagtgaaggatgaagagtcatcttctgaacagagcatttctatagcagtgtcacatgttaatacttccaaggcaggtttgcccgcacagacggctctcccttgtgacatatgtggccccatcttgaaagatattttgcacctggatgaacaccagggtacacaccatggactgaaacttcacacatgtggggcatgtgggagacaattctggttcagtgcaaaccttcatcagtaccagaagtgttacagtatagagcaacccttaagaagggataaaagtgaggcctcaattgtgaagaactgcacagttagcaaagaacctcatccgtcagagaagccctttacgtgtaaggaggagcagaaaaacttccaggctactttgggtggctgccaacaaaaggccatccacagtaagaggaagacacacaggagcactgagagtggggatgcatttcatggtgaacaaatgcattacaagtgcagtgaatgtgggaaagctttcagccgcaaagacacacttgtccagcaccagagaattcatagtggagagaagccttatgagtgcagcgaatgtgggaaagccttcagccgcaaagctacacttgtccagcatcagagaatccatactggagaaaggccttatgaatgcagcgaatgtggaaaaaccttcagtcgaaaagacaaccttactcagcacaagagaatccacactggagaaatgccttataagtgcaatgaatgtgggaaatattttagccatcactccaatctaattgtacaccagagagttcacaatggagcaaggccttataagtgcagtgattgtgggaaagtcttcagacacaaatctacacttgttcagcatgagagtattcacactggagaaaatccttatgattgcagtgattgtgggaaatcctttggccacaaatacaccctcattaaacatcagcgaattcacactgagtcaaagccgtttgagtgcattgaatgcgggaaattctttagtcgaagttctgactatattgcacaccagagggttcacactggtgaaaggccttttgtgtgcagtaaatgtgggaaagactttatcagaacctcccaccttgttcgacaccaaagagttcacactggagaaaggccatatgagtgcagtgaatgtgggaaggcctacagcttaagctcccacctcaatcggcaccagaaagttcacactgcaggcaggctttaggagtgctttgaatacaacaggactcatcaatcagatgttgaatttcatgtatctgaacattgacacaaaggagataccttatggtgccaggtacgtgggaaccttctagggatatgttgcactttctgacttgctcaggttttttgccagagttatgtcactgtcaatccatgtggccgaaaccatcttaactctaccagctaagataccccagcattggggaaggcagggttttgtattgtccagtccctggagaaaatcatgaaatgcctgagttcattgggggtcctcattcccttctgtatgacaggtataggtatggatatgacccatttttagccaagagggtctgagctgtatctgctggtggcttatacaaaaagtttactttcttcatggatattcttggtctcacatacttgtaatcaagtttttccagcctccaagtcacctggcctgggaaagtacttgcctcatgttgctctggtttgtgataataaaggctttacagtttaagccacatttaatcttggggcttcttcttatggtctggggtggattgaaaacaggctctgccaaactgaagacagcctttgtgcggtgcctccaactttgcctcaaatgggacagtgggttgagggagaacagttcttagtccagttttgatgttaacttccatagctgacaaagcttgttaagtaagaattaagatcttgtgtagacctgatttgtctggattttagagttatttgagagcccatatttcaccttgaggagggtgctgctgctgtgacagcctgcagtgttttgaaacagcatggattgggtgtcttgtttgcagcatgtgtcccatgttccccaacac

SEQ ID NO: 1206 - DNA, 3408 bp, Homo sapiens
gaaatggagttaggctcgcgccggcgcagtgtcggctgccggtgccgcggcctttgtctcgcagtcaggaggggccagccgttcctgccagaagccagggcatgacccctggggtgcgcgtctccacagacccggagcaagtgacgtttgaggacgtggtagtgggcttcagccaggaggagtgggggcagctgaagcctgcccagaggaccctgtaccgtgatgtaatgctggacaccttcaggcttctggtctctgtgggacattggttaccgaagccgaatgtcatctccctgctggagcaagaggcagagctgtgggcggtggagtctagacttccccaaggcgtgtacccagagattaagggacatttccagtttttgcttctttcagacttggaaactagacccaaagtcaaactgtcagttctaaagcaaggcatctctgaagaaatatccaacagtgtcatcttggtagaaagattcctgtgggatggtctgtggtactgcaggggtgaggacactgagggccactgggaatggagttgtgagagtctagagagcctggcagtgccggtggccttcacgcctgtgaagacgcctgttctggagcagtggcagaggaatgggtttggggaaaacataagtctgaaccctgatctcccacatcaaccaatgactcctgaaagacaaagcccccacacatggggaacacgtggaaaaagggagaagccagacctaaatgttttacagaaaacctgtgtaaaagagaaaccctacaaatgtcaggaatgcggaaaggcctttagtcacagctcagcacttatcgaacaccaccggacgcacacaggagagagaccttacgaatgtcacgaatgcttaaaaggcttccggaacagctcggcacttaccaaacaccagagaatccatactggggagaaaccctataaatgcactcagtgtgggaggaccttcaaccaaattgccccactgatccagcaccagagaactcacacaggtgagaagccctatgaatgcagcgaatgtgggaaatccttcagttttaggtcctccttcagccagcacgagcgaactcacacaggcgagaagccctacgagtgcagtgagtgtgggaaagccttccggcaaagcatccacctcacccagcatctgcgaatccacactggggagaaaccctatcagtgtggtgagtgtggcaaggccttcagccacagctcatccttgaccaaacaccagcgaatccacacaggggagaagccctacgagtgccatgagtgtggaaaagccttcacccagatcacaccactgattcagcaccagaggacccacacaggagaaaagccctatgagtgtggtgagtgtgggaaagccttcagtcagagcacactcctgaccgagcatcggaggattcacacaggagagaagccctatggatgcaacgagtgtgggaaaaccttcagccacagctcctcactcagccagcatgagcggacacacacaggagagaagccctatgagtgcagtcagtgtgggaaggccttccggcagagcacacacctcacccaacaccagcgaatccacacaggggagaagccctatgaatgcaatgactgcggcaaggcattcagtcacagctcgtccctcaccaaacatcagcgaatccacactggggagaagccctacgaatgcaaccagtgtggcagagccttcagccagcttgctcccctcattcagcatcagaggatccacacaggagagaaaccctatgaatgtaaccagtgtggcagagccttcagccagagctcccttctcatcgaacaccagaggattcacaccaaggaaaagccgtatgggtgcaatgagtgtgggaaatccttcagccacagctcctcgctcagccagcacgaaaggacgcacactggggaaaagccctatgagtgtcacgattgcggaaagtcctttaggcagagcacccacctcactcagcaccggaggatccacacaggagagaagccatatgcatgcagggactgtggaaaggcctttacccacagctcctcccttaccaagcaccagagaactcacactggataaacccactccacatgtgctggggacataggaagaccttaagccatagctcatccctttctagatttgacccaatcatacacatgagaaacgtacattcatacacaagccttttcacacagcactcccctcagacaccctcagagagttcacactgatgggaaatgaccatgggaccaccaagctctaggtcatccatctctgcatccaaatagtagggaaacgtggagataatcaacactcaggaccttcagccttgaacgcccattagtgctatgttatagaacctacaaaaaagaaatggaacaaatgtagtggatccagggaacgcttttgtccaaggattcaccgtattccaaaccagagatgttcaaattggtgagaaacccaacaaatgcctttcatatatacgagaaccaaatgaagtcagaatttgccattattgcacatcacatttttgggggggaaagtgcttatgaatggtgcaggttgactctgatattcattcccaaatgacagtatggcagagtgttccagaaatgagagtggcatctttatggaatcactgtggatactgactgtctcagtaaacagctgtcttgtctgtgtgtatattgtttgatcagggtacatggcagccagtcacagattggaattacatatgacaaagtatcagtgtactataaacaggtttttagttatccctgcattatttttgcaattaatctttatatgcaatgagattgaaaagctttgtatgggaagactcaaaatgtaaagctgcttccgtagagtctcactgattctgagatggcttttgctgctctgttctccctctacatttctctgcagaactcgcgttagaaacacagatatttgttttacaaaaagggagatttttcctttgttaaaccatcgtcttataagcaatagcaaattcatgttagaaacttctgttttgcaagattcatcttttttgggatatgttcaagttaatcctctcaaactgctttttcattgttttcatacaatttaacattttgttaaaccctaagtccacaaatagcagtctttctgacaactataacctttaaatggtgacttgctgccctcattagaaattgcattggctggccaggcgcggtgacttatgcctgtaatcccagcactttgggaggccaaggtgggaggatcacctgaggtcgggagatggaggttgcagtgagctgagatcgtaccattgcactccagcctgggcaacaagagtgaaactctgtctcagaaaaaaaaaaaaaaa

SEQ ID NO: 1207 - DNA, 2988 bp, Homo sapiens
cagaggcccagagtggctcgcctggagtctctgtggcgcggtttcctgtacctgccttgggatccggagggaggaagctgggacacccgggagtcaggaaatggactcggtggcttttgaggatgtagatgtgaacttcacccaggaggagtgggctttgctagatccttcccagaagaatctctacagagatgtgatgtgggaaaccatgaggaatctggcctctatagggaaaaaatggaaggaccagaacattaaagatcactacaaacaccgagggagaaatctaagaagtcatatgttagaaagactctatcaaactaaggatggtagtcagcgtggaggaatttttagccagtttgcaaatcagaatctgagcaagaaaatccctggagtgaaactctgtgaaagcattgtatatggagaagtcagcatgggtcagtcatcccttaatagacacatcaaagatcacagtggacatgaaccaaaggaatatcaggaatatggagagaagccagatacacgtaaccagtgttggaaacccttcagttctcaccactcctttcgaacacatgagataattcacactggagagaaactctatgattgtaaggaatgtggaaaaaccttcttttctctcaaaagaattagaagacacatcatcacacacagtggatatacaccatataaatgtaaggtgtgtgggaaagcttttgattatcccagtagatttcgaacacatgaaagaagtcacactggagagaaaccctatgaatgtcaggaatgtggaaaagccttcacttgtatcacaagtgttcgaagacacatgataaagcacactggagatggaccttataaatgtaaggtatgtgggaaaccctttcattctctgagttcatttcaagtgcatgaaagaattcacactggagaaaaaccctttaaatgtaagcaatgtggtaaagccttcagttgttccccaaccttacgaatacatgaaagaacccatactggagagaaaccttatgaatgcaagcagtgtgggaaggccttcagttatctcccctcccttcgactacatgaaagaattcacactggtgagaaacccttcgtatgtaaacaatgtggtaaagcctttagatctgccagtacctttcaaatacatgaaaggactcacactggagaaaaaccttatgaatgtaaggaatgtggggaagcattcagttgtatcccaagtatgcgaagacacatgataaaacatactggagaaggaccttataaatgtaaggtatgtgggaaaccctttcattctctgagtccatttcgaatacatgaaagaactcacactggagagaaaccttatgtatgtaaacattgtggtaaagctttcgtttcttcaacatcaattcgaatacatgaaagaactcatactggagagaaaccctatgagtgtaagcaatgtgggaaagccttcagttatctcaactcctttcgaacacatgaaatgattcacactggtgagaaaccctttgaatgtaagcgatgtggtaaagcctttagatcttctagttcctttcgactacatgaaaggactcacactggacagaaaccctatcattgcaaggaatgtgggaaagcctattcttgccgtgccagctttcagagacacatgttaacacatgctgaagatggaccaccttataaatgcatgtgggaaagcctttaatgctctgggttcatgtcagatacattaaaatactcactgaagagaagccctatgaatgtaagtaacgtgggaaagcatgaaattctgtcagtgccttttttaatacatgaaagaattctagagagaagccatatacatgtaagtaacatgggaaagctttcaatcattttagttcctttcaaatacatgaaagaactcatcatggagaaaaccaaacaaatgctttttggaaaggaacccatatttgagagaaaccctgggtaaagggtgtaggaaaggttttgtcatcacacaaccctgtcacacatgaatgtgtagtggagagaaccttggtaaatgtaaagagtgtgggagagcctttagtcattttagttccacttgaagccatgaaagaacacacaaaagagaaagctcttgaatataagcaatgtccacacgtttttagccagcccacatgctttcaacaacatgtaagaatgtaccctggatcaaaacactataaatgtgaaaactacaaggaaggttttccattatacttttaaagtcatttgagggctctggctctgtggctttgtgggttaaagtacttgtctggcaaacaggagatgctggatttcaatcccagcagggcctcactagttgaggtattgaatttgaacagatgttttggctctggctgggtgtggtggctcacacctgtaatcccagcactttgggaggctgaggcaggaggatcacttgaggtcaggagtttgagaccagtgtgcaaaacatagcaagacctcatctcagaaaaaaaaaaaaagtcatttgaaaacttctaatacagcaaaatcctataaatgtaagtacttcaaaaagcctcatgcatagcgggtcatgtagtctctagaaaatacataacctgatggaaatgtagaagctatatgtatattttgttaattagtggctcatatttaaaatagttctctgactatggatttcaaatgcttaatctcacaaagaaatgttaaattgatataatcctgtaagtaatctgaaagcaatagtgcatgaatttcataggtagtgttgttttaggtcagtaaataaaatatttgtctttccattttgaaatgtgtttaatccaacaatgaatttaaatgtgtttctcatattcaggtatgttaaattgtatatggttgcttaattgttctgtgattgaggaccactgaaaaataagtcttaataaatgttggtatgaacctaaaaaaaaaaaaaaaaaa

SEQ ID NO: 1208 - DNA, 2501 bp, Homo sapiens
tggagagaaccttacacatttcacgagtatggaaagacctttgctcaaaattcagcccttgtaatgcataaggcaattcatactggaaagaaaccttacacatgtaatgaatgtggcaaggtttttagtagaaaagcacaccttgcatgtcatcatagacttcatactgtctaaggtttctaatcaacaatcaaaccttgcacaacatcagagagtttatactggagagaaaccttacaagtgtaatgagtggggcaaagccttaagtgggaagtcgtcacttttttatcatcaagcaatccatggtgtagggaaactttgcaaatgtaatgattgtcacaaagtcttcagtaatgctacaaccattgcaaatcactggagaatccataatgaagacagatcttacaagtgtaataaatgtggtaaaattttcagacatcgatcatatcttgcagtttatcagcgaactcatactggagagaaaccttacaaatatcatgactgtggcaaggtcttcagtcaagcttcatcctatgcaaaacataggagaattcatacaggagagaaacctcacaagtgtgatgattgtggcaaagtcttgacttcacgttcacacctcattagacatcagagaatccatactggacagaaatcttacaaatgtcttaagtgtggcaaggtcttcagtctgtgggcactccatgcagaacatcagaaaattcatttttgagataactgttccaaatacagtgactatagaagatcataaagctttaattgacattagagccaaataggcattgacttgagattgagttgacttaaccttgagtttaagaattaatttacattaaagtgtttatgttaagaagattgggccaggtgggattacaggcgcgagccaccgcgcccggcccctaagttaatatttcaaacaatcgaaggtaaaacaacatattgtgttgggccacctgtactgaacgctgaatcgtttttcctcttaagttgaaaatggttttaatgcaaagcgccttttttgagcaggtagagtcacgcatccggcaggcggggcgagctcccctctgtctggggcagggtgggggagaggggcagggacctcggtaaaggggtggagtggcgcgctggttgccgcgggcactggcaattagaagggattattaaactaagcaaggtcctgggttgtttgagtggataatggaaactgaaaggtgacgtgcaaaactgcctattactcccaggagtggaggataatttcatatttcatggaaataaactcagggcccggagcggtggctcacacctgtaatcccagcactttgagaggccaaggagggaggatcgcttaagcccaggaattcgaaatcagcctaggcaacatagtaagacctcatctctactaaaaataaaaaaaaacagccaggtgtgttagtccacacctgtggtcccagctgcttgggcttcccgagtagctgggattacaggtatgaaccactatgcccggctaactttgttttttttttttagaaattaaaccttttttcagcttaatgacccaggggtgtatttttgaaggacttgggagctctctttgaaaggcaaacaacaagggaaacagtacctttatctcagtaggaaattaaataattcaaacatcaaataacttcaatttaaggctatggactttgagataattctgagccttgagaggaatgtggtcaggcaacctgagtccagtggaatgcaggtgcaacttctaagagttttcctgtaagtaattaagaagactaagtagccccagagataagacctcctcggatcattgtcccttcttatgtagtgataaagtaaccttccttgaagtgtatctatccgtaatcaatcaagttgctgcagcctatgcactggcccagaataaaaaacgtggtgattctgctaaagcttctctgtctttccctgtgtgtgaaatcttaacgtctctacttgggaacgctgatcccattcatttagagttgatgtttccacgtggctatttccaagctttgccttcaaataaattctgtacttaatcatatattctaaattttattatttactgctgacatcagtttctgtcggattgtaggagcctcaccagagagggcccctgtcgccatgttgtaaaactcacacttgccaaaagttgtgggttagggtttctccccctccctcaggatgacgctagttagctgacacagatggtcacctccattaccaagtagagtcaggatgaactatgtgtgactgttcaactatgtgtcctcttccctgaggactgattagtgtttatcttgaaaacatgtccttaatgggttgtatagaacactgaagcatctgatttcaaactcttagctcttttcctctatttcccatcacattctggtctaaggcttatttattaataaaatgatttttatttctttattaaaaaaaaaaaaaaaaaa

SEQ ID NO: 1209 - DNA, 720 bp, Homo sapiens
ctaaagggctagagcagaacataaaagattctttccaaaaagtgacactgagcagatatggaaaatatggacataagaatttacagttaagaaaaggctgtaaaagtgtggatgagtgtaaggaacaccaaggaggttataatggacttaaccaatgtttgaaaattaccacaagcaaaatatttcaatgtaataaatatgtaaaagtcatgcataaattttcaaattcaaatagacacaagataagacatactgaaaataaacatttcagatgtaaagaatgtgacaaatcactttgcatgctttcacgcctaactcaacataaaaaaattcatactagagagaatttctacaaatgtgaagagtgtggaaaaacctttaactggtccacaaacctttctaaacctaagaaaattcatactggagaaaaaccctacaaatgtgaagtatgtggaaaagcctttcaccaatcctcaatccttactaaacataagataattcgtactggagaaaaaccctataaatgtgcacactgtggcaaagcctttaaacagtcctcacaccttactagacataagataattcatactgaagagaaaccctacaaatgtgaacaatgtggcaaggtctttaagcagtccccaacccttactaaacatcagataatttatactggagaggaaccatacaaatgtgaggaatgtggcaaagcttttaacc

SEQ ID NO: 1210 - DNA, 2967 bp, Homo sapiens
agtgcggacgtcgccattcctggcccatgggaagattgcgtttcacctgctcctgaaggccgaaggtggctctagcgcatcctttgtcgcgccgtgacctgcaggtactgacagatccgtagggaggacaccgtgacttcccggacgctgggaaatggactcagtctcctttgaggatgtggccgtgaacttcaccctggaggagtgggctttgctggattcttcacagaaaaagctctatgaagatgtgatgcaggagaccttcaaaaacctggtttgtctaggaaaaaagtgggaagaccaggacattgaagatgaccacagaaaccaggggaaaaatcgaagatgtcatatggttgagagactctgtgaaagtagaagaggtagcaaatgtggagaaaccactagccagatgccaaatgttaatatcaacaaggaaacttttactggagcaaaaccacatgaatgcagcttttgtggaagagacttcattcatcattcgtcccttaataggcacatgagatctcacactggacagaaaccaaatgagtatcaggaatatgaaaagcaaccatgtaaatgtaaagcagttgggaaaaccttcagttatcaccactgctttcgcaaacatgaaagaactcacactggagtgaagccctatgaatgtaaacagtgtgggaaagcctttatatattaccagccatttcaaagacatgaaaggactcatgctggacagaaaccctatgaatgtaagcaatgtggaaaaacctttatatattaccagtcttttcaaaaacatgctcatactggaaagaaaccctatgaatgtaaacagtgtgggaaagcctttatatgttaccaatcttttcaaagacacaaaaggactcacactggagagaaaccctatgaatgtaagcaatgtggtaaggctttcagttgtcccacatactttcgaactcatgaaagaactcacactggagaaaaaccctacaaatgtaaagaatgtggtaaagccttcagttttctcagttcttttcgaaggcataaaaggactcatagtggagagaaaccctatgaatgtaaagaatgtggaaaagccttcttttattctgcaagctttcgagcacatgtaataatacacactggggctcgaccttataaatgtaaagaatgtgggaaagccttcaactcttctaattcctgtcgagtgcatgaaagaactcatattggagaaaaaccatatgaatgtaaacgatgtggcaaatcattcagttggtccatttctcttcgattgcatgaaagaactcatactggagagaaaccttatgagtgtaaacagtgtcataaaaccttcagtttttcaagttcccttcgagaacacgaaacaactcacactggagagaaaccctatgaatgtaaacaatgtggtaaaaccttcagtttttcaagttcccttcaaagacatgaaaggactcacaatgcagagaaaccctatgaatgtaaacagtgtgggaaagccttcaggtgttcaagttattttcgaattcatgaaaggtcacacactggagagaaaccctatgaatgtaaacagtgtggaaaagttttcattcgttccagttcctttcgactgcatgaaagaacacacactggagagaaaccctatgaatgtaaactatgcggtaaaaccttcagtttttcaagttcccttcgagaacatgaaaaaattcacactggaaataagccttttgagtgtaagcaatgtggtaaggccttccttcgttccagtcaaattcgattgcatgaaaggactcacactggagagaaaccgtatcaatgtaaacaatgtggaaaagccttcatttcttccagtaaatttcgaatgcatgagagaactcacacgggagagaaaccctatcgatgtaaacaatgtgggaaagccttcagattttcaagttctgttcgaattcatgaaaggtctcacactggagagaaaccttatgaatgcaaacaatgtggaaaagccttcatttcttccagtcactttcgactgcatgaaaggactcatatgggagagaaagtctaagaatataagcaacattctgaagccttcggttgttccagctccttctgaatacacaaaagagttcatactggacagaagctgtgtgaatacaaacattgttctaaagcccttaattgttccagtttcttttgagcacgaaagaattcccactggtgagaaacagtatgaatgtaaacattgtgattaagccttcagttgacctaattcatttcaaagacaggactcgtgctgcagtgaaatctgttttgttttttgttttttgtttttttaaaaaaggccaagcttgttggctcatgcctatagtcccagcactttgggaggccaaggtgcaaggcaggcagatcatttgaggtcagaaattcgagaccagcgtggtcaacatggtgtaaccccatctctactaaaaattaccaaaaaatgaaccaggcatggtagtgcatgcctctaatcccagctactcaggaggctaaggcaggagaatcacttgaacctggagacagaggttgcagtgagctgagatcacgccactgcattccagcctgtgcgacagaatgagacactgtctcaagaaaaaataaaagtgggaaaatcttccaactgtcctctagagtgtgaatatatgaaaggagtcagagtggggtgaaagtctataaatgtaagacatttgggaaagccttcacacagccttttgagcacacatgagaatgtatactggagagaaaccctataaatattaagaatgtgggaaattcttcatcctagttcttttgttgttgttgatgatacaaaaatattttcatttaataaagattgtcaggttatatttaataagaaagaaagtatcatgtaaacagcccagtaataaaattttacaatcttaaaaa

SEQ ID NO: 1211 - DNA, 3067 bp, Homo sapiens
ttgtttctgggaagtgtggtggcctgagttccacgttcttcgtttctccgctagttgtgcgcttggccgcgagacactctggcagttataggaacacaaaggtctgtgtactcttccgcggggggccgcggttatttctgggaaatgtagttgcctaggacccgggttctttgtttctcggctctgggcgtgggaggatagcccctatgctctggcgcaccgggccgcgatggctctgggaattgtagttgtcgcaggccctcgttctttgtctcctggcgttctgggcacggcagcgaggcgctctgggagttccagtaggaacgaaaagcccttgcgcgcagggccgcattggtttctgggaattgtagtttcttgaggccggcggcctggttggggtgacgtcggcgaggcttctgaagacgcaattcctgcgacgcccgcggaggggccctggggggcggcgccgagcgtctggcctgtgttggctgtaggcaacgaaaggagccctcccggtctgcgccggatggccccgggcggtgactcggtccggagccctggaacgctacgcccacctggcggaaagcaccacggaaacgcatccttctgtggccactgttaggtctgccattttacacttttctgatctcctccttcccttctgtgagctatgtctcaggggtcagtgacattcagagatgtggccatagacttctcccaggaggagtggaaatggcttcagcctgctcaaagagatttgtacagatgtgtaatgttggagaactatggccatctggtctcactgggtctttccatttctaagccagatgtggtttccttattggagcaagggaaagaaccctggctggggaaaagggaagtgaaaagagatctgttttcagtttcagagtcaagtggtgagatcaaagacttttcaccaaaaaatgtcatttatgatgactcatcccagtatttgatcatggaaagaattctaagtcaaggccctgtgtattccagttttaaaggaggctggaaatgcaaggatcatactgagatgctgcaagaaaatcagggatgtattaggaaagtaacagtctctcatcaagaagccctggctcaacatatgaatatcagtactgtggagaggccctatggatgccatgaatgtggaaaaacttttggtcgacgcttttccctggtgttacaccagaggactcatactggagagaaaccatatgcatgtaaggaatgtggcaaaacctttagccagatttcaaaccttgtgaaacaccaaatgatacatactggaaagaaaccccatgagtgtaaggactgtaataaaacattcagttacctttcatttcttattgaacaccagagaacgcacactggggagaaaccttatgaatgtactgagtgtggaaaggcctttagccgtgcctccaacctcactcgacatcaaagaattcacataggaaagaaacaatatatatgtaggaaatgtggtaaagcatttagcagtggctcagaactcattcgccaccagattacacatactggagagaaaccttatgaatgcattgaatgtgggaaggcatttcgccgtttctcacaccttactcgacatcagagcatccatacaaccaaaaccccgtatgaatgtaatgaatgtaggaaagctttccgttgtcactcattccttattaaacatcagagaattcatgctggagaaaagctctatgaatgtgatgaatgtggtaaagttttcacttggcatgcatcccttattcaacatacgaagagtcacactggagagaaaccctatgcgtgtgctgaatgtgataaagccttcagccggagcttttccctcattctacatcagagaactcatactggagagaaaccctatgtatgtaaggtatgcaacaaatccttcagctggagctcaaaccttgctaaacatcagaggacacacactcttgacaacccctatgaatatgaaaattcatttaattaccactcattccttactgaacaccagtgaatttacactgcaaagaaaaactatgaatgtatggaattttttaaaaagaagtataatgccttacttcagagaactcttggaaagaagccttatgtgaaagtgatgactgtgaagtaatatggcccacactttattcaccaccctggagaaaaaaaaacccaggaatatgtggaaaagccattaataaccactcttttatttttttgcaataacaaggtgaaatcaatattgttgagaagattcttccatctggtaatgttgagaagacttcatttggtaggagtcccttactttacgtgtgtaaattcctaccaggaaagaatacatatccaatagattggagaaagccagagattagccctcattccgcatctgtcaaccaggacagaaagcatggacaagggatgagctttacaaagatgatgcactttggagatcagaaaattcatatttaagcaaagtgatacaaacacagtgatttgggaatgccttcatttacaatgcaatacttacattttaatactcttgtaggagaaaaagcaactgtataaatgaatgtagagtgactttctgcaatatttcaaacctatatcagagaattacactgtgggaaaactaccattgtaataagtgtagcaaaatctccttagatatctgaaaagtcatactggatggaatctgtaggaaacggttctattttgagggaagggggattcctttttgttttttaagtgaattcagaaaatgttataaataaatcttttggtttattataaaccttctgcttgctgattttttcccacagcatgtgattctgaaaatgtaactacaatattgacataaaaaataaacagtagtttttcttgttgaaacatacaaacataacaaagtgtttttaggtgttttatgattttaactttcagacagagtttggatttaaggtaatgctgacagttatccttgaatctgactatagacatttgttattcagtgtgaaacaaatataagatacatcacagaaaa

SEQ ID NO: 1212 - DNA, 1643 bp, Homo sapiens
ggcgcgggtctttgcgtctggctactaccagaccgcgggttaggggcttcatctctctgcgttctcagttgtgggaggccttggtgattcggccacagcctcagcctccgtcgctctgtgacctgcgggtattggatgattggtagctaagactcccgaatacttcagaagtggggaaatggaactcttaacattcagggatgtggccatagaattctctccagaagagtggaaatgcctggaccctgaccagcagaatttgtatagagatgtgatgttggagaactacaggaacctggtctccctgggtgttgctatctctaacccagacctggtcacctgtctggagcaaagaaaagagccctacaatgtgaagatacataagatcgtagccagacccccagctatgtgttctcatttcacccaagaccattggccagtgcagggcatagaagattcattccacaaacttatactgagaagatatgagaaatgtggacatgataatttacaattaagaaaaggctgtaaaagtttgaatgagtgtaagttgcagaaaggaggttataatgaatttaatgaatgcttgtcaactacccagagcaaaatacttcagtgtaaagcaagtgtcaaagttgttagtaaattttcaaattcaaacaaacgtaagacaagacatactggagagaaacactttaaagaatgtggcaaatcatttcagaagttttcacacctaactcaacataaggtaattcatgctggagagaaaccctacacttgtgaagaatgtggcaaagcctttaaatggtctttaatatttaatgaacataagagaattcatactggagagaaaccttttacttgtgaagaatgtggcagcatctttaccacatcctcacactttgctaagcataaaataattcatactggagaaaaaccctataaatgtgaagaatgtggcaaagcctttaataggttcacaacccttactaaacataagagaattcatgctggagagaaacccatcacatgtgaagaatgtaggaaaatctttacctcatcctcaaactttgccaaacataagcgaattcatactggagagaaaccctacaaatgtgaagaatgtggcaaagcctttaataggtccacaacccttactaaacataagagaattcatactggagagaaaccctacacatgtgaagaatgtggcaaagcttttagacagtcctcaaaactgaatgaacataagaaagttcatactggagagcggccctacaaatgtgatgaatgtggcaaagcctttggacggtccagggtcctgaatgaacataaaaaaattcatactggagagaaaccctacaaatgtgaagaatgtggcaaagcctttagacggtccacagatcggagtcaacataagaaaattcatagtgcagataaaccctacaaatgtaaagaatgtgacaaagcctttaaacaattttcgctcctgagtcaacataagaaaattcatactgtagataaaccctacaaatgtaaagattgtgacaaagcctttaaacggttctcacacctgaataaacataagaaaattcatacttgagagaaatcctacaaatgtaaagaatgtggcaaacctttgg

SEQ ID NO: 1213 - DNA, 6234 bp, Homo sapiens
gagaagcccacgccactctaccccagagctctcgatggtgcttctccggcttcagggctggagtgggggtggagggcgggaaaaaccacagagacaaaacatagagtaccccggcagccggcaagaggaagagagagtggcttccacatccccaatatcctagaggcggctgagccggaggcggtcgcacaaagcgggccccgggggccgttccagccgcggccgaccatagagatgcggctcccgccggctctgggtctggagccttccaggttacaaaccgcctttccagttcgctggctcttatgatccagctcctgcccgacgatgtggacactgtcatcacctccattttacagataggaaagctgaggcccagagaagcgaagcgactgtgtctgtccaagaccacgcgccctcctgcccggaagataagcgtatttcttctctggtgcccacctgtctcctacctcaccctgccctcccgcaggtgaaggttcttaatcttgacggctcagcgtcctccttggctccccccggaggccatgtatggtcaagcttgaagattccccagaacagcgataatattcacatttaagaagccaaaacacacaagtcggtggtgatgacagacccccttttggactcacagccagccagtagcaccggggagatggatggactgtgccctgagctattgctgatccccccgcctctctctaaccgtggaatcctggggcctgtccagagcccctgtccttcccgggaccctgcacctatacctactgagccaggctgcctgctggtagaggccacagcaactgaagagggaccagggaacatggagatcattgtggagacagtagctggaaccctgaccccaggtgctcctggagagaccccagccactgcagcttcataggctccaacgtcaaactcttccggcagcatcagcggagccatggtgctgggacacagggagaactttctgccgttcagggccttccatcccaggagctgctgccagctcccaaactgcctccaggagagagagaaccttcacaggaagcaggtacacccttgcctgggcaggagacagctgaagaggagaatgtagagaaagaagagaagagtgacacccagaaggactcccaaaaggctgtggataaaggccaaggggctcagcggctggaaggggatgtggtctctggcaccgagtccctcttcaagacccatatgtgtccagagtgtaagcgctgctttaagaagcggactcatctggtggagcacctgcatctccacttcccagaccccagcctccagtgccctaactgccagaagttcttcaccagtaagagcaagctcaagacccatctgctgcgggagctgggtgaaaaggcccaccactgcccactgtgccactacagtgcggtggagaggaatgcactcaaccgccacatggccagcatgcatgaagatatttccaacttctactcagacacctatgcctgtcctgtctgccgtgaggaattccgcctcagccaggccctaaaggagcacctcaagagccacacggcagcagccgcagcagagccattaccccttcgctgctttcaggagggctgcagctatgcagcacccgaccgcaaggccttcattaagcacctgaaggagacccatggggtgcgggctgtggagtgccgccatcactcatgtcccatgctctttgccacagccgaagccatggaggcccaccacaagagtcactacgccttccactgcccccactgtgattttgcttgttccaataagcacctattccgtaaacacaagaagcagggccaccctggcagtgaagagctgcgctgcaccttctgcccctttgccaccttcaacccagtggcttaccaggatcatgtaggcaagatgcatgctcatgaaaagatccaccagtgtcctgagtgcaactttgccactgcccacaagagggtgctcatccgacacatgcttctacatacgggtgagaagccccacaagtgtgagctgtgtgacttcacatgccgagacgtgagctacctatccaagcacatgctgacccactccaacaccaaggattacatgtgcactgaatgtggctatgtcaccaagtggaagcactacctccgtgtgcacatgcgaaaacatgcaggggacctcaggtatcagtgcaaccagtgctcctatcgctgtcaccgggctgatcagctgagcagccacaagctgcggcatcagggcaagtctctgatgtgtgaggtgtgtgccttcgcctgcaagcggaagtatgagctgcagaagcacatggcttcccagcaccaccctggcacaccggccccactctacccttgccactactgcagttaccagagccgccacaagcaggctgtgctgagccatgagaactgcaagcatacccgcctccgtgagttccactgtgccctctgtgactaccgcaccttcagcaacaccacactcttgttccataaacgcaaggcccatggctatgtacctggagaccaggcctggcagctccgctatgcaagccaggagccagaaggggccatgcagggcccaacacccccaccagattcagagccctcaaaccagctgtcagcccgacctgaggggccaggtcacgaacctgggactgtggtggaccccagcttggaccaggccctgccagagatgagtgaggaggtcaacactggaagacaggagggcagtgaggctccccatgggggtgacctgggtggcagtcccagcccagcagaggtggaggagggcagctgcacactacacctagaggccctgggagtagagctggagtctgtgactgagccaccccttgaggaggtcactgaaacagcccctatggagttcaggcccctgggactggaagggccagatggactggaaggaccagagctatctagctttgaaggtattgggacttctgacttgagtgctgaagaaaatccccttctggaaaagccagtgtctgagccctccacaaatcctccatccttagaggaggctcctaacaactgggtaggaaccttcaagacaactccacctgctgagacagcacccttgcccccattacctgagtcagagtcattactcaaggccctaaggagacaggacaaagaacaagcagaggcattggtgctagaggggcgggtgcagatggtagtgatccagggagaggggcgagccttccgctgcccacactgcccttttatcactcgccgggagaaggccctgaatctgcactccaggactgggtgccaaggccgccgagagcccctgctgtgccccgagtgtggggctagcttcaagcaacaacgcggcctcagcacccacctgctgaagaagtgccctgttctactcagaaagaacaagggcttgcccagaccagattcacccatccctctgcaacctgtgctcccaggtacccaggcctcagaggacacagaaagtgggaagcccccacctgcatcacaagaagcagagctactgcttccaaaagatgctcctttggagcttcccagggagccagaagaaacagaagagcctcttgccacagtctctggttccccagtccctcctgcaggaaactccttgcccacagaggcccctaagaagcactgctttgacccagtccctcctgcaggaaactcctcacccacggaggcccctaagaagcaccaccttgacccagtccctcctgcaggaaactcctcacccacagaggccctgaagaagcaccgctttgagcagggcaagtttcactgcaactcctgcccattcctttgttcccggctctcctctattacctctcacgtggctgaaggctgcagggggggacgtggcgggggaggaaaacgagggaccccccagacccagcctgatgtgtccccgttgagcaatggggactctgctcccccgaagaatgggagtacagagtccagctctggtgatggggatacagttctggttcaaaagcagaagggggctcgcttctcctgccctacatgtccctttagctgccagcaggaacgggctctgaggactcaccagatccggggctgccccctcgaggagtctggagagctgcactgcagcctctgcccattcactgctcctgctgccactgccttaaggctccaccagaagcggaggcaccccactgcagccccagcccgtgggccccggccccatctacagtgtggggactgtggcttcacctgtaaacagagccgttgcatgcagcagcaccggcggctcaagcacgagggggtgaagccccatcagtgccccttctgtgacttttcgaccaccagacggtaccggttagaggctcaccagtcccgacacacaggcattggccgcatcccctgcagctcttgcccccagacgtttggtaccaactcgaaactgcgcttgcaccggttaagggtacatgacaaaacacctacccacttctgtccactttgtgactatagtggctaccttcgccatgacatcactcgtcatgtcaacagctgccaccaaggcaccccagcctttgcctgctcccagtgtgaagcccagttcagctcagagacagcacttaagcagcatgctctgcgccgacaccccgagcctgcacagcctgcccctggctctcctgcagagaccactgagggccccctgcactgttcccgctgtgggttgctgtgccccagccctgccagcttacgaggacacacccgtaaacagcacccacggcttgagtgtggggcctgccaggaggccttccctagccgactggctctggatgagcaccggaggcagcagcatttcagccaccgctgtcagctctgtgactttgctgcccgggagcgggtgggcctggtaaagcactacctggaacagcatgaggagacttcagcagccgtggcagcctcagatggggatggggatgctggccagcccccgctacactgccccttttgtgacttcacatgccgccatcagctggtactagatcaccatgtgaaagggcatgggggcactcgtctctacaagtgcaccgattgtgcttacagcaccaagaaccgacagaagatcacctggcacagccgcatccacactggggaaaagccttaccactgtcacctctgcccctatgcctgtgctgatccctctcgtctcaagtaccacatgcggatccacaaggaggaacggaagtacctgtgccctgagtgtggctacaagtgcaagtgggtcaaccagctgaaataccacatgaccaagcatacaggactgaagccataccagtgtcccgagtgtgagtactgcaccaaccgggctgatgcactgcgtgtgcaccaggagacccggcatcgagaagcacgggctttcatgtgtgagcagtgtggcaaggccttcaagacgcgcttcctgctgcgcacccaccttcgcaagcacagtgaggccaaaccctatgtgtgcaatgtgtgccaccgtgctttccgctgggctgctggcctgcgccatcatgccctcacccacaccgaccgccaccccttcttttgccgcctctgcaactacaaggccaagcaaaagttccaggtggtcaagcacgtacgcaggcaccaccctgaccaagccgacccaaaccagggtgtgggcaaagaccccaccacccccacagtgcacctgcatgatgtgcagctggaggatcccagccctcctgctcctgccgctccccacactggacctgagggctgaaagcctgccccacctcctgtataggaagagggtatggtctgagatgtgcagactgggaccagcgctagcctgaggagctcagagcctaaggaaagactggcttttggggtacaagggtgactagaaccttcctgggactctggctatagtactttgaaattatcacccatataaaagagggacatggactataacgttgatttcttattgctgtacattgcgtttttaacctgcaagttctcagtttcttcaccatcactccatcaaagtccctggctataagatctggattttacccactccatcttctctttccttcttactgtgtcaattcctattttctttcagaatcttctaaaaacagttgtatctaaccgcatgtgctgttgtgcctaatgctctataaagcatgttaaacagaaa

SEQ ID NO: 1214 - DNA, 2955 bp, Homo sapiens
gggcgggcctcagacacactatgcgggttgcggggcctgggggccggacggctgtttcctgtcctggtgcatggtggtcggacgaaggaattgttggaaaattttctcggaggtagaagatgttgttagcccaaataaatcgagattctcagggaatgacagagtttcctggaggagggatggaggcgcaacatgttacgctgtgcttgacagaggcagtcaccgtggcagatggtgacaacttagaaaatatggaaggcgtaagcttgcaagcagtaacacttgcagatggttctactgcttacatacaacacaattctaaagatgcaaaactcatagatggccaggtcattcagttggaagatggttctgcggcctatgttcaacatgtacccatacctaaaagtacaggggacagtttgcgtctagaggatggtcaagcagtacagttagaagatggtaccacagcatttattcaccacacctccaaagatagttatgaccagagtgcattacaggcggttcagctggaagatggtaccacagcttatatccaccatgcagtgcaagtcccgcagtctgacaccatcttggcaattcaggctgatgggacagtggcaggtctgcacactggggatgctacaattgaccctgacaccatcagtgctttggaacagtatgcagcaaaggtgtccattgatggaagtgaaagtgtagcaggtactggaatgattggagaaaatgagcaagagaaaaaaatgcagattgttttacaaggacatgctacaagagtaactgctaaatctcaacagagtggagagaaggcatttcgatgtgaatatgatggatgtggaaaattatatacaacagctcatcatctcaaggtccatgagaggtcacacacaggagatcggccttatcagtgtgagcatgcaggctgtgggaaggcatttgcaacaggttatggattaaaaagtcacgtcagaactcatacaggagaaaagccatatcggtgttcggaagataattgtactaaatctttcaaaacttcaggagatctacagaaacacatcagaactcatacaggagaaaggccctttaagtgtcccttcgaaggctgcggtcggtcctttacaacatcaaatatcagaaaagtgcacgttaggacacacacaggagaaagaccttattactgcacagagccaggatgtgggagggcatttgccagtgcaacaaattataaaaaccatgtgaggatacacacaggagaaaagccatatgtttgtacagttcctgggtgtgacaaaaggtttacagaatattccagtttgtacaaacatcatgttgtccacactcattccaaaccttacaactgtaaccactgtgggaagacatacaagcagatctccacgctggccatgcacaaacggacagcccacaacgacactgagcccatcgaggaggagcaggaagccttctttgagccgcccccaggtcaaggtgaagatgttcttaaagggtcccagattacgtatgttacaggtgtagaaggggacgacgttgtttctacacaagtagccacagtaacccaatctggactgagtcaacaagttacactcatatcccaggatgggactcagcatgtcaacatatctcaagctgacatgcaggccattggcaacaccatcacaatggtaacgcaggatggcacgcccatcacagtccccgcccatgatgcagtcatctcctcagcaggaacgcactctgttgctatggttactgctgagggtacagaaggggaacaggttgcaattgtagctcaagacttggcagcattccatactgcctcatcagaaatggggcaccagcagcatagccatcacttagtaaccacagaaaccagacctctgaccttagtagcaacatccaatggcacccagattgcagttcagcttggagaacagccatctctggaagaagccatcagaatagcgtctagaatccaacaaggagaaacgccagggttggatgattaatcctcagaacaatggagcaataaagcagaaggagtctttcatcttctggcagcagaaatccatgaagcccgggcccaggaaaattagaagttttccattcctgatacactgtacacatttttatgcgagagtggagaacattttattcttgacacttttgtgtatataacccttggaatagattctcagagtgattcattgtgtacaaggaagtatgaaattagggcaatacagtaaattttcatgttactcttttatcagatcacaaactcctagagtctacatgcaagactagtaaagtcttatggagtcttatgatggatttttaacttcccgtggaaaaaaaaataaaggctgtatctaaaatatcaaaggttctatatgtcacacaatcgtaattccaaaagccattatggataataaagggtgtaaagccttcagatatttccccagttagtagagtgtctgcggtttttgttctactatatgcttgtccatttttatttgtatctcatggtttgcagactgtttgaataatttatagtttcccatccctgttaaaaaccagctcttcaagctgaaatgctaattatattggcattacattgaattatgtacaaaattataaaatttggttatttaaaattaaaaagttaaatccagtggttttgttaaagattttgcttagtattcaatttttattactgttttttaaaaataatgaatcatcaaagtttaaccacaggctggtgcccgggataacagtactgtaattggaaatggctttactctgaaaattaggttagtgggttggtgtaaattatttatttttgcttatgtacttttgttttaaagcttatttaccccaaagtttattattaattttgaatacagcaatttttaaaatgttaaaaaaaaa

SEQ ID NO: 1215 - DNA, 2622 bp, Homo sapiens
tctcccctcccgccgcccgggcgagcgacacggctgcggcccccctcccctcccttccctccctccctcccatccccccctccccgagacccaccggaccccgaacccagatggccgaaacgggctccccgtcttaacgatttggcgtctccctcgaccaccacctctttgtgcagcagcccccgggcagaccctgttccgagggcaacgctccccagtccccccacccccgaccccggaatcatgcatcggactacacggatcaaaatcacagagctgaacccccacctcatgtgtgccctctgcggggggtacttcatcgacgccaccactatcgtggagtgcctgcattccttctgcaaaacctgcatcgtgcgctacctggagaccaacaaatactgccccatgtgtgacgtgcaggtccataaaacccggccgctgctgagcatcaggtctgacaaaacacttcaagacattgtctacaaattggtccctgggctttttaaagatgagatgaaacggcggcgggatttctatgcagcgtaccccctgacggaggtccccaacggctccaatgaggaccgcggcgaggtcttggagcaggagaagggggctctgagtgatgatgagattgtcagcctctccatcgaattctacgaaggtgccagggaccgggacgagaagaagggccccctggagaatggggatggggacaaagagaaaacaggggtgcgcttcctgcgatgcccagcagccatgaccgtcatgcatcttgccaagtttctccgcaacaagatggatgtgcccagcaagtacaaggtggaggttctgtacgaggacgagccactgaaggaatactacaccctcatggacatcgcctacatctacccctggcggcggaacgggcctctccccctcaagtaccgtgtccagccagcctgcaagcggctcaccctagccacggtgcccaccccctccgagggcaccaacaccagcggggcgtccgagtgtgagtcagtcagcgacaaggctcccagccctgccaccctgccagccacctcctcctccctgcccagcccagccaccccatcccatggctctcccagttcccatgggcctccagccacccaccctacctcccccactcccccttcgacagccagtggggccaccacagctgccaacgggggtagcttgaactgcctgcagacaccatcctccaccagcagggggcgcaagatgactgtcaacggcgctcccgtgccccccttaacttgaggccagggaccctctcccttcttccagccaagcctctccactccttccactttttctgggcccttttttccacctcttctactttccccagctcttcccaccttgggggtggggggcgggttttataaataaatatatatatatatgtacataggaaaaaccaaatatacatacttattttctatggaccaaccagattaatttaaatgccacaggaaacaaactttatgtgtgtgtgtatgtgtggaaaatggtgttcattttttttggggggggtcttgtgtaatttgctgtttttgggggtgcctggagatgaactggatgggccactggagtctcaataaagctctgcaccatcctcgctgtttcccaaggcaggtggtgtgttgggggccccttcagacccaaagctttaggcatgattccaactggctgcatataggagtcagttagaatcgtttctttctctccccgtttctctccccatcttggctgctgtcctgcctctgaccagtggccgccccccacgttgttgaatgtccagaaattgctaagaacagtgccttttacaaatgcagtttatccctggttctgaggagcaagtgcagggtggaggtggcacctgcatcacctcctcctcttgcagtggaaactttgtgcaaagaatagatagttctgcctctttttttttttttcctgtgtgtgtggcctttgcatcatttatcttgtggaaaagaagattcaggccctgagaggtctcagctcttggaggagggctaaggctttagcattgtgaagcgctgcacccccaccaaccttaccctcaccggggaaccctcactagcaggactggtggtggagtctcacctggggcctagagtggaagtgggggtgggttaacctcacacaagcacagatcccagactttgccagaggcaaacagccttccaattgcccctccacccccagctgaggcccggtcacctggtcaggacagagcaactgcatctaaaagcacaagaagacagaaacctgtaagctctgaccccacccccaccccttgagaggtcagcggaccacctccttagggacagaccctggcaggtcgctgcccaccgagatttcctcaagtgtgcatagatctgagaggagtcgggagtcgagactcgagattccatcatagcgtaggtgtgtggggttgggagccccctgatgggcttgtctgtgtttgcaccttgtcctgtgtctgaggtcctgtgactgtaccctcctttgccctgggacatctgtatctcttggctttgtaataaatgctgcatactttctaaaaaaaaaaaaaaaaaa

SEQ ID NO: 1216 - DNA, 2417 bp, Homo sapiens
gcagcagagaggagttgagggcgatgagagcgggtactgcgaactgccgggcgatgctgtcgctgccgccgtgatacggagagcaacagttccccagcaacacccctccccgacacaggcacacaccccccgacaggcacgcacacccaccccacagtgcccggctcggctgcgcctcctctattggcccaggaagcccacccagccccgccacgcagagcccagaaggaaagaaagcctcatgcctgagccgaggggagcaccatggatctgacaaaaatgggcatgatccagctgcagaaccctagccaccccacggggctactgtgcaaggccaaccagatgcggctggccgggactttgtgcgatgtggtcatcatggtggacagccaggagttccacgcccaccggacggtgctggcctgcaccagcaagatgtttgagatcctcttccaccgcaatagtcaacactatactttggacttcctctcgccaaagaccttccagcagattctggagtatgcatatacagccacgctgcaagccaaggcggaggacctggatgacctgctgtatgcggccgagatcctggagatcgagtacctggaggaacagtgcctgaagatgctggagaccatccaggcctcagacgacaatgacacggaggccaccatggccgatggcggggccgaggaagaagaggaccgcaaggctcggtacctcaagaacatcttcatctcgaagcattccagcgaggagagtgggtatgccagtgtggctggacagagcctccctgggcccatggtggaccagagcccttcagtctccacttcatttggtctttcagccatgagtcccaccaaggctgcagtggacagtttgatgaccataggacagtctctcctgcagggaactcttcagccacctgcagggcccgaggagccaactctggctgggggtgggcggcaccctggggtggctgaggtgaagacggagatgatgcaggtggatgaggtgcccagccaggacagccctggggcagccgagtccagcatctcaggagggatgggggacaaggttgaggaaagaggcaaagaggggcctgggaccccgactcgaagcagcgtcatcaccagtgctagggagctacactatgggcgagaggagagtgccgagcaggtgccacccccagctgaggctggccaggcccccactggccgacctgagcacccagcacccccgcctgagaagcatctgggcatctactccgtgttgcccaaccacaaggctgacgctgtattgagcatgccgtcttccgtgacctctggcctccacgtgcagcctgccctggctgtctccatggacttcagcacctatggggggctgctgccccagggcttcatccagagggagctgttcagcaagctgggggagctggctgtgggcatgaagtcagagagccggaccatcggagagcagtgcagcgtgtgtggggtcgagcttcctgataacgaggctgtggagcagcacaggaagctgcacagtgggatgaagacgtacgggtgcgagctctgcgggaagcggttcctggatagtttgcggctgagaatgcacttactggctcattcagcgggtgccaaagcctttgtctgtgatcagtgcggtgcacagttttcgaaggaggatgccctggagacacacaggcagacccatactggcactgacatggccgtcttctgtctgctgtgtgggaagcgcttccaggcgcagagcgcactgcagcagcacatggaggtccacgcgggcgtgcgcagctacatctgcagtgagtgcaaccgcaccttccccagccacacggctctcaaacgccacctgcgctcacatacaggcgaccacccctacgagtgtgagttctgtggcagctgcttccgggatgagagcacactcaagagccacaaacgcatccacacgggtgagaaaccctacgagtgcaatggctgtggcaagaagttcagcctcaagcatcagctggagacgcactatagggtgcacacaggtgagaagccctttgagtgtaagctctgccaccagcgctcccgggactactcggccatgatcaagcacctgagaacgcacaacggcgcctcgccctaccagtgcaccatctgcacagagtactgccccagcctctcctccatgcagaagcacatgaagggccacaagcccgaggagatcccgcccgactggaggatagagaagacgtacctctacctgtgctatgtgtgaagggaggcccgcggcggtggagccgagcggggagccaggaaagaagagttggagtgagatgaaggaaggactatgacaaataaaaaaggaaaagaaaaaaaaaaacagaaggaaaaggaaaaaaaaaaaaa

SEQ ID NO: 1217 - DNA, 3880 bp, Homo sapiens
aggactcccagacccctcaccttctgcctcccctggtcgcgtccgggtccttgcggagctaactagctcgccacgacgtcaagaacgacgtaacgtcaggccgctgtgggctctgggaattgtagtccagagctagatcggccacggacagaatggcgttctcttatctctgagtcggggcctggctcgttttgacatttttgcgcccacgagtcttcggagagggcgtcgccactccagaccttccagcaagcttgaagtcatctgacgctaaaggactacttacctcaagagctccatcgtcacagaaggaggcggccaagttcgcggggggaggggaggagacagagagtcgaccagtaaagcctcaagggaaatgtagtccaaggcctgagaagcgacgttgctggtaatagaaggtaattcagtaccagcctgggcctggccgcggtgaccgaggcgggccgcgtcgcggagacttctgggagtgcttcctcgctctccgagtgcgcaagcgcagcgcaccgagtggacattttggtctttgtccgcgggtcagtacggcccctgggtccacgtggcgcgaaagtaggaggaagacataggccaaggagccagacttcctgtgttaactccttcctctgccactttttaccttggggacctcagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagagaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatccaaaaaaaaaaaaaaaaaaaaaaaaaa

SEQ ID NO: 1218 - DNA, 5744 bp, Homo sapiens
gtttcctcggcggcctcggagcgcgggtgcagcagttgtgtcccgacccctgggagcgccatggcagagctgtgccccctggccgaggagctgtcgtgctccatctgcctggagcccttcaaggagccggtcaccactccgtgcggccacaacttctgcgggtcgtgcctgaatgagacgtgggcagtccagggctcgccatacctgtgcccgcagtgccgcgccgtctaccaggcgcgaccgcagctgcacaagaacacggtgctgtgcaacgtggtggagcagttcctgcaggccgacctggcccgggagccacccgccgacgtctggacgccgcccgcccgcgcctctgcacccagcccgaatgcccaggtggcctgcgaccactgcctgaaggaggccgccgtgaagacgtgcttggtgtgcatggcctccttctgtcaggagcacctgcagccgcacttcgacagccccgccttccaggaccacccgctgcagccgcccgttcgcgacctgttgcgccgcaaatgttcccagcacaatcggctgcgggaatttttctgccccgagcacagcgagtgcatctgccacatctgcctggtggagcataagacctgctctcccgcgtccctgagccaggccagcgccgacctggaggccaccctgaggcacaaactaactgtcatgtacagtcagatcaacggggcgtcgagagcactggatgatgtgagaaacaggcagcaggatgtgcggatgactgcaaacagaaaggtggagcagctacaacaagaatacacggaaatgaaggctctcttggacgcctcagagaccacctcgacaaggaagataaaggaagaggagaagagggtcaacagcaagtttgacaccatttatcagattctcctcaagaagaagagtgagatccagaccttgaaggaggagattgaacagagcctgaccaagagggatgagttcgagtttctggagaaagcatcaaaactgcgaggaatctcaacaaagccagtctacatccccgaggtggaactgaaccacaagctgataaaaggcatccaccagagcaccatagacctcaaaaacgagctgaagcagtgcatcgggcggctccaggagcccacccccagttcaggtgaccctggagagcatgacccagcgtccacacacaaatccacacgccctgtgaagaaggtctccaaagaggaaaagaaatccaagaaacctccccctgtccctgccttacccagcaagcttcccacgtttggagccccggaacagttagtggatttaaaacaagctggcttggaggctgcagccaaagccaccagctcacatccgaactcaacatctctcaaggccaaggtgctggagaccttcctggccaagtccagacctgagctcctggagtattacattaaagtcatcctggactacaacaccgcccacaacaaagtggctctgtcagagtgctatacagtagcttctgtggctgagatgcctcagaactaccggccgcatccccagaggttcacatactgctctcaggtgctgggcctgcactgctacaagaaggggatccactactgggaggtggagctgcagaagaacaacttctgtggggtaggcatctgctacggaagcatgaaccggcagggcccagaaagcaggctcggccgcaacagcgcctcctggtgcgtggagtggttcaacaccaagatctctgcctggcacaataacgtggagaaaaccctgccctccaccaaggccacgcgggtgggcgtgcttctcaactgtgaccacggctttgtcatcttcttcgctgttgccgacaaggtccacctgatgtataagttcagggtggactttactgaggctttgtacccggctttctgggtattttctgctggtgccacactctccatctgctcccccaagtaggcaggctgtaggcacttgggctgactgcctgcagaagtcccaagaccctagtgaaaatacagcaggcagaactctccttggataattccccaagaggtcccaaggattgggagcatgggaggggagctggcgggagggtgggaggtgggatttagccaggaaaggggtgagagtgattgtgttgtgggcgaggaggcgtttccaccccctggtgcctatcagggcagggtgacctactccccattgttctggaaatctccaggctgctgggcagctgggcagagctctgggaagtgaagtcatgagtgcccgattcctcttagagaaaatccatagctactgtaggttctgtcttgggccacttggatctgaaggctgcccctttgctctctggggtagccttcagatcttggtgttttgaattcttactatagatgtttttaaagttccaaagtcattgagtttcaatgttacataaactccattacccgcatgttggggcttgatctcctggttattatctgtgcttgaggaaacacccacagcagtctctacccagaacagtttcctaaagaggcataccctcttcctccactggaaaatagtgcgttcccttcctaccctgcacacccatcgcccccacattgatggttttcaaacagcaaacttttcagctaaagcttcaaaccatgattggaatcagcctgtgttggatttgtgattcagggtcatggtgaccctgatccagtttgggtggaaatccttcctaagtatcataagaagcatcttggcagagatgctttggtggcagccatgagctttgctggaggccttgcttcccatagccttggctgtggggcaaggaactctgccaggcgagggggatgctgccctggatcaacagaagcctggtgggtttgctcgtgttagagtgtcctgccttcttactgacaactcttctcggtgatagcctctcttccctggattgtgacatatggaatgacagtgcaggtaccaccgaggctagcacagtcaagcctccagctaagctggatccctgaagcctgctatcatgcagacaggctatgcggctgcctcggaccatgctaggccacttgctggggtgtcaacctaccaccaaaggggtcttttagcaaacctcatggggaacaggaacattcctgttcatccctggccacaggctgcagacccagcactggcccttgcgtgagtcagagcctggggctggccctagccccttctactgacttcctcatttaagccaattatataagctcacattgatcagggagggagggaaagagctaaagagggtcacacaagtggctattttccctgcagtgtttctgtgtggtgaaaataacccagtccactaaggggcgggagtgaatggatggctggattttccccaagctccttatagcctaatgttgtcaggatgtgagtatgaggaatttagcctcttatagtgaaatgagtccaactctgggctttgcttagaggagagctcctgtcaggcttcctataatatgaaaagaagtcaccattggggaactagagaccccagaccttttcatatggatatttgagaatgtaatgcatctcaggcctcgtgctggaactctagggcactctaggcaggctcagaacacttgatattcctgacagctacacacctgacatgcaggtacatacctgatcggtgtcatctcctaacaaggattttcagttcctcgggagagcaataatctttgtaggaaagacatccctgcaataggtgatatgtggtccttagaagttttattcctttactacttggaagaaaagttctttggtgattcttctctgcttttgaagatgatcaaaagcatcttcattgattttctgaaacgaaagccttgtctgaaaccaattaatacttgggaaacagctgggcttggaggagtagaatgccagagataaatccatggctcctgctctggctctcttctgcagaaatgagggcaacagtgaggccacttccctggcaaatgtgcagctcaggatagggaagcataagaccctctgtttaaaagagagtcaagtaggtaaccaaagccaagctctgtgcaaggtgctttggagttgtaaattgaggagtgcatccttgctgtcttgaaccattctgtttgcaatggtgagaccttacataacctagccttgcagggccgccacacaaccctggagtcctagagttggaggaacctttgtatccatctgacttctcattttgcagaatatgatgagaaagtagaggatcgctctgttcaccactcttgctattccattagtggggagatgcctgctagcatgtgtgaggggaacactctgatacactgggaagtatcggaaattcccagaaacacaaacataaaataactctcctagacccaggtactggggactgtctcagtccgtgtggcatgataaataaaaggttaggatcaagtctttgtatttttcaagatgtggtagctgattattcctgttttaagtactctgaaattgatctgtgatcaataatactaatatgttatcttttaccgtattctgcctctcactattgattttaattagttaggagtatttgagctgttatttcttgagcttaatatttttttagagttaactctttaaggagataatcatggctgtagacaaggccagggctggctgacgtgccttagaaggtttgaatgcaataaagcggtgtttggcgttctcctgcattgtagtgcgggtacaaaatgctatttgttcgtcatactgttgtcagcagatgagccgcccactacagacggctactgcccagggacctgcccaggccccacccaagggctcccaagggttgagatttctgcagacctatagccagcacacttagtcctgccctatatagagttcctcttcgggaagcttttgataaggaattctcagaccgataggatgtctgtctgggctttgctgcgggacagtctaactgtgggggctaggggaaagcaggagagtatcgatcaaagagtaagccacacacggataatcagttactagggatggaggtgtgagggttcattatattattcattttactgttgtatatgtttgaaaatgtctataataaaaagctttaaaaaaaaaaaagaaacaaaaatagttcaggccagcaatgggccctccatgttcagtggattttatccttgtttcaattggggtaggagttccaggaggtgtggattggaggttgtctaaagaattgaactggcctttgtccctgcttcctgggagggagactttcagtccttgacatttccagggtaataggagtgtctttgttatttgtgaggccatgggatcacacctgagcttatgctaaaaggtgggatgactcagagctggggctggtcaccagacagactgaccatgtgattagaggtttgaggctttgagtcagcctgacctatggggcgggggactggaggctgagtttaatcatctggccagtgctttaatcagtacatcatgaaaccctaataaaaactctggacactaaagctcagcatagcttcctgggtggtgaagctgtggctatgccggcagggcagtgtgccctaattccacgaagagggggcatgggagcactgtgctcaagacccttccagacctttccctgtgtcttccttggcttgtggagctgatttgtatcctttataataaaactaatcataagtata

SEQ ID NO: 1219 - DNA, 9573 bp, Homo sapiens
ggcgaccgcggcggcgctctagctgcggcatgtctgcgtctctactgctctgggaggaggaagagaaggaggaagaggaggaggaggaggagggggaggaagaggagaaaggcgcaggggtgggagctgttgccgaagctgccacagcaaaagttctcccccctccccccttcccctcctctcaaggcccctagaaaggttggagctgccgccgcctgcagtcggtgaccgcgcgactcggcgcccgcccgcggatagagggaggaatcagcagcttggaaattcaagcacgtgatctggcgggatgggcgtttgcctaacgtatttaatggaggaatcggatggcataagtgattaaggtggtattgaggatttctgaagcctatgaaaggtagaaactcaaccatgatttctttttcaactctacagcattcctttccttgaagtcttcgtttttaccttagtctcgggcagttatacttaagcatgaacattgacgacaaactggaaggattgtttcttaaatgtggcggcatagacgaaatgcagtcttccaggacaatggttgtaatgggtggagtgtctggccagtctactgtgtctggagagctacaggattcagtacttcaagatcgaagtatgcctcaccaggagatccttgctgcagatgaagtgttacaagaaagtgaaatgagacaacaggatatgatatcacatgatgaactcatggtccatgaggagacagtgaaaaatgatgaagagcagatggaaacacatgaaagacttcctcaaggactacagtatgcacttaatgtccctataagcgtaaagcaggaaattacttttactgatgtatctgagcaactgatgagagacaaaaaacaaatcagagagccagtagacttacagaaaaagaagaagcggaaacaacgttctcccgcaaaaatccttacaataaatgaggatggatcacttggtttgaaaacccctaaatctcacgtttgtgagcactgcaatgctgcctttagaacgaactatcacttacagagacatgtcttcattcatacaggtgaaaaaccatttcaatgtagtcaatgtgacatgcgtttcatacagaagtacctgcttcagagacatgagaagattcatactggtgaaaaaccatttcgctgtgatgaatgtggtatgagattcatacaaaaatatcatatggaaaggcataagagaactcatagtggagaaaaaccttaccagtgtgaatactgtttacagtatttttccagaacagatcgtgtattgaaacataaacgtatgtgccatgaaaatcatgacaaaaaactaaatagatgtgccatcaaaggtggccttctgacatctgaggaagattctggcttttctacatcaccaaaagacaactcactgccaaaaaagaaaaggcagaaaacggagaaaaaatcatctggaatggacaaagagagtgctttggacaaatctgacctgaaaaaagacaaaaatgattacttgcctctttattcttcaagtactaaagtaaaagatgagtatatggttgcagaatatgctgttgaaatgccacattcgtcagttgggggctcgcatttagaagatgcgtcaggagaaatacacccacctaagttagttctcaaaaaaattaatagtaagagaagtctgaaacagccactggagcaaaatcaaacaatttcacctttatccacatatgaagagagcaaagtttcaaagtatgcttttgaacttgtggataaacaggctttactggactcagaaggcaatgctgacattgatcaggttgataatttgcaggaggggcccagtaaacctgtgcatagtagtactaattatgatgatgccatgcagtttttgaagaagaagcggtatcttcaagcagcaagtaacaacagcagggaatatgcgctgaatgtgggtaccatagcttctcagccttctgtaacacaagcagctgtggcaagtgtcattgatgaaagtaccacggcatccatattagagtcacaggcactgaatgtggagattaagagtaatcatgacaaaaatgttattccagatgaggtactgcagactctgttggatcattattcccacaaagctaatggacagcatgagatatccttcagtgttgcagatactgaagtgacttctagcatatcaataaattcttcagaagtaccagaggtcaccccgtcagagaatgttggatcaagctcccaagcatcctcatcagataaagccaacatgttgcaggaatactccaagtttctgcagcaggctttggacagaactagccaaaatgatgcctatttgaatagcccgagccttaactttgtgactgataaccagaccctcccaaatcagccagcattctcttccatagacaagcaggtctatgccaccatgcccatcaatagctttcgatcaggaatgaattctccactaagaacaactccagataagtcccactttggactaatagttggtgattcacagcactcatttcccttttcaggtgatgagacaaaccatgcttctgccacatcaacacaggactttctggatcaagtgacttctcagaagaaagctgaggcccagcctgtccaccaagcttaccaaatgagctcctttgaacagcccttccgtgctccctatcatggatcaagagctggaatagctactcaatttagcactgccaatggacaggtgaaccttcggggaccagggacaagtgctgaattttcagaatttcccttggtgaatgtaaatgataatagagctgggatgacatcttcacctgatgccacaactggccagacttttggctaaaaaaaaaaaaaaagtgtaaataatactggcactttagaacagattaatcaagagtggggttactctgtgtaaatggagtgctgtacagatttaagagcaatgcgtaataacaagttaagctgatatgaatagcaagataatccaataactgcatttcgtttggttagtcagcattctttgaactgccttacatgttgtcacctttatagaagcaatgcattacttgttttagatcagaaacttgctattccacccacaccaagttaaaaaggaaaaaaaaaagactttcgcacaattgtttcctaactgataacattgtacattcttaggagattagtaattgtgtgaaatttactcatactgtttctaagtttttcagcatagtcattgcacttcagcagggaatctgagtatactttacagacagagtgaacttaaaagtttaatgtcaagagattatggcttaaataaattagtgtgtcctatagggggaaaaaaaccaagaaaccaccttttaaaaagaatgatatgccatatacccttgattttcattttgcattatattgacgtgtttttttgaaggaaaaaaagtaataaaaatctgatagtctaagactccactatttaaaagcctaattactttaaaaatatgcatactttcagaacttttaccaaaacacacaactgttgaagcagtcacttctctatggaagtatgcatattggtgtcagtttctttgtacagttgtacttagatattttttatgatttttcatgtgcaggtatcaaggttttgaagttttagtaaaagaaattctgtagattacattcccaagaacataatgcttacacaaaatgtatattccacgttttaaagcttaattgtattttactttacatatacacttcagttaacatagagcacttagaatctatttggtatttttgatttctcaaagtaaaaaaaaaattagatttttaggtttgatatggttgtgtcataatcatctcgtaattgacaattttaacttttggcaataaaaggaaattgggatatctttggaactgtaaaacctggtttaatctttttctttctagactcttgatagattggataattaaacagtatccagagaaactaaagaaatgggcattttaattgcatattttatcttgagttactttttaatgaacactgctcattacaactttacaaaccaaaagtgtttactaattccagtaactaccatttctttttcagctagatgagtgatcggaaaatttttgttgcatttcaaaatctaaataaactacagactttatccttataccatgaatgtttttttttaatactctgtcttaaaataatacagcatggtacaataaatagtgcttttatgtatatatacacacacacacttttctgaagaatgatggtttgagttatgcgttgggcagttttgatttttggaagttatattagttattgactctttgttacaactttttcatttttacattttaaattttctgccatcgttgtcacaatgcacatcctgatatagcaccagtgaaaatctaaaattaatacccttggaaaatgaaaatattcttaatttccattttgactcttatactggccctatagctctgcagtctttgtttcaatatagaatatgttatccatttaaattattttttcttttatttaatgttatcccaagactgttctcataaagaaagggaagaaataactatccacccttaacatccttcatttattttgaatatattggtgtttttatgataaggaatataaattatatttaatgtggtttcctgtatactttggttattaagttttgcttgaaatagtagttttcccgtttgacagctttctttgctgccaaagttttcaagaatttaagacttctttgaagtaaatatttaagttctgccattattgactcttaagattgtgtgtgttgtgttgtgcattacataattacaaaaaggcttcattcaggtgatacgttaaaaatggaactgtgctcaccctaaataggcattggtatttttctcttttggtgagagtaggcatttatttcttgagttgttttggagcctgatcaaaaattttgttcatggagaacttgatgcaattttgatacagtggagaggtttttttcggttgttttaacatcaccagcatagtttttagaatgtgactcttgctgagcatttagggtgagcttgggaaggaaggcctttgaaaatggtagttatgcaagcagactttcaggtgttgcattcctgttttcaacacatttctttaaatctacataatggcagacttttctaccaggttataagcagtttttagataagtgatactcagccagcataacttattgacttaccatttacgtatagtcatcactctcttactgtgaaattccaaatgcctaccagagttaccttgttctatcataatatgacaaacatctcaacagttttggatttccccactttggttcagaaggttatttaatttctatctgggcattaatggagaaaataagtagccttgtgtgctgcttcagattgaaacatggaggatatgagatattcttctgcaattcatgtttctcatttctcaaagtgagcacattgttctataaaaacatgctggtacacccttaaacttttgatcaatctgagtgaggtgtgcttttcctcttgggacctactcacgtttgaagattggaaacatcacgttaggcgaggcagtatctcttgaacatcttctaaagggttttttaaaaccttattctcacatatttcatttgtcttgaatatttaagtggctcttaaacgttttgggtctacatgcaaatgtggtacttaacaaggtaggaatccatcttcttagctctggctgagggtgccagccatcggtcaggtcatttttatctcaagaggcagaaggcagttatgtcaagaattgtgctcagggcaggatttcgtttccacagaggagagacacttgcagagtgccagctaggttagatcttttgccgcttctttcatttgattaatttgggtttttaaagggctgtttaaaaaaaaaaaaaaaaggccgggaaactttaaaagtaggcattactgtagtactgcatttcttagaacattttaaactagaactcatttttttttcacagtatatttacttgaagaagcactataataatcattgagaagtattttgagtctgaaatttaatttaattttccgtttcaaattgctttatttcagggaaataattttccagttgttttgctatattctgcaaataaaaaccgtgtttccttttttcacttaaactttggtaggaaacaaactaaagcagacaaacatttcttgttatgtttgttgctttctttaatccaatggataaaaaagtaaaaccctgtaaacattattttatttttttatgcaataccatgctgtaaatatggttcatcaaataaggatgtacctatgattgaatctttaattctgcacagttagagtttatatataaacgtgtcttgacaatcaaggacttttatgtgagtcttcctttatgatgtttattaatgttatgcattccatttgttttgaagtgagtaccaatgtgctaatttgtattgtctgaaagtatgtaatgtttttacagcttgtttttaagaatctgtaaatatgtacaaacaaatcacagtactgctttatgttagaaggcatatgatgttgtactgtatgtaagcaataatacatagcagtgctaactttacaagtagcatcaggaaagttctaaaaacatttcagagttattaattatccttatttcatttaataatgattatctttaatcagtttttataagcaaattccattgttcctcctattggaacgtaacactgtttacacagcataattgaagttgcaggggagacaggctaaatctgacttcatctgtactcactttcactaagcattgaatggccttaccactcttctgcaagatggaggaagaccgcaaaacttagtgcccatcacactgaaggaagggatgtggttttttttcctgcttctgtactgctacctaactttgtgatttgctttggattttaatatttgtttctgttttagattcaagcccgtaagttttgaggtgacttcagctccattgtgaaatagatagttctcttcatatttcataactacatttcaataattctaaactttctacattgatttttagatacttatttttcaagcttggtttctcagctgatcagatgaatttattcaacttcaatacaaagaaagacaaacctattatagtttcaagtgagtagatattatactgtacaggacagctatttgaacacacacatcactgctttagaaataaaaccgccaatttataaatgtatatgacctacattttataggaaaaaatgtttttaaatgctagtcatttatataatgtgctttgaaggatttgctagtccacttctgtcactttttagtacactggtatcttttatatgtaatgtatgctttttattattgtagcaaagcatttcagtagaaagaattttgcaacaatatgggggaaatttttcattgttggatttgaattatactggattttatctgtgtagtcttacttgtctttattttaatgctgtctgaagggaacttggtatccaaataaagcaggtaacctcattttacttcaagggcatactgtgtagtgctgaatttaatctgaaaatctgatgattttgaaaagaaaaacaagtttataaacattgtacagaagaaattaaatgtgtgtgatggaaatcctgatggtggagcacgttgaattttctgatatatagtgttattttcctgggatcccctatgccttctttgtatttcaactaataaaggaaaaaccctgtcattaaaactggtaagataataggatattctgattatacagtattactattcctatcccattttctgaccttttctcaatcactgtaaatttttattttctatttcctattgataattaaatatgtacataatatagacactgttgtatagaactaaatgaattgggttgctatgcttgagtgggtagtgaaatggaaatatttgatgaatactgagagttcctaaaatgctagagcaaatttccgagggaaaggggggcatcgtgtgtcttgggaaggttgcagcaggttgtttcttcaactccctaagaaatcattgggaaggactcaactgcaaactcgggatcagatacaaaatgggtctttccttcccctctcccccaaaaaataggagcactaaattttaaaatctactcaggtgacagttgctttgcaatgaaacttatcacattgaaattttcagtgttaaataaaaagagatttgtgatatttttaaatataaacttttacatcagtagtcagcagcctgacaattgaaatttggtaagtcgatatattttaaaatattttgctctccaaatagaattgtttttaaacaattgggaggttttttgtttctttaaatatgttttaattgtcattgtaaaaacaaaatcttgcttgaccctatattatgccatgaatgaattgctgagcctttataatacagtgacagcttgtttcatgcatagtcatggaacatagagatgttctttaaactgacctattgataagaggtttaatgagtttcacggctttcaacactattgtcatatagttatctttgccatttggagtttataaaaccattttatgtattgtgatactaaaggaagttgttttgctttactttaaattgaattattagactaatatttgcaaattctgcattttaaatgtggacactggctgtttgaaaaataaaatatagaatacagttttatggataattttcgagctgaatttttcacaatattctgaaccaaataacgaatggtaaatatgcaaaaatcatggtgcatagatataaccgtaaagagaaaagaatttctgtgtggaattaacagttacacaaattgggtaacaattatcagggcctttattatagctttatgtggaatgttattctaaaatgcaagagtcaaatgttactgtcattgaatattttagacttgaaacgtgtttatcatagagcgaagaaaatatgtgttcttttctttacagataagactctgttaacccactgtcagcatacgtgggatttcttttcttttttctttcattagtggagatttgttttcatccatctaccaccttgccagtaccctagcttgtgaccagcgggatgcattgtaagaaagttgtctgtggttaggagtgcagtctgggtccatggaacaaatttaaactaattggccctcgcaatgatcagtcctaggaccctggccttattattagcatggtgctttaaccaattgtacataataataccactgatagtctactaatgcatttcctagatcccagtttttcttgaatgattaggaatggtggggagaggggaggggagatattctacatgatacttctccaatcttctaaagattataagaaaaaataaaaaattgaagtcacttgaaaaaaaaaaaaaaaaaaaaaaaaaaaaaaaa

SEQ ID NO: 1220 - DNA, 2767 bp, Homo sapiens
atgcgccggaagttgcagccgggaagcctgcgaggtcggttccgcccgactctaacatggcggcgccctttgtctgctctggagtgccgtccccggccttctcgcggccgtgatgcacctccctctgcggtggggtccgggacatggcaggtaatgagccggacgaggggagccaagctggagtttacacaggcaaactgtcagaaaagagtagcctgggctgtctggaaatctgagccatggactttccccagcacagccagcatgtcttggaacagctgaaccagcagcggcagctggggcttctctgtgactgcacctttgtggtggacggtgttcactttaaggctcataaagcagtgctggcggcctgcagcgagtacttcaagatgctcttcgtggaccagaaggacgtggtgcacctggacatcagtaacgcggcaggcctggggcaggtgctggagtttatgtacacggccaagctgagcctgagccctgagaacgtggatgatgtgctggccgtggccactttcctccaaatgcaggacatcatcacggcctgccatgccctcaagtcacttgctgagccggctaccagccctgggggaaatgcggaggccttggccacagaaggaggggacaagagagccaaagaggagaaggtggccaccagcacgctgagcaggctggagcaggcaggacgcagcacacccataggccccagcagggacctcaaggaggagcgcggcggtcaggcccagagtgcggccagcggtgcagagcagacagagaaagccgatgcgccccgggagccgccgcctgtggagctcaagccagaccccacgagtggcatggctgctgcagaagctgaggccgctttgtccgagagctcggagcaagaaatggaggtggagcccgcccggaaaggggaagaggagcaaaaggagcaagaggagcaagaggaggagggcgcagggccagctgaggtcaaggaggagggttcccagctggagaacggagaggcccccgaggagaacgagaatgaggagtcagcgggcacagactcggggcaggagctcggctccgaggcccggggcctgcgctcaggcacctacggcgaccgcacggagtccaaggcctacggctccgtcatccacaagtgcgaggactgtgggaaggagttcacgcacacggggaacttcaagcggcacatccgcatccacacgggggagaagcccttctcgtgccgggagtgcagcaaggccttttccgacccggccgcgtgcaaggcccatgagaagacgcacagccctctgaagccctacggctgcgaggagtgcgggaagagctaccgcctcatcagcctgctgaacctgcacaagaagcggcactcgggcgaggcgcgctaccgctgcgaggactgcggcaagctcttcaccacctcgggcaacctcaagcgccaccagctggtgcacagcggcgagaagccctaccagtgcgactactgcggccgctccttctccgaccccacttccaagatgcgccacctggagacccacgacacggacaaggagcacaagtgcccacactgcgacaagaagttcaaccaggtagggaacctgaaggcccacctgaagatccacatcgctgacgggcccctcaagtgccgagagtgtgggaagcagttcaccacctcagggaacctgaagcggcaccttcggatccacagcggggagaagccctacgtgtgcatccactgccagcgacagtttgcagaccccggcgctctgcagcggcacgtccgcattcacacaggtgagaagccatgccagtgtgtgatgtgcggtaaggccttcacccaggccagctccctcatcgcccacgtgcgccagcacaccggggagaagccctacgtctgcgagcgctgcggcaagagattcgtccagtccagccagttggccaatcatattcgccaccacgacaacatccgcccacacaagtgcagcgtgtgcagcaaggccttcgtgaacgtgggggacctgtccaagcacatcatcattcacactggagagaagccttacctgtgtgataagtgtgggcgtggcttcaaccgggtagacaacctgcgctcccacgtgaagaccgtgcaccagggcaaggcaggcatcaagatcctggagcccgaggagggcagtgaggtcagcgtggtcactgtggatgacatggtcacgctggctaccgaggcactggcagcgacagccgtcactcagctcacagtggtgccggtgggagctgcagtgacagccgatgagacggaagtcctgaaggccgagatcagcaaagctgtgaagcaagtgcaggaagaagaccccaacactcacatcctctacgcctgtgactcctgtggggacaagtttctggatgccaacagcctggctcagcatgtgcgaatccacacagcccaggcactggtcatgttccagacagacgcggacttctatcagcagtatgggccaggtggcacgtggcctgccgggcaggtgctgcaggctggggagctggtcttccgccctcgcgacggggctgagggccagcccgcactggcagagacctcccctacagctcctgaatgtcccccgcctgccgagtgagctggcggcccttctgactgtttatttaaggatggatggcaccctggaaccgggaagggtggcctgttccctagagagaataaattggattattttctaaaaaaaaaaaaaaaaaa

SEQ ID NO: 1221 - DNA, 791 bp, Homo sapiens
cacactggggagaggccttatgagtgcagtgaatgtgggaagttctttccctacagctccagtctccgaaaacaccagagagttcacactggatcaagaccctatgagtgcagtgaatgtgggaaatcctttactcaaaattccggcctcattaagcacaggagggttcacactggggagaagccttatgagtgcacggaatgtgggaaatcctttagccataactccagccttattaaacatcagagaattcatagtcgataaaagccttatgagtggcaaatgtggaaatctgttagcaccctggagaaagtccttgagtacacagtgaatgtcagaaagcttcagctgaaggccatatctcattgagtgccacacagttcacaagggaaagacacttttgatatgtagggatgtccagttgatataacagctctgaaggagatcccttatgagggtggcatcagcctgaattgaacatcctatatctgaacatctgcataaatccaggtatgtgtgaactgcattgcaccttttgccctgcccagggcccatgtcagatttatgtctctgctgatactatagtggaagccattttacctctaccgcctggcaggtgaccaccagtgtgcaccactcacccatcccagtgtattcaggtaagtgaaccttggtgttctgttcatgggaggaatttgtaaatagcccaagcatttattccgttttttttttttcctttctgatgagttaggccatggacctgacccagttttgccagaggaatctgctgg

SEQ ID NO: 1222 - DNA, 2673 bp, Homo sapiens
ctccgagcaggacactgctacttaacaaggtggtttgagccaagtatgtgtcttgcgggtctttgcgaaagtgaaccagttattaggggcgcctaacgacctggggggtcaactaaggggactgtggcacgtttcaggcaggattcctccttcattcaaactgcatcacccaggagtctgcaaattccccaaagtaggaggaaaaatgaccacattcaaggaggcagtgaccttcaaggatgtggctgtggtcttcactgaggaggagctggggctgctggaccctgcccagaggaagctgtaccgagatgtgatgctggagaacttcaggaacctgctctcagtggggcatcaaccgttccaccaagatacttgccacttcctaagggaagaaaagttttggatgatggggacagcaacccaaagagaagggaattcaggaggcaagatccaaactgagttggagtctgttccagaagcaggagcacatgaagagtggtcctgccagcaaatctgggaacaaattgcaaaagacttaaccaggtctcaggactctatcataaataactctcagttctttgaaaatggtgatgtcccctcccaggttgaagcaggactacccacaattcatacaggacagaaaccttcccagggtgggaagtgtaaacagtccatcagtgatgttcccatctttgatcttcctcagcagttatactcagaagagaagtcttatacatgtgatgagtgtggaaaaagcatctgttacatctcagctcttcatgttcatcagagagtccacgtgggagagaaactctttatgtgtgatgtgtgtggcaaggaatttagtcaaagctcacatctgcaaactcatcagagagtccacactggagagaaaccattcaaatgtgagcaatgtgggaaaggtttcagtcgtagatcagcacttaatgttcatcgtaaattacacacaggagagaaaccttacatttgtgaggcatgtgggaaggccttcattcatgattcccagcttaaggaacataagagaatccatactggggagaaaccattcaaatgtgatatatgtggtaagaccttctattttaggtcaagacttaagagccattccatggttcacacaggagaaaaaccatttaggtgtgatacatgtgataagagctttcatcagagatcagcacttaataggcattgcatggtccacacaggagagaaaccgtacagatgtgagcagtgtggaaaaggctttattggtaggctagatttttataagcatcaggtggtccacacaggagaaaaaccatataattgtaaagaatgtgggaagagcttcagatggtcctcatgccttttgaaccatcagcgagtccacagtggagaaaaaagcttcaaatgtgaagaatgtggaaagggattttatacaaattcacaactgtcttcccatcagagatcccacagtggtgaaaagccatataaatgtgaggagtgtgggaagggctatgttactaagtttaatcttgacttgcaccagagggtccacacgggagagagaccttataattgtaaggaatgtgggaagaactttagccgggcctcaagtattttgaatcataagagactccactgccagaaaaaaccattcaaatgtgaggactgtggaaagaggcttgtacacaggacataccgtaaagaccagccgagagactatagtggggaaaacccatccaaatgtgaggattgtgggagacgctacaagaggcgcttgaatctggatatacttttatcattatttctaaatgacacataattgttcatatttatggggtacaacgtgctattttaatgtgtgcatacaatttatagtgatccaatcagtgtaattggtgtatctgttacctcaaacatttaccatttctttgtgttggaaaattcaaaatccatttgagaggagttggtagacagcaagggaagggtccctggagacccccagccaaacgggtcagtgtctcatccccacataacacaaaaagcagcctggggaagacaatcaagctacaggcactgataagggaactagcacaggggattgtgcctggagacatgcccatggctgcacagatagaagaacctccagcccattcaggtaaaaactcgcacaaacctccggctcactcagttaagggaacaagaccagacacagaaatgcctttgtcctttgtataatcagcaggctccgaggaaaaagtttcttcttttgtgggcatgaacacagtgggcttcagtaggttcaggttggcactttcttttgtggaaaaggaaaagcccagcctctgtaaatcatcacttcagctcctgattggtcccaggccaagctgaatagcccttaggaataatcacttcaactcctgattggtcccgggccaagctgaatagcccttatgaatcatcacttcggttcctgattggtcccgggccaaggtcccagaccaagctgaatcacgctttctccaagacagcccgcaggctaagtgcattccttccccttcccagtccataaaaaccccggaccccagcctcatactgggcaacttatttggatccccatctccactgtggagagcttttttctttcacttattaaacttttactccaatttc

SEQ ID NO: 1223 - DNA, 1695 bp, Homo sapiens
gaggctgcaggaccctctacacacagacagctgtccagcacggaaggtgggctgaggcccagggtgaacatgccagctaatgggacatcaccccagagattccctgccctgattccaggagaacctggcagatcttttgaggggtccgtgtcattcgaggatgtggctgtggatttcacccgacaggagtggcacagactggaccctgctcagaggaccatgcacaaggatgtgatgctggagacctacagcaacctggcatctgtgggcctctgcgtggccaaaccagagatgatcttcaagttggagcgaggagaagagctgtggatattagaggaggaatcctcaggccatggttactcaggatctctctcactgctgtgtggcaatggttctgttggggataatgccctcaggcatgataatgaccttcttcaccatcagaagattcaaacattggatcaaaatgttgaatataatggatgcaggaaagccttccatgagaaaacaggctttgttagacgtaaaagaacacccagaggagataaaaactttgaatgtcatgaatgtgggaaagcttactgtaggaagtcaaaccttgttgaacatctgagaatacacacaggagagagaccctatgaatgcggtgaatgtgcaaaaaccttcagtgcaagatcatacctcattgctcatcagaaaactcacacaggggagaggccctttgaatgtaatgaatgtgggaaatcttttggcaggaagtcacaactcatcctacatacaagaacacacactggagagagaccctatgaatgtactgaatgtgggaaaaccttttctgagaaggcaaccctcacgattcatcagagaactcacacaggggagaaaccctatgaatgtagtgaatgtgggaaaacatttcgtgtaaagatatcccttacccaacaccacagaactcatacaggggagaaaccttatgaatgtggggagtgtgggaaaaacttccgtgcaaagaaatccctaaatcagcatcaaagaattcacacaggtgagaaaccctatgagtgtggtgaatgtgggaaattcttccgaatgaagatgactctcaataatcatcaaagaactcacacaggtgaaaagccctatcagtgtaatgaatgtgggaaatctttcagggtgcactcatctcttgggatccatcagagaattcacacaggagagaaaccttacgaatgtaatgagtgtggtaatgctttctatgtgaaagcacgcctaattgaacatcagaggatgcattcaggagagaaaccctacgaatgtagtgaatgtgggaaaatcttcagtatgaagaaatccctttgtcaacaccggagaactcacacaggagagaaaccttatgaatgtagtgaatgtggaaatgccttctatgtgaaagtacgcctcattgaacatcagcgaattcacacaggagagagaccctttgagtgtcaagaatgtgggaaagctttctgccggaaagcacacctcacagaacatcagagaactcacataggctggtcctggcgttgtacaatgaagaaagcctctcactgaagacttccctcaccattggatcaagctccttgggggcatatgatcaccagggcacacagtgtgcctgtgaaaatttggcacctacatttgtatcaaagtatgtcc

SEQ ID NO: 1224 - DNA, 168 bp, Homo sapiens
tataagtgtgaagaatgtggcaaaagctttattctgtcctctcatcttactacacataagataattcatactggagagaaaccctacaaatgtaaagaatgtggcaaagcttttaaccagtcctcaacccttatgaaacataagataattcatactggagagaaaccc

SEQ ID NO: 1225 - DNA, 2546 bp, Homo sapiens
aattcggggcgggacttccgggggtcagccggcgttggctgagacgtcttcgtgccacggtgctgcctcctttccaagcgcgacccgttgaggtccttgtcatgcccagcctcagaactcgccgtgaggaggcagagatggagctctcagttccaggaccatccccctggacccctgcagcccaggcccgtgtgagagatgctcctgctgtgacccaccctggatctgcagcctgtggtaccccctgctgtagtgatactgagctggaagccatctgccctcactatcagcagccagattgtgacaccaggactgaagacaaggagtttcttcacaaggaagacattcatgaagatttggaatcacaggcagaaatatcagaaaactatgctggtgatgtttcccaggtacccgagcttggagatctgtgtgatgatgtatcagaaagagactggggagtccccgaaggcaggaggctgccacagtccctctcccaggagggggacttcacaccagctgccatggggctccttaggggccccttaggggagaaagatctggactgtaatggttttgacagtcgcttcagtctgagcccaaacctgatggcatgtcaggaaatccctacagaagagaggccacatccatatgacatgggtggccagagtttccagcacagtgtggacctaactggtcatgagggggttcccacagctgaaagtccactcatatgtaatgagtgtgggaaaaccttccaaggaaatcctgaccttattcagcgtcaaatagtccacactggggaggcttcctttatgtgtgatgattgtgggaaaaccttcagccagaactcagttcttaaaaaccgtcatcgatctcatatgagtgagaaagcttaccagtgcagcgaatgtgggaaagccttccgagggcactcagacttttctaggcatcagagtcaccacagcagtgagaggccttatatgtgtaatgaatgtggaaaagccttcagccagaactcgagccttaaaaagcaccaaaagtctcacatgagtgagaagccctatgaatgcaatgaatgtgggaaggcttttaggcggagctcaaacctcatccaacatcaaagaatccattctggggagaaaccgtatgtgtgcagtgagtgtgggaaggccttcaggcgaagctcaaacctcatcaaacaccacaggactcacacaggagagaagccttttgagtgtggcgagtgtgggaaagccttcagccagagtgcacacctgaggaagcaccagagggtccacactggagagaagccttatgagtgtaatgattgtggcaagcccttcagtcgggtctccaacctcattaagcaccacagggttcacactggagagaagccctataagtgcagtgactgtgggaaagcatttagtcagagctccagccttattcagcatcggagaattcacactggagaaaagcctcacgtgtgtaatgtatgtggaaaagcctttagttatagctcagtgctccgaaagcaccagatcatccacacgggagagaagccgtacagatgcagtgtctgtgggaaggccttcagccacagctcagccctcattcagcaccagggcgtgcacacaggcgacaagccctacgcctgccacgagtgtgggaagacctttggtcgcagctccaacctcatccttcaccagcgagtccacactggagagaagccctatgaatgtactgaatgtggaaaaaccttcagccagagctcaaccctcattcagcatcagaggattcataatgggctgaagccccatgaatgtaaccagtgtggtaaagccttcaaccgaagctcaaatctcattcaccaccagaaagttcatactggggaaaaaccctacacctgtgttgaatgtggtaagggcttcagccagagctcacacctcattcagcatcagataatccacacgggcgagcgcccctacaaatgcagtgagtgtgggaaagccttcagtcagcgttcggtcctcatccagcaccagaggattcacactggggtgaagccctatgactgtgctgcttgtgggaaagccttcagccagcgatcaaagttgatcaaacaccagttgattcacaccagggaataggctgttgggctggcaggagtgaaaccgagcatagtttcctctccaactcctctttggccattgtctcagcctctgccacttcccagaccgaaagcctggactcagctcactgcctacatccagtggccacatagcctgggaccctcctttgaaacatcctttacaggctcccttctcactgccactgctcttgcctcttgtgatgtcttgggtttgggcttgtttttacagcttgtgaacggactgcacgtttgttacaagggagaagattatggaggctgcatattcatgaatagagtttattattataatgaaaagttaccaaaaaagtaaagtgacgtttggtttgagataaccatagtagtttgtttgattggtaaaaaaaaaaaaaaaaaa

SEQ ID NO: 1226 - DNA, 509 bp, Homo sapiens
gtcttcactcagaactcacaccttgcaaatcatcaaaggactcacaccggagagaaaccttaccgatgcaatgagtgtgggaaagccttcagtgttcgttcaagcctaaccacccatcaggcaatccatactgggaaaaaaccttacaaatgtaatgaatgtggcaaggtctttactcaaaatgctcacctggcaaatcaccgaagaattcatactggggagaaaccttacaggtgtacagagtgtgggaaagcctttagggtaagatcaagtctaactacccatatggcaatccacactggagaaaagcgttacaaatgtaatgagtgtggcaaggtcttcaggcagagttcaaatcttgcaagtcatcacagaatgcataccggagagaaaccttacaagtgtaatgagtgtggaaaagcctttagaggacattcaaacctaactacccatagagtgccatccctgagagaccagaccgctccccaatactctcctaaaataaacat

SEQ ID NO: 1227 - DNA, 4652 bp, Homo sapiens
gtggccgcgctcggcgctgccatgttgaggagccgccgctgccgttgccgccgccgccgccgccgctttgttgtcgcctcctccggctgaggaggctccccgagcggggggagtggggaggaggggggtcggccgccgcagccatggaggccaactggaccgcgttcctgttccaggcccatgaagcttcccatcaccaacagcaggcagcacagaacagcttgctgcccctcctgagctctgccgtggagccccctgatcagaaaccattgcttccaataccaataactcagaaacctcagggtgcaccagaaacattaaaggatgccattgggattaaaaaagaaaaacccaaaacttcatttgtgtgcacttactgcagtaaagctttcagggacagctatcacctgaggcgccacgaatcctgccacacagggatcaagttggtgtcccggccaaagaaaacccccaccacggtggttccccttatctctaccatcgctggggacagcagccgaacttcgttggtctcgaccattgcaggcatcttgtcaacagtcactacatcttcctcgggcaccaaccccagtagcagtgccagcaccacagctatgccagtgacccagtctgtcaagaaacccagtaagcctgtcaagaagaaccatgcttgtgagatgtgtgggaaggccttccgagatgtgtaccatctcaatcgacacaagctctcccattcagatgagaaaccctttgagtgtcctatttgtaatcagcgcttcaagaggaaggaccggatgacttaccatgtgaggtctcatgaaggaggcatcaccaaaccctatacttgcagtgtttgtgggaaaggcttctcaaggcctgaccacttaagctgtcatgtaaaacatgtccattcaacagaaagacccttcaaatgccaaacgtgcactgctgcctttgccaccaaagacagactgcggacacacatggtgcgccatgaaggcaaggtatcatgtaacatctgtgggaagctcctgagtgcagcatacatcaccagccacttaaagactcatgggcagagccaaagtatcaactgtaatacatgtaaacaaggcatcagtaaaacatgcatgagtgaagagaccagtaaccaaaagcagcagcagcagcagcagcagcagcagcagcagcagcaacaacaacaacaacaacatgtgacaagctggccagggaagcaagtagaaacactgagactgtgggaagaagctgttaaagcaaggaagaaagaagctgctaacctgtgccaaacctccacggctgctacgacacctgtgactctcactactccattcagtataacatcctctgtgtcgtctgggactatgtcaaacccagtcacagtggcagctgcaatgagcatgagaagtccagtaaatgtttcaagtgcagttaacataaccagcccaatgaacatagggcatcctgtaactataaccagtccattatccatgacctctcctttaacactcactaccccagtcaacctccccacccccgtcactgccccagtgaatatagcacaccctgtcaccatcacatctccaatgaatctacccacacctatgacattagccgcccctctcaatatagcaatgagacctgtagagagcatgcctttcttgccccaagctttgcctacatcaccgccttggtaaacagtattataaaatcaaaatatgggtaaaagtaaatatttaccagcaacttaacttttagttgattaaagcaaaaagtaaaccatgaaattgggagattttattacattagttaataagagtgtggtagcatttttctccaatttggctgggattattcaaagtagggtgtgtatgtaacttatcactggaccactttagtttaatcagaaattccttttagctgacaacattgcttaaacaggatagtagttggcaagatgaaatgccagaattaaaaccaatcataagtagaacccacttcaaaataaaaaaacagcattactatttctaatcccaaggaatcactttattgtaaacactagcagaactcttctccctatacaaggtggatggctgattttaacctgaaattttaaatccacagattgagagctagtgtagaattgtctgtgtttattgtttttatgagtaaatacatgcattgtcataataaaatgcatttcagagaatatgcattttacctttgggaatatgttaatttcaggcagcattccctatgggaaaggtgataccagctctgatatgcaaagcatatgataatttatcattctaacttcaacgtataatagggattgtgacctgatatttggagatgtaaatattgctcagcatattaatcccgatggaatatagcattgtagttgactttttaaaaaaaaaaaaaatttaaaaaaaatctacaaattgtgttttgctaagaaaagcctcaactgacagaggagaagtcaagtgtgtggacaggcaagctcctaataaacagagtccagtgggattcctatttaggagccaaggagtactttggaacagtacaaatatattgctttaaattggaagacgctggaggcactgggatgtgatatgcccctctctctcccaatcagagcctgttgatattacaacagggacagatgtgttagttgctcactagagtttatgtcttatattaaattgtatacagtttttattctaaccactaactaggtagtgtatgccccttcagaacatgcagagtgtatctttttttaaatttctccttccgtttcttaagtattgcgcagatttgttcaactttgtaaatatggacatcactttttttttctttgagaaaacacttgtatcagctttgtggtgttttcagggagacagctgtctgcattccctgtagaaacccagcaatgattatgcacgttgagacatgtgctttttatttcttagcaagatattttatctctgtacataaagtagaaaccaaaagctagggaaacagatactctttacaccatcatgccacgcattgtttttaaagcattgcgttaaaaaaaaaattaactaaaccaagatgctgtgattttttaagttgcaatatgtttttggtttttttcattttttaatcattgcagttaagagaaatggaaattagttgtgttaatcttgcagaatgtttgcaggactgactatcaaactggatgatttccatttataccctactgtgtcagttcaagcatcaaaataccttgcatctgagacagacttcctacatcagggacaggtatctgtgtgtcattatacaaaacagttctagggggttgaactacatagtaaaaaaataaaataaatagtacttagtgtaaaataattttataaatgatcttttgtactttaggacattaaattgtacaacttttgtatatataaaagcttaggaactttctgtttagcaggaaggcaacacattcctacacttttaatgtatatgtttgttataatgtccatgtaaacatgccctatgtttgtgccttttaattagtttgtctcaataaacaaaatgtagagaaaaatatgtagctatgactttgttacaactgttcttatccacagtacaaaaatggtttgtttttaatatgtagagcattatgtgtggactactggaaggactcgtgtagggaaagcccaagaatgaccttgctgaggcctggattgggaggcacagtggccacatttggaggaagttcacatttcctggcatgcagacccaaaactgggttctggctctgcctgctgggatctgttatctctggtgggctggcagtcataattcacaattcagacagcccaggcttcctccacagtggtccaaggagcagtcctcagtgggggcaggtgtgggccctacccctaagctagaatgtggttgtcagaaccctgaaagtattagttctaaaaaaaaaaagatatatactagaagtaattgttttatcaattcattgtataataaacaggagtgagacttcattgtatgacttcagttaaaatactattttgtatgcattctttattcacttaagaagcttgtctgcaataataaagccacgtcatgtcttcttttgggagggagagagtcgatggcaggagggggttttgggtgggccactgaaaaggggtaccgaataggttgtgtgatgaaattctgtgtcttggaactggaattgagtttcgatgttgatgaactgattcaaccaggtgttgaaggcacgacagccactgctctacgaaaaggcagagtacgtttttcccttctggttgtaacctggttgagagcttcccctttatcagattggcagctaaacagttgtattagataatccttaaatctgacatccagcctgttacgctctagggctcgctgcttggcctgcgtttgctttttattgtgtatccgttcccctcctacggtgtgctcctgaatgaaggtttctatgtaagcagatgatgattttacctgtcaataccagcactgtattactaacatgcaaaatactgcagatttattttgaaaattaaagttaactggtcacaaatgtaaaaaaaaaaaaaaaaaaa

SEQ ID NO: 1228 - DNA, 2411 bp, Homo sapiens
cttttcaggagtcccttctgttatttagcaagacacactactacaatggagaaaaaagatgccccctccttcaagccctgagatcttcaggactttggcgaaaagtctgcgcccgaagagacccaggaaggattcttggaattgtagtccaaaggcatcccgccttctgcgcagactcacaagtccctgtggacggaattcttgaagtgtagcgccgctcagtccttccaccggaagtgtccgatcggaatcagccctgtccgagaggtgagtccgggtttggggatccagatgtccagccccgtgtccccctccaaacatccagtccctctcatattgcctttgaaattagcagcctctgggtgaccagaccttggccctcagaggaatcccggagaaaggtagaaccagcttcggcgttgggaacgcaggcgcgcttacgcatttagtgagggtttggcggtctccatagttaccgccgccgcgcgtgacgtcatagtggagcgctgagggcttggtggcgtggggtgggggctgtcctactgatcctgaatttggggtcactggtaagaggagttgcccattccagccaggtggaacggggaggggtgccacatgtctcagatctgccattgtctgcgaaaagaaactgctgcgaggaccatccccaatcccctgcttcccttgggaagagtaaccgccgttttgtaggacacttggggacaaccccgcttgtcctgaaatttattgacacggtaaatagtatttcctgtgtgccgaggatgcagttaaaccaacactgaccccctgcccttgagaaacacaagatggctacagaaccaaagaaagctgcagcccagaactctccagaggatgaaggacttctgatagtgaagatagaagaggaagaatttatccatgggcaggacacttgcttacagagaagtgaactccttaagcaggagctctgcaggcagctttttaggcagttctgctaccaggattctcctggacctcgcgaggcactgagccgcctccgggagctctgctgtcagtggctgaagccagagatccataccaaggaacagattctggaactgctggtgctagagcagttcctgaccatcctgccaggagatttgcaggcctgggtacatgaacattacccagagagtggagaggaggcagtgaccatactagaagatttggagagaggcactgatgaagcagtactccaggttcaagcccatgaacatggacaagaaatattccagaaaaaagtgtcacctcctggaccagcacttaatgtcaagttacagccagtggagaccaaggcccattttgattcatcagaaccccagctcctatgggactgtgataatgagagtgaaaacagtagatccatgccaaagctggaaatttttgaaaaaattgaatcacagagaattatatctggaagaatctcaggatacatatcagaagcatctggtgagtctcaagacatctgtaagtctgcaggcagggtaaagagacaatgggaaaaagaatcaggggagtctcagagactctcgtctgcccaggatgaaggttttggtaaaatcctcacccacaaaaatacagtcagaggtgaaataataagccacgatggatgtgagaggagattaaatctgaactcaaatgaattcacacaccagaaatcttgtaaacatggtacctgtgaccagagcttcaaatggaactcagattttattaaccatcaaataatttatgctggagaaaaaaatcaccaatatggaaaatctttcaagagcccaaaacttgctaaacatgcagcagttttcagtggagataaaactcatcagtgtaatgaatgtgggaaagctttcaggcacagctcaaaacttgctaggcatcagagaatccacactggagagagatgctatgaatgtaatgaatgtgggaaaagctttgcagagagctcagatcttactagacatcggcgaattcacactggggaaagaccctttggttgcaaagaatgtgggagagcattcaacctgaactcacatcttatcaggcatcagagaattcacaccagagagaaaccctacgagtgtagtgaatgtgggaaaaccttccgagtgagctcacatcttattcgacactttagaattcacactggagaaaaaccctatgaatgcagtgagtgtggaagagccttcagtcagagctcaaaccttagtcaacaccagagaattcacatgagggaaaacctattaatgtaaggaacttaaatttgtaagtaaatgctgaggaaatggcacaatatgaaaaatattaaataaaaaataaatattgggcaagatggaagactgaaaaaaaaaaaaaaaaaaaaaaaaaaaaaaaaaaaa

SEQ ID NO: 1229 - DNA, 1667 bp, Homo sapiens
gaattccagccaagttttccccacctggtgccttttctagctcgcagctcctcagacaatatgcgctaagtggccatcccacacagatcttcccaagctcatctgcaggaggtgacttccaactagaagctccaagatgctctagtgaaaaaggagaaagtggagagacagaaggccccgacagctcattaagaaagaggccaagcagaatttctaggacattcttcagcccacatcaaggtgacccagtagaatgggtagaagggaacagagaaggaggaacagaccttcgcctggcccaaaggatgagtcttggggggtcagacacaatgttgaagggagcagacacttcagaatctggagcagtcatacgtggaaactatagactgggacttagcaaaaagtcaagcctgttcagccaccagaagcatcatgtgtgccctgaatgcgggagaggcttttgccagagatcagaccttatcaagcaccagaggacacacaccggggagaagccatacctgtgtcctgagtgtgggcgtcggtttagccagaaggctccctctcccatacaccagaggaagcactcgggggagaagccgtatgtgtgcagggaatgtgggcgacacttcaggtatacatcctctctcactaatcacaagaggattcactccggggagaggccctttgtatgtcaggagtgtgggcgaggctttcgccagaagatagccctccttctacaccagaggacgcacttggaggagaagcccttcgtgtgtctgagtgtgggagaggctttgcagaaggcatcactcctccagcaccagagctcacacacaggggagaggcccttcctctcccttgagtgtgggcgtacgttcaggcagcagtcactcctccttagtcaccaggtcacacactcaggagagaagccttatgtctgtgctgagtgtgggcacagctttcgccaaaaggtcactctcatcaggcaccagaggacacacacaggggagaagccttacctgtgcccccagtgtgggcggggttttagccagaaggtcaccctcattggacaccagaggacacacacaggggagaagccctacctgtgccctgattgtgggcgtggctttggtcagaatggcaccctcatcagacaccagaggacacacacaggggagaagccttatctgtgccccaagtgtgggcgtgcatttggctttaagtcgctcctcacccgacaccagaggacacactcagaggaggagctttacgtagacagggtgtgtggacaaggacttggccagaagtcacaccttatctctgaccaaaggacacactcaggagagaagccctgcatttgcgatgaatgtgggcgcggctttggctttaagtctgccctcatccgacatcagcggacccattctggggagaagccgtatgtctgcagggagtgtgggcgtggctttagccagaagtctcacttgcatagacacaggaggaccaagtctggtcatcacctcctaccccaagaggtcttctgacctttcctttccccgtgagtgtgaagctggcagaaatcactagtaaatgcttcagtttactgaaatggaatggaaaaaaaaaaaatgttgctttcgtttcatcgatcatagtagtgatttgttctt

SEQ ID NO: 1230 - DNA, 5700 bp, Homo sapiens
gatgaggaggcaccttccaagcaatgtgtttctgtaggagtgtcacaggtcacaactttaaagccagctttgtccacccagaaggcccagccctgtgagacatgtagctcacttctgaaggacattctacacctggctgagcatgacggaacacaccccaagcgtacagccaagctttacctgcaccaaaaggagcatcttagagagaagctcaccagaagtgatgaagggaggccttcgtttgtgaatgacagtgttcacctggcaaagaggaacctcacatgcatgcagggtggcaaggattttactggtgattcagatcttcaacaacaggctcttcacagtgggtggaagccacacagggacactcatggtgtggaggcctttcaaagtggacagaataattacagctgcacccaatgtgggaaagacttttgccaccaacatacactgtttgagcaccagaaaatccacacagaggaaaggccttatgagtgcagtgaatgtggcaaattgtttaggtacaactctgaccttattaaacatcagcgaaatcatactggagaaaggccttataagtgtagtgaatgtggaaaagccttcagcctcaaatacaatgttgttcaacaccagaaaattcacactggagaaaggccttatgagtgcagtgaatgtgggaaagcttttcttagaaagtctcacctacttcagcaccagaggattcacaccaggccaaggccttatgtgtgtagtgaatgtgggaaggccttccttacacaggctcaccttgttggtcaccagaaaattcatactggagaacggccttatggatgcaatgaatgtgggaaatactttatgtacagttcagcactcattagacatcagaaagttcacactggagaaaggcctttttattgctgtgaatgtgggaaattctttatggacagctgcacactcattattcaccagagagttcatactggagaaaaaccttatgaatgcaacgaatgtgggaaattctttagataccgttccacactcattagacatcagaaagttcacactggagaaaagccttatgagtgtagtgaatgtgggaagttctttatggacacttccacactcattattcatcagagagttcatactggagaaaagccttatgaatgcaacaaatgtgggaaattctttaggtattgcttcacactgaatagacatcagagagttcactctggagagaggccttatgaatgcagtgaatgtggcaaattctttgtggacagctgtacactgaagagtcatcagagagttcacactggagaaagaccttttgaatgcagcatttgtgggaaatcctttagatgtcgctccacacttgatacacatcagagaattcacactggtgaaaggccttatgagtgtagtgaatgtgggaaattctttaggcacaactcaaatcatattagacatcggagaaatcactttggagaaaggtcttttgagtgcactgagtgtgggagagtttttagccaaaattcccacctcattcggcaccaaaaagttcacactagggaaagaacttacaaatgcagcaaatgtgggaaattttttatggacagctccacactcattagtcatgagagagttcatactggagaaaagccttatgagtgcagtgaatgtgggaaagtctttagatacaactccagcctcattaaacatcggagaattcacactggagagagaccttatcagtgcagtgaatgtggaagagtctttaaccaaaattctcatctcattcagcaccagaaagttcacaccagataaagaatgtatatataaagcagatggggaaagacttcacacagaaatctactctgatttagcactgggacctacgttttaaaaaaagtattcttgtagaatacagataacataaaatctaacatcttaaccatgttaaagtgtatagttcagtaccgttaagtcattcacattgtgcaatgaatatctagaagtcttttcaacttatgaaactaagtctataccttttaaaaccttattcctcactccatccagcctcttgacaagcaccgctctgtatgaattttactagtccgggtacctcatataagaaaacttaagttttggtcttcttgtggtttattttgtggcttattttgcttaacgttatatttttaaggtttcatgttctaatccattagaatttccatcctttttaaaggctgaataaaattctgttagtcatgtgttgcttaacagtggggaagtgtcctgagaaaagtgttattaggtgattttctttctttttttggtggtggggggattgcgtgaatgcctaggctgtatggtatatcctatagcaccttgctacaaacttgtatagcatattactgtactgaatactgtaggctgttggaacacatggtaagtaattgtttttaagtatatctaaacagaaaaggtacagtaaaaatacagtataaaagaaaaaatgatagactcacagagaacttaccatgaatggagcttacagtactgcaagttgctctaggtgagtcagtgagtggtaagtgaatgtgaaggcctaggttgttactgtgctgtagactttatagacattgtgtacttagacgacaatacatttttatttttattattatttttgagacagaatcttgctctgttgcccagactagagtgcagtggtgcaatcttggcttcctgcaacctcctccacctcctggttcaagcagttctgcctcagcttcccaagtgtctgggattacaggcatgcaccaccatgccccgctaatttttgtatttttagtagagaacggggtcttaccatgttggccaggctggtctcaaactcccgacctcaagtgagccactcgctttggcctcccaaagtgctgggattacaggcatgagccaccgcacccggccggttttaccatttttagagccaagctttactatatatttgatatttgttctttcttcaaccttagctgaattcacattcctctgatagaaggtgttttcaaactgatgccgttcttagtgcctcaaactagatcctgttcatacttgttagaacaagttattacaaattcactttggtgtaaaaaattgaaatccatacataattttttttttttttttgacagagtctcactaacgctaggttggagtgcagtggcatggtctcggctcattgcaacctccgcctcctgggttcaagcagttctcctgcctcagcctcttgagtagctgggattacaggtgcccacaatcacgcccagctaatttttgtatttttagtggagatgggttttcactctgttggccaggctgctctcgaactcctgacctcaggtgatccacctgcctgggcctcacaaagtgctgtgattacaggcttaagccaccacccctggccaattttttcataatatacatttttttctcatttttcatgaaacttttgaagacccctcatattctagatattccttctcagatatgtggttttcaaatactttctcccattgagtctttttccttttcactctgtccattatgtccttttttacacaggaattttgaatttaaatggagtctaatatatctgttttataagtctttgatgcatttgagttcattttagcaacttaattcttttgcgtgtggatatccagttttttttttttaacatcaaaagaataatgtttttgcctagcattaaggcccttggtagaggcttgtcagttacaattttggagcagcagattaagtccacactcccaaccattttccttatcaggctctcaaactctgggccacaatatgtaagacccaatcaccccaggatcaggaatcagatatctagggacagcttctgtgcccaggagcttgtaaaattattccattggtcaatgcacaggggtccctgaaaacctagctaaccccaatttacatggcacacacaagctgccccctaagctccagcttgctgttatcttgggttccctcataactcttgcagccctgcctatgtccttaggtttcaagctgtaagtagcaaagtggtctacattttatgattatcattgtgacatgtcctgacatcagaaaaacacctttgtatgttattactatacaaccagcagaatattatgagtgcagcaaatgttagaaagtattcagcctaacttcactgagcaagagtaagttcatcctggagaaagtccttaggaatgcaggcaatatactttttttcctttgtcaacaggtcaaaaacagcaaagctctatcgagcttgtcttactcaccctatttttttgttgctctgttttgttttaggcttttagcctgaagccatggttttgtttctgtctctagtggtaggtggacaagaggaatgagatgagaaaggagctttactggcccagctagaaacaaactaagaacccatgactgtattctttcccttggatgaccctgtgttagcttgttgagggagatctcagcctgaaattgaatctcacatccaaacatccacgcaagggagatttgttgtaattgtcagatatatggtaaatttttgtgaatgatgttgcactttctgacctgcctggggcctttccagagttaagttgctgaaagtgtgcattacagaagactcctgctattagctgtcatggtgccacaatgtgcatcaccttagtcaccttaaattacttagagagtgataaggtctggacttctggttaaatgtttttaaaaaatggggggtgggggggtggtgcatagattgctgtgttctctacctttatctggaatattcagtcatttgttccctttgggggcctcattcccagtcccctgactggtttgggtgtggacatcacccagctttggacagagaacacacgccaacttcagctggcagcttgtagagatttccttttttcagaggtattattagttgtctgatactgataatgttgatgataaattttctaccttccaagcttcccaacccagtcaatttccacctaagcattgctgttttcttctgatgataaaggtcatattgtttaagctacatttactcttggggttctcttcactgtgtgctgcgggttgagaacaaaattaggctttgccagaatgaaaaagtgaatggtttttggggccttcaactttttgtgctcttgaagaaataagaagacaaaatagctttcaatccacatcaggcccaatttgcattgcttcgggagttcctgggaaagtgacggacttctatccaaaatcgcgccgtgaatttgattattggtagttctacagtcagcttgagggttgttggtttgacagttgtcagagcatgttgcagctgtatgaggtgggtatctgtacatatggatgtcccatattctccagcattgcataggaatagctggtgtctagatcctgcctcaggagctatgtgtcctgaatttaaaaatcaggtatgttatatccctggggcatgtcagacatacaacaacagtgcattagtccattttccattgcttacaacaaaataccttaaactgggtaatttgtaaagaaaataaatttcttactgttgttttgttgtgctttctttttttctagatcgcgagcggccgc

SEQ ID NO: 1231 - DNA, 2498 bp, Homo sapiens
agcgagtggcatcggccccgcccccagcccgtgctcgccggtgtcgggtcctaagtccctcggtcttgggttcccggagaggtgagtcggctgcaggtgggtgcggggcgccgggctgttcggggtaccggtgtcgcagtcgccagtccgagctcacaccgggcgtggagttcagctgcgcatcgggttgcggcagcttcgccaggcctggggctggctgggccgcggggccgccctggaggccggagccactgggcctgcggcgcctcggcagcgagcagccgctttgctcgcgtgcaggaggctgttcgctacctcacacccccggctggcgctgtggcctcgcttagctctaccgtttagcacccggcgacatgcacccggtcggtttccgccaggatgcgggagagttggggcaagctacctgcgacagcttgaacttttcctagggattccgctccacccgccggttagagcgtattgctcattaaatccgagacctgtgtgcttgctactgaaataaaagaagtattttttccccagagtccttttaggacgttatgacttttctcctttgcaagactgcaaaaaactgacaagaagacaaaactcttcccactcccagggaccgcgttgtcttgagtttggctagtaaaggctagcaagtgaggctttgtctctgcatcccgttccccctaacatcctcagagaaccttcgtttctagaatctttctagtattcagagacttctccagggtcatgatcccaaaggcttaacccgtttacaaggagagagttgtctcctgacgcccaaaatggcagctaaaatggagataactttaagctccaacactgaagcttcctccaagcaagagagacacataatagccaaactagaagagaaacggggccctcctctgcaaaaaaactgcccagatcctgagctctgccgccagagcttcagacgcttttgttatcaagaggtgtctggaccccaagaggctctctcccagctccgacagctctgccgtcagtggttgcaacccgagctgcacaccaaggagcagattttggagcttctggtgatggagcagttcctgaccatcctgcccccggagatccaggctcgggtcaggcatcgatgtccaatgagcagcaaggagattgtgaccctcgtggaagattttcacagagcatccaagaaaccaaagcagtgggtggccgtttgtatgcaggggcaaaaggtgctcttggagaaaactggatctcagcttggagaacaggaactgccagactttcaaccgcagactcctaggagagatctcagggagagctctccagcagagccttcccaggcaggagcttatgaccggctgagcccccatcattgggagaaatccccactcctccaagaaccaacccccaaattggctgggacagaggcccccagaatgagaagtgacaacaaggaaaatccacaacaggaaggggctaaaggagcaaagccatgtgcagtgtcagctggcagatccaaagggaatggtctgcagaatcctgaaccaagaggggcaaatatgagtgaacctcggttgtcacggaggcaggtcagctccccaaatgctcaaaagccatttgctcactaccagagacattgcagggtggaatacatcagcagccccctaaaaagccacccactgagagagctaaagaaaagcaaaggaggtaaacggagtctgagcaaccgtttgcaacatcttggtcaccagcccacccgctcagcaaagaaaccctacaaatgtgatgactgtgggaaaagcttcacgtggaattcagagctgaagagacacaagagagtccacacaggagagagaccctacacgtgcggagagtgtggaaactgctttgggcggcagtcaaccctgaagctgcaccagaggatccacactggagagaagccataccagtgtggccagtgtgggaaaagctttcgccagagctcaaaccttcaccagcatcaccgacttcaccatggggactaaaaggagcactccatgctttagattcacacggaaggtgtttgtgtttctcctcccccttacttgcatgtaaatcacaaaaactgtgtgacttacaaggaaagcacgaggcccttgaggaatgatgatgcacattctgctgtgaggaggcccagaaaaggccaaccagggcccaaccgtgcatgatgacagggtgaagagaaggcaggtctgggcactggggcaaagagaacttaagtctctgcagagagcaaggagtaactactgagagagaatcaggacaatcctgcaggtggcccgcttactgttaaatcgtccctctgttgctttatcctctaaaatatgttaagggataaattctatatatatagttatgcatttgctgtcataccagacaattttttatcatgagcacacttctttaataaagatgagtgatctaccagaaaaaaaaaaaaaaaa

SEQ ID NO: 1232 - DNA, 3788 bp, Homo sapiens
agagcgaccatttagcttctgttgttaagtggatctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggcttctgcagaacccccaggtcaggccacatcattgaggctgcaggatctctcttcatagcccagtacgactctccgccgtgtccctggttggaaaatccaaacacctatccagcttctggctcctgggaaaagtggagttgtcagcaagagagaccgagagtagaagcccagagtggagatgcctgctgatgtgaatttatcccagaagcctcaggtcctgggtccagagaagcaggatggatcttgcgaggcatcagtgtcatttgaggacgtgaccgtggacttcagcagggaggagtggcagcaactggaccctgcccagagatgcctgtaccgggatgtgatgctggagctctatagccatctcttcgcagtggggtatcacattcccaacccagaggtcatcttcagaatgctaaaagaaaaggagccgcgtgtggaggaggctgaagtctcacatcagaggtgtcaagaaagggagtttgggcttgaaatcccacaaaaggagatttctaagaaagcttcatttcaaaaggatatggtaggtgagttcacaagagatggttcatggtgttccattttagaagaactgaggctggatgctgaccgcacaaagaaagatgagcaaaatcaaattcaacccatgagtcacagtgctttcttcaacaagaaaacattgaacacagaaagcaattgtgaatataaggaccctgggaaaatgattcgcacgaggccccaccttgcttcttcacagaaacaacctcagaaatgttgcttatttacagaaagtttgaagctgaacctagaagtgaacggtcagaatgaaagcaatgacacagaacagcttgatgacgttgttgggtctggtcagctattcagccatagctcttctgatgcctgcagcaagaatattcatacaggagagacattttgcaaaggtaaccagtgtagaaaagtctgtggccataaacagtcactcaagcaacatcaaattcatactcagaagaaaccagatggatgttctgaatgtggggggagcttcacccagaagtcacacctctttgcccaacagagaattcatagtgtaggaaacctccatgaatgtggcaaatgtggaaaagccttcatgccacaactaaaactcagtgtatatctgacagatcatacaggtgatataccctgtatatgcaaggaatgtgggaaggtctttattcagagatcagaattgcttacgcaccagaaaacacacactagaaagaagccctataaatgccatgactgtggaaaagcctttttccagatgttatctctcttcagacatcagagaactcacagtagagaaaaactctatgaatgcagtgaatgtggcaaaggcttctcccaaaactcaaccctcattatacatcagaaaattcatactggtgagagacagtatgcatgcagtgaatgtgggaaagcctttacccagaagtcaacactcagcttgcaccagagaatccactcagggcagaagtcctatgtgtgtatcgaatgcgggcaggccttcatccagaaggcacacctgattgtccatcaaagaagccacacaggagaaaaaccttatcagtgccacaactgtgggaaatccttcatttccaagtcacagcttgatatacatcatcgaattcatacaggggagaaaccttatgaatgcagtgactgtggaaaaaccttcacccaaaagtcacacctgaatatacaccagaaaattcatactggagaaagacaccatgtatgcagtgaatgcgggaaagccttcaaccagaagtcaatactcagcatgcatcagagaattcacaccggagagaagccttacaaatgcagtgaatgtgggaaagccttcacttctaagtctcaattcaaagagcatcagcgaattcacacgggtgagaaaccctatgtgtgcactgaatgtgggaaggccttcaacggcaggtcaaatttccataaacatcaaataactcacactagagagaggccttttgtctgttacaaatgtgggaaggcttttgtccagaaatcagagttgattacccatcaaagaactcacatgggagagaaaccctatgaatgccttgactgtgggaaatcgttcagtaagaaaccacaactcaaggtgcatcagcgaattcacacgggagaaagaccttatgtgtgttctgaatgtggaaaggccttcaacaacaggtcaaacttcaataaacaccaaacaactcataccagagacaaatcttacaaatgcagttattctgtgaaaggctttaccaagcaatgaattcctagtgcatcagcatattcataaatgaaatatactccgagtttcttgaagaagagaaaatcttctcagaatcaggtctaattatatgttattgaattcatgcttcagaaaaactctagggatgcactgcatgtgtgaacacatgataaaaaagtcatgctttattttagtgagggcaattacagagaaaagagtaagcagaaatgtccttctgagtactggcctcattaaggattataaattttctccccgggaagaaaccctgactaacgcattgagaaaagcctttctgtaaagaatggtacaagacaggttgttactcgattatttatagtaaaatatgtgggaaattatatcaatgataaccctgtttattgtgggatatcaatatttttaaagtgccaacacagtcatgataggacaatattttatgtgtgtgtgtgcgccttatgtatataagcatatatataatatataagcatattattatatacaggttgagtatcccttctccaaaatgcctgggatcagaagcattttggatttcagatacttacagattttggaatatttgcattatatttattggttgagcatccctaatctgaaaatccaagattaaatgctccaattagcatttcctttgagcgtcatgttagagttcaaaaagtttcagattttgggttttcagattaggaatacccaacctgtatgtacgtatatttctgtatctatgtatgtatatatatgcatatgcagacatatgtatatggtctggtcagcatatgtgtatgtatgcgtatgtatgtatgtatgtatgccctcagtgcagtggggtttgctgcagaattcactgcatagcaggagatgtaagcagatgagttattttttaagagaatctaatctaattgtttttataaaaattattccctattgaatatttatataatgaggttgtatcaacaatgattaactcctttattatacatacacatgaatgtgcatttttggtaaatgcataaatgagattctataatgtttactgatctttatattacagattttctcttcttttaggattagctcagcttgccccccctttccatctccaccatctatagtgagcctctccataattagtgccaaccattagtctcgttcatatttttacaccaggagtcaacaaactgtggccattggccaaatatggcctcccaactgtttttttaaaataaagttttattggaacacagccatgttcatttggaaaa

SEQ ID NO: 1233 - DNA, 2274 bp, Homo sapiens
cgccatctcccatagctgtcgcctgcagctgagaaagggttgctgtcccagcaggccaggtccagggctgggtataagtaagcaagaagagggcctgggagaagagtctgacgagcaaggggaaggtagccaaggatggagtgaaatacagggtgacctgtgtttttcccctggctgctttggaaattatgggaaaaaatcaaataccaaggaagaaaaatctataatgaaattagatgtggatttctttttatgtattcagcttgggggcttatgatacttctagtacccaaagagatgcggtcttgctgtgttgcctaggctggtctcaaactcctgctctcaagtgatcctcctgcctcagcctcctgagtacatttatatttaaagtaattattgatggctctgcctgcttaggactctgcccagccaggaaggaaacctacaggaggaagaatggctgcagggtggctgacaacctggtcacagaactcagtaaccttccaggaagtggcagtggacttttcccaggaggagtgggcattgctggaccctgctcaaaaaaatctatacaaagatgtgatgctggagaactttaggaacctggcctcagtagggtatcagctctgcagacacagtctgatctccaaggtggatcaagaacagctgaagacagatgaaagaggaattttacaaggtgactgtgcagactgggaaactcaacttaaaccaaaagatacaattgctatgcagaacattcctgggggaaaaacatccaatggcataaacacgaactgtgtcagaactcactctggagagatgccctatgaatgcagtgactgtgggaaagccttcatttttcagtcttcccttaagaaacacatgagatctcatactggagagaagccttatgagtgtgatcactgtggaaaatcctttagccagagctctcatctgaatgtgcacaaaagaactcacactggagagaaaccctatgactgtaaggaatgtgggaaggctttcactgttccttcatcccttcagaaacatgtgagaacccacactggagagaaaccctatgaatgcagtgactgtggaaaagccttcatcgatcagtcatcccttaagaaacacacacgctctcacactggagagaagccttatgagtgtaaccagtgtggaaagtccttcagcacaggctcttaccttattgtgcacaagagaactcacactggtgagaaaacctatgagtgtaaagaatgtgggaaggcctttaggaattcctcttgcctgagggtacacgtgagaactcacactggagagaagccttataaatgtattcagtgtgaaaaagcctttagcacaagcactaaccttataatgcacaagcgaatccacaatggccagaaactccatgaatgaaatgactcagggaagtgtttgttgcccctcatgcctcctttctcactttagaacatatattggagagaagccctgttatggtcacctggaaacagccttctggcccaactctggatgcctgttatactgggacaaaccttataaatgttatagctatgattgtttttatcagtgagtatttcattcttatatgtgtcacaactgtagatcctatgaatattttagttatcttttcagtttaattgcattgtgaacagaacacatggtcttcaatatgtagattctgtgtgacatagatttgaacataattgctggacactgactgatgtactgtggcagacagaactagttgctgtctcaatatccattcctcccttctttcttaaagtaataaaatttaccatttagttcaagctggcaatgtggacagttttcacccagcttcccttacagctgtgagcggccaaatatgttcacatccctagcccatgcaaagtaggcagaagtcactggatacagctgctaaggaagctcatggaaatgggaatatctcatctggtgtttttttcttaactatttgccctttgtcttgtcccttatttcctagaaaatatatacaccaagaggaggacagagaaaggatactaaatgaaacaacaggggagatacaatattatctggttgcactaatcctgtgctgcttatctctggatttcatgttacatgagaaaaattaactgccatgtggtttaaaccactcttgtgggaagttcctctttcagctgatttcagtcccaactgttacatctaataaatggtcaagttttaggaatcgttcaaaaaaaaaaaaaa

SEQ ID NO: 1234 - DNA, 3252 bp, Homo sapiens
gtgtctcctccccctggggtgagtccagcagcagcctcctctttcctgactgtcacatttcttttccagctctgaccgggagtcagctcctcggggataccatcccccgacctcaccttctacctaccgcagcctgctagcctttccgggagaaaaggcatccttacctctggttgaaggtctcggggcctccccctctgcatccggaccctctccccatcccagcctcccatgccaaggcccgccttgtcagtcacttccttttgtcatcggcttggcaaacgggagagaaaacagagcttcatgggaaacagcggcaacagttggtcccatacacctttccccaagttggagctaggcctggggccccagcccatggcgccccgggagctccctacctgctccatctgcctggagaggttgcgcgaccccatctcgctggactgtggccacgacttctgcatacggtgcttcagcacacaccgtctcccgggctgtgagccgccctgctgtcctgagtgccggaagatatgcaagcagaagaggggcctccggagcctgggcgagaagatgaagctcctgccgcagcggccgctgccccctgcactgcaggagacgtgtcctgtgagggcggagccgctgctgctggttcgcatcaatgcctctgggggcctcatccttaggatgggggccatcaaccgctgcctgaagcaccctctggccagggacaccccagtctgcctcctcgctgtcctgggggagcagcactcagggaagtccttcctcctcaaccatttgcttcagggcttgccgggcctggagtctggtgagggcggccggccaagaggaggagaggcatccctgcagggctgcaggtggggcgccaatggcctcgccaggggcatatggatgtggagccaccccttcttgctggggaaagaagggaagaaggtggcggtgttcctggtggacacaggggatgccatgagccctgagctgagcagggaaacaaggatcaagctctgtgctctcaccacgatgctgagctcctaccagatcctcagcacctcccaggagctgaaggatacagacctggactatctggagatgtttgtccacgtggccgaggtgatgggcaagcattatgggatggtgccaatccagcatctggacctcttagttcgtgactcatcccaccccaacaaggcagggcaggggcatgtaggcaacatcttccagagattgtctggcagataccccaaggtgcaggagctgctgcaagggaagcgagcccgttgctgcctcttgcctgccccagggaggcggcggatgaaccaaggccatgcaagccctggtgacacagatgatgacttccgccaccttctgggggcctacgtctcagatgtgctgagtgcggccccccagcacgctaagagccgctgccaggggtactggaacgaggggcgcgccgtggccaggggggacagacgcctactcacggggcagcagctagctcaggaaatcaagaacctctcaggatggatggggaggacagggcccggtttcacctctccggatgagatggctgctcagctgcacgacctgaggaaggtggaagctgccaagagggagttcgaggagtatgtgaggcagcaggacgtagccaccaagcgcatattctctgcgctgcgggtcctgccagacaccatgcggaacctcctctccacccagaaagatgccattctggcccgccatggtgtggccttactctgcaaggggagagatcagaccttggaggcactggaagctgagctgcaggccacggccaaggccttcatggactcctacacgatgcgcttctgtggccacctagctgctgtggggggtgctgtgggggccgggctcatgggcctggcagggggcgtggtgggtgctggcatggcagcagctgcactggctgcagaggctgggatggtggctgctggagctgccgtgggggccacaggggccgctgtggttgggggtggcgtgggtgctgggttggctgccacagtgggctgcatggagaaggaggaggatgagaggcttctggaaggggaccgagagccccttctccaggaagagtaacagccccaggaggtattgaaggacaggagagatgtcaggtggggatgaagaagaggggcaggtcgggggagggtgatgccagggattccaaggcaccgccatgtactgcactgccctggtcgaatgctcggtgtctgggtggcagctgagctgggactcaaggtggctcttggaacctgggaggcagcatctgggggcagtggatagaacacccggcctgtttctggttgcagatggttgccgatctgcccttgtcacagataggctacatcccagggtttctggctgcaagtgagactccaccctccccacctggctcatttccccgatgaccctggattgtaggaaagttaagcaggcaccatcctggaagtctacccctaggtggtcgagagacctgttctttcacagatgtgagaagccccaggatgattgaccatggtgttcaggagcggggagcactgatgaggtgctggggatgacaggaaggaaggaacactgggcagaaccagagagatgggacatggtagactgtggcccagaccccagagcagagaaacttgttcccatgacccttcccaaatctgctccagcaggactaaggtggctttcccactcctggcccacagccccagagagcctgtctgtgcatcctgaaccactctttgctgggcctccgcaagggcctctcttgggtctgtgtcctttttcaagcctgtttagatgggggagtgcccatgccctctgtgaagtgcccaaatgcgaaagaataacaccttttcttgcattctgagctaagccagacagcctttatactagattctatcaaaatcttgcaaaggaaaacaaaatgaacaacttctacccttaaacacatcctttctcccctgggcttgtaagaagatgcagcttgatgcagctcctcaaacaccaggccccctgggaactgggggtgcgggagttctccctctgggggacagaaaatctgactactaggaagacttctaggctatgaaactgacttctaggctatgaaacttacagggtatgggtgggcacattatcctttattttatgaaaaataaaatgtgtgtatgtgaaaaaaaaaaaaaaaaaaaaaaaaaa

SEQ ID NO: 1235 - DNA, 168 bp, Homo sapiens
tttcagtgcaccatctgcaaaaaagcctttctgcggagttcagactttgtgaagcatcagagaactcacacgggagagaagccctgtaaatgtgattactgtgggaaaggctttagtgacttctcaggattgcgccaccacgagaaaatccacacaggagagaaaccc

SEQ ID NO: 1236 - DNA, 3140 bp, Homo sapiens
acaagagcagccattgtcccgcgcgcggacgcttgctgtcgccgagcagctcggcccttcagacttaacccccagcggccttgcggatgctgactaggagaggggaccgaactagcttaacccgagtcggccgtgttgcagaatcggggcagggggttgcctaacccgagttcgtcctgccgcagagccgtgctaggcactgaggcggtgacaggcccagcctgggctgcgggccagcggacgcccaggttggtaggggcgtggggcagcgcttggtgtccgatgcgcgcatgcgcagggtctacgcgggaagctggaagcggtgctcaggacctcagcaccctgctgtgcctggaggagagcatggaagagcaggatgagaagcccccagagcccccgaaggcctgtgcacaggattctttccttcctcaagagattatcatcaaagtcgagggagaagacactgggtctctgaccatcccatctcaggaaggagtgaacttcaaaattgtgactgtggacttcacacgggaggaacagggtacttggaaccctgctcagaggaccctggacagagatgtgatcctggagaaccacagggacctagtctcttgggacttggcaactgcagttggaaaaaaagattcaacttcaaagcagaggatttttgatgaagaaccagctaatggagtgaagatagaaaggtttacaagggatgatccttggttatcttcatgtgaagaagtggatgattgtaaagaccagttggagaagcaacaggaaaaacaagagatacttttgcaggaagtggcattcactcaaaggaaagcagttattcatgagagagtctgcaaaagtgatgaaactggggagaagagtggtctgaattccagtctattttcatccccagttatacccataagaaaccattttcataaacatgtatcacatgctaaaaaatggcatcttaatgctgctgtaaacagtcatcagaagattaatgagaatgagacactatatgaaaataatgaatgtggaaaaccccctcagagcattcaccttattcagtttacaagaactcaaacaaaagataaatgctatggatttagtgaccgtattcaatctttttgccatggtacacccctacatatacatgaaaaaattcatggaggaggaaaaacctttgattttaaagaatgtgggcaggttttgaaccccaaaatatcccataatgaacaacagagaattccttttgaagagagtcaatataaatgtagtgaaacctctcatagttcctcccttactcaaaacatgagaaataattctgaagagaaaccttttgaatgtaatcagtgtgggaaatccttcagctggagctcgcatcttgttgcacatcagagaactcacacaggggagaaaccttatgaatgtagtgaatgtggaaaatccttcagccggagctcgcaccttgtttcccatcagagaactcatactggagagaaaccttacaggtgtaatcaatgtgggaaatcctttagccagagttatgtccttgttgtgcatcaaagaactcatactggggagaagccttatgaatgcaatcaatgtggaaagtcattcaggcagagctataaacttattgcacatcaaagaacacataccggagagaagccctatgaatgtaatcaatgtgggaaatcatttatccagagctataaacttattgcacatcaaagaattcatactggggaaaaaccctatgaatgcaatcagtgtgggaaatcctttagtcaaagttataaacttgttgctcatcagagaactcacacaggagaaaaaccctttgaatgtaatcagtgtgggaaatccttcagctggagctctcagcttgttgcacatcaaagaactcacactggagagaaaccgtatgaatgtagtgaatgtggaaaatcttttaaccgcagttctcaccttgttatgcatcagagaattcacactggggaaaaaccgtatgaatgtaatcagtgtgggaaatccttcagccagagttatgttcttgttgtacatcagagaactcatactggagaaaagccctatgaatgcagtcaatgtgggaagtccttcagacagagttcatgccttactcaacatcagagaactcatactggagagaaaccatttgaatgtaatcagtgtggaaaaacatttagcttgagtgctcgacttattgtgcatcaaagaactcatactggagagaaaccctttacatgtattcagtgtggaaaagctttcattaatagctataaacttattaggcatcaggcaactcatactgaagagaaactctatgaatgtaactagtttgtaaatcagctgggatttcttcctttttatttcattcttttaaaaaatttattttaaggtagtacatgtagttggaagaactactataaaaacaatatatgtgggaaaacttccagccctctgttaattgtgtgtctcaaatttgttctggaaaagaaagggggaaagtctatgaacgacttttcaacctggcaattccatatacaatgttaaacttgattcttatgacatattcctatgaaaataataaatactggcacttttccttgcagaaagcactcagacctgaatcagagaaaatcatatgccaaagccaactgccagtgttagacctctttttccataaagagtaaatggaatgctaacactagtgggcttattgagaaaatttaaaggttgctgtagtgtttagaacttaggctggaaaaccatattttagtgcatcattttactacatgatcttccaattagatagcttgtaatctgttccttacagcacttgctgttgttacatgtgaagattttataaattttaggaaagtgtctatgatatatagtgaaaagtgtgggaaaagaatatagaaataatattcacttctaaaaccattatgataaaatatttgtgtatggattagaatagaaagggattatggatgtatctattcaatttctcagtttatgttgggccttcctttttggaatgtacgctgttatgctatgataaatgatataatgagtaaaaattattcaaagccaaaaaaaaaaaaaaaaaaaaa

SEQ ID NO: 1237 - DNA, 1312 bp, Homo sapiens
gcggccgcccgcgagcggggcggtgccacgtacggctccggaagaagcgacggaatctgctagggcacaagagagacgggcgctcgggctctcgcagtcctcttccgtcagtgtcttttgcttcgactcccggcggagcgcgcaacgtggagtgacgtgcaggggccaagtgcaacccaggcagccacggctgtttcggagctcaggactctaaaatggcagagcagctttctccaggaaaggcggtggatcaggtgtgcaccttccttttcaaaaagcctgggcggaaaggggctgctggacgcagaaagcgcccggcctgcgacccagagcccggagaaagcggcagcagtagcgacgaaggctgcactgtggttcgaccggaaaagaagcgggtgacccacaatccaatgatacagaagacccgtgacagtggtaaacagaaggcggcttacggcgacttgagcagcgaagaggaagaggaaaatgagcccgagagtctcggcgtggtttataaatccacccgttcggcgaaacccgtgggaccagaggatatgggagcgacagctgtctatgagctggacacagagaaagagcgcgatgcacaagccatctttgagcgcagccagaagatccaggaggagctgaggggcaaggaggatgacaagatctatcggggaatcaacaattatcagaaatacatgaagcccaaggatacgtctatgggcaatgcctcttccgggatggtgaggaagggccccatccgagcgcccgagcatctacgtgccaccgtgcgctgggattaccagcccgacatctgtaaggactacaaagagactggcttctgcggcttcggagacagctgcaaattcctccatgaccgttcagattacaagcatgggtggcagatcgaacgtgagcttgatgagggtcgctatggtgtctatgaggatgaaaactatgaagtgggaagcgatgatgaggaaataccattcaagtgtttcatctgtcgccagagcttccaaaacccagttgtcaccaagtgcaggcattatttctgcgagagctgtgcactgcagcatttccgcaccaccccgcgctgctatgtctgtgaccagcagaccaatggcgtcttcaatccagcgaaagaattgattgctaaactagagaagcatcgagctacaggagagggtggtgcttccgacttgccagaagaccccgatgaggatgcaattcccattacttaggtttcccataattcttaaatttaaaaaataaacgttttgttcttttggaaaaaaaaaaaaaaaaa

SEQ ID NO: 1238 - DNA, 1381 bp, Homo sapiens
gccacggccgttgggagcctgagactcaaacatggcagcgccaccttctccaggaaggacggccgaccaagcagaccaggtatgcaccttcctcttcaaaaagcctggacggaaaggggctgcaggcctcagaaagcgcccggcctgcgaccccgagcacggagagagcagcagcagcggggacgagggcgacacagtggctcagcccccgcgggtggcaccgaggccccggggcctccacagctggcagaaggcggctcacggcgacaggaggggcgaggaggcggcgcctgagagcctcgacgtggtgtacaggtccacccgctcggcgaagcctgtggggccagaggacatgggggccaccgctgacttcgagcaggacaccgagaaggagcaccatacgccgaccatcctcaagtgcagccagcgggtccaggaggcactgcggggtcgggagcacgaccacatctaccggggaatccacagctacctgaggtacctgaagcccaaggacacgtccatgggcaactcctcctcggggatggcgaggaagggccccatacgtgcgccagggcatctgcgcgccactgtgcgctgggattaccagcctgacatctgcaaggactacaaggagactggcttctgtggcttcggggacagctgcaaattcctccacgaccgttccgattacaagctcgggtgggagattgaacgggagcttgaagagggtcgctactgtatctgcgaggacgaaaaccatgaagtgggaagcgaggaagaggaaataccattcaggtgtttcatatgtcgccaggccttccaaaacccagtcgtcaccaagtgcaggcattatttctgcgagagctgcgcgctggagcacttccgggccaccccgcgctgctacatctgtgaccagccaaccggcggcatctttaaccccgccaaagaactgatggcgaaactgcaaaagcttcaggctgcagaaggaaaaaagagataagaaagactcaagtctgtatgtacactggggagaagcagcctgttgagtaagatgagagagatgacagtcttcctgcaatcccatgcctgagtatgtaaccaaaagaattgaaatccggatctcaaagaggtatgtgcactcccatgttcactgcagaattatttgcaaaagccaagaggtgtaaacaacccaagtgtccatggatggatgaatggacaaacaaaatgcgatacacacacacaatggaatgctattaagccttaacgggaaggaaatccttttaaagatttaaactgatccttttaaggatcacatgctacaactagaatgaaccttgaagacgacactgctaagtgaaataaactagtcacaaaatgaaaa

SEQ ID NO: 1239 - DNA, 2678 bp, Homo sapiens
gaatcggtgactttcaaggatgtgatagtggactttacccaggaagaatggaaacagctggaccctggccagagagatttgttcagggatgtgacattggaaaattatacacacctggtctctataggactccaagtttctaaacctgatgtgatttcccagttagagcaagggacagagccatggatcatggagccaagcattccagtaggtacctgtgcagactgggagacaagacttgaaaatagtgtgtcagccccagagcctgacatttctgaagaagagctatctccagaggtaatagtggaaaaacacaaaagagatgattcttggagttccaacttgctagaaagttgggaatatgaaggcagtttagagagacagcaggcaaaccaacagacactgccaaaggaaataaaggtaaccgaaaagacaatacccagttgggaaaaaggccctgtaaataatgaatttgggaaaagtgtcaatgtgagttcaaaccttgtaacacaagaaccatctccagaagagacctctactaaaagaagcatcaaacagaattcaaacccagttaaaaaagagaaatcttgtaagtgcaatgaatgtgggaaagcctttagttattgttcagctcttattcgccatcagagaacacatactggagaaaaaccctacaaatgtaatgaatgtgaaaaagccttcagccggagtgaaaaccttataaaccatcaaagaattcatactggagataaaccatataaatgtgatcagtgtggaaaaggcttcattgagggtccatctcttactcgacatcaaagaattcatactggagaaaaaccatataaatgtgatgaatgtgggaaagcctttagtcagaggacccatcttgttcagcatcagagaattcatactggcgagaagccatacacttgtaatgagtgtggaaaagcctttagccagagaggccactttatggaacatcagaaaattcatacgggaggaaaaccttttaaatgtgatgaatgtgataaaaccttcaccaggagcacacaccttactccacatccaaaaattcatactggagaaaaaacctataaatgtaatgaatgtggaaaggccttcaacgggccctcaacttttatccgtcatcatatgattcatactggtgaaaaaccgtacgaatgcaatgaatgtgggaaagccttcagccagcactcaaacctcactcagcatcaaaaaactcatactggggagaaaccctatgattgtgcagaatgtggaaaatcttttagttactggtcatcccttgctcaacacctgaaaattcatactggagaaaaaccttacaaatgcaatgaatgtggaaaggccttcagttactgctcatcccttactcaacatcggagaattcacactggagaaaaaccctttgaatgcagtgaatgtggaaaggctttcagttatctctcaaaccttaatcagcatcagaaaactcatactggagagaaagcttatgaatgtgaagaatgtgggaaagcttttattcggagttcatctcttgctcagcatcagagaattcatactggagagaaaccctatcagtgtcatgaatgtgggaaaaccttcagttatggttcatcccttattcagcataggaagatccatactggagaacgaccttacaagtgtaatgagtgtgggagagcattcaaccagaacatacaccttacacagcataagagaattcatacaggagccaagccttatgagtgtgctgagtgtggtaaagcctttcgacattgttcatctcttgctcaacatcaaaaaactcacacagaagaaaaaccctaccagtgtaataaatgtgaaaagacctttagccagagctcccatctaactcagcatcaacgaattcacactggggagaagccctataagtgcaatgaatgtgacaaagcctttagccggagcactcatctgactgaacatcagaatactcatactggagagaaaccttataactgtaatgaatgcagaaagacttttagccagagcacatatctcattcagcaccagagaattcattcaggagagaagccttttggatgtaatgattgtggaaaatccttcagatatcgctctgctctcaacaaacatcagaaactgcatcctggcatatgacaattctaggaacatcataaatttaggggagatatttactttagtttgtccttttgttaagtactgaagaatcagagtggatttagaaactgccttgaaatcttttaaattttcactatcatgttatggaatggaaagtacattgggctgaactaatccaattgttattaagccactctgtgacattagaaaactctactgttttaagctttagtttcctttatggaatgaaggctttggagtagattatttcaaaggtagtttggagttttataatcagttttgtatatttacaatattttcttgaatgggtttactatacatcagcattttgctgtgttgcatctagaatgtgtatgtttatgcatgttttgccaatagaatttgtgcttcagtaactagatcggggatctagtatgctcctggtctaatgcatttacattgtttaggtaactggttcctaataaaaagaattataaaataaaaaaaaaaaaaaa

SEQ ID NO: 1240 - DNA, 4312 bp, Homo sapiens
ctgaatcaagtgagaggagagctgcggagcaatcaccatgagtatctcagctcttggaggccgcaccaaagggaagcctctgccaccaggcgaggaggagcgcaataacgttctcaagcagatgaaagtgcgaaccacgctgaagggggacaagagctggattaccaagcaggatgaatcggagggtcgcaccatagagctgccctcaggccggagtcgcgccacatccttttcatcagctggggaggttccgaagcctaggcctccgagcacaagggctcccactggctacatcatccggggagtgttcaccaagcccatagacagctcttcccagccccagcagcagttccccaaggccaacgggactccaaaaagtgctgccagtctggtgagaacagctaacgctggtcctccccgcccctcctcctctggctacaagatgaccactgaggattacaagaagctggcaccctacaatatcaggcgcagctctacatcaggggacaccgaggaggaggaggaggaggaggtggtgccattctcctcagatgaacagaaacggaggtcagaggctgcaagcggtgttctgaggaggacagctccccgggagcactcctacgtcctgtcagcggccaagaagagcactggtcctacccaggagacacaggcaccgtttatcgcgaagagggtggaggtggtggaagaggacgggccttctgagaagagccaggacccacctgctctggcaagatccactcctggctcaaacagtgcggatggaggcaggaccaaagcgtctcgggcaatttggatcgagtgcctgccaagtatgcctagccccgctgggagccaggagctcagctcaagaggtgaggaaattgtccgcctgcagatcctgacacccagggcaggactccgcctggtggccccagacgtggaaggcatgaggtcttccccaggcaacaaagacaaggaggccccctgctccagagagctccagagggacttggctggtgaggaggctttcagggcccccaacacagatgctgcaaggtcaagtgcacagttgagtgatggcaatgtgggatccggagccacgggctcccggcctgaaggcttggctgcagtagacatcggctccgagagaggaagctccagtgccacttcagtctctgctgtccctgctgataggaagagcaacagcacagcagcccaggaggatgcaaaggcagacccaaagggggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcagggtgaggagcccctcgagctgcatggtcactgttactgtcactgccacatctgagcagcctcacatttatattccagcccccgcaagtgaattggactccagctctaccaccaaagggattctcttcgtgaaggagtacgtgaatgctagtgaagtgtcttctgggaagccagtatctgcacgctatagcaacgtcagcagcattgaggactcattcgccatggagaagaagcctccatgtggcagcactccatactctgagaggacaactggagggatctgtacttactgcaaccgtgagatccgagactgtccaaagattaccctagaacatcttggtatctgctgccatgaatattgctttaagtgtgggatttgcagtaaaccgatgggcgatctcctggatcagatcttcattcaccgtgacaccattcactgtgggaaatgctatgagaagctcttctagcgaccccccaccgccaggctgatcagaagctgatgactcgtggacaaatttggctgtccccagttttgccccaagttgctgtctccccttccctcacctcctccctccctgtttgatttcttcatgcttttgcccttctcaagttgaagttgcatacatccaatatcgtatcttaatgatgctatgataattgcttgtgtgtgtagcttcttgtagcttagaaagcgctttatgcccatgatgtcatttcaggctcaaccaaagaggatcaaacaggaattccatcttggcttccctaagacagattggctttctaatgagtttaagtgggcagaagtgtagggttcagtgtgtcctgactcccttgaggcttataatgggccaagttgaagactgttgatgatccctggtgggtaaattgcagacatcaaatgctagggattggcataggctagtgtttagcttgtctatttgccatatctattttttttaaatttccatacacttgtaaaagtagttagttgcttttgattgagttatatagcagtttttcatttggtcttccactcacctttcactatatttgagtgttcccttacaggtatgttggcatgtgttggaaaatttacacaattaggtttaaattcagtaggatgtgattttaggatgctactgatcaaagtgatatctgtgtctgttggaatcttgatagctgattaatttgccctcaattctgctccctgaacttcacacataaatcttcccaagtgggttttagggtgtatagatcccagcaggattaaggaggtggaaaagcagctaacatttcttgaggctctaccacatagcaggcactgtcacagagtaatggcattaatccccataataatcctgtgaaggtgatattctcatcccatcttagacatgaggatattggaactcagagaggtggctattgcattgcgcagaacgctacagagcccatgctcttcccagagcagcacccacaaaagcaagcattgattttgtgctcagtgtgtgccaagcactgtgcagagggtacacagttcctgccaggttaacaccctcccttcaggcctcccaaaggcataggcttgcaaagagcagaaggtgtgaaatcacactcttcctctgggcatcctggatccctgaattatccccccccccatgaagtacttcaagggccaagctgcccctttccctcctctccgcccatgaaaatgcctccaaactgagatgctttcagctgagaacagatttgactcacagacattaccaaagaggagcttgtgaatccaggaaaagctccagggggctagctgatctgagcagagagctttcagtgacccattttcctgtctagactctgccttaagctagtggcaactgctggggccccaggtacttgggacatggaaactcgttggatggctgggcagatgtaagcctgtccatgcagtcagccgatcctctgctcaggttcagctggactctgccatctgtgggcccagcatcactctgtaagttccttgaaaggaagaacaaccttagagtatttctgatacaaaatgagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtg

SEQ ID NO: 1241 - DNA, 1658 bp, Homo sapiens
cggctccgggagctctgtcaacagtggctacagcccgagacccataccaaggagcagatcctggagctgctggtgctggagcagtttctgatcatcctgcctaaggagctccaggcccgggtgcaggagcatcacccagagagcagggaggacgtggttgttgttctggaggatttgcagctggatcttggagaaacaggacaacaggacccagaccagccaaagaaacaaaaaatacttgtggaggagatggcccctctgaaaggagtacaggaacagcaggttcggcatgagtgtgaagttacaaagcctgagaaagagaagggtgaggagacaaggattgagaatgggaagcttattgtagtaacagactcttgtggaagagtagagtcatctgggaaaatatctgaacccatggaggctcataatgagggctctaacttggaaaggcatcaggccaagcccaaagagaagattgagtataaatgctcagaacgtgagcagagattcatccagcacttggacctgattgaacatgcgagtacacacacgggaaagaaatcctgcgagtctgatgtgtgtcagagttccagtcttacaggacataagaaagtcctctctagagagaaaggtcatcagtgtcatgagtgtgggaaagcctttcagaggagttcacacctcgtcagacatcagaaaatccatcttggtgagaagccttatcagtgcaatgagtgtggcaaagtctttagccagaatgcaggccttttggaacatctcagaattcatactggagagaaaccttatctatgtatccattgtggaaaaaattttaggcgcagctctcaccttaatcgacatcagagaattcacagtcaggaggagccctgtgagtgcaaggagtgtggaaaaacctttagtcaggccttactcctcacccaccatcagagaatccatagtcactccaaaagccatcaatgtaacgagtgtggaaaagctttcagtttgacctcagaccttattcgacaccacagaattcatactggagaaaaacctttcaagtgtaacatatgccagaaagccttccgactaaactcacaccttgctcagcatgtaagaatccacaatgaagaaaaaccctatcagtgtagtgaatgtggagaagccttcaggcaaaggtcaggtctttttcaacatcagagatatcaccacaaagacaaactggcttgatgaggtgttctctccttgtagaacatcagagaaggcacattgactagcaaacagcactttaggaaaagtcaccgtagcccactgtgggatcagaaaattcttgggggctgagttggaggctccctgcctctattctctctcctttgctttccttgaagtcagctttggaccacaataatttcactgtagatgatatgctaggatcaaagttaaacagcattcttcactgcaggacatctcagagcatgtaacataactgcatgattatatactctaagcaatagagagcttcatgactgagtaagagttttgaagtcagcagtgaatcaagtgacagatttgcaggcttaagcagaacaagggaagattgatatttttggatatgctatagcagctttctcctatgaaataaaactgatgatgtttggaag

SEQ ID NO: 1242 - DNA, 3186 bp, Homo sapiens
ggaactggcagcggggaggaggctctagcgaggcctgaaaggctgcgtaaccaggcaggagtaggggttggggttcggggttgggggacagccagggatcgcgtctgatatgctgttggggtcgtgaccgtctgggggccgaggcaggcactggccagacccagccagggatcctcgtattcgtcgagcctaatttccagcagccgggtaggcctcaccagaggctcctttccgtgaggccgcccccaattcctgcccctattctctgcctgggagatggcttccccgagccccccgccggagtcgaaggggttgctgacatttgaggatgtggctgtgttttttacccaggaggagtgggattatctggacccagctcagagaagcctgtataaagatgtcatgatggagaattatggaaacctggtctcactggatgttttgaacagagataaggatgaggagccaactgtaaaacaagagattgaagaaattgaggaagaagtggaaccacagggtgtaatagttacaagaatcaaaagtgaaattgaccaggatcctatgggtagagaaacatttgaacttgttggtaggttagataaacaaagagggatcttcctatgggaaataccaagggaatctttgacccaggaacagagaatgttcagagaaaacactaacattatccgtaaaagaccaaactcagaagagaaatgccataaatgtgaagaatgtggaaagggttttgtccgcaaggcccatttcattcaacatcaaagggtccatactggtgagaaaccttttcagtgcaatgaatgtgggaaaagttttagtcgcagttcatttgttattgaacatcagagaattcacactggggaaaggccctatgagtgtaattactgtggaaaaacctttagtgtgagctcaacccttattagacatcagagaatccacactggagaaagaccctatcagtgtaatcagtgtaaacagagcttcagccagagaaggagccttgttaaacatcaaaggattcatacaggtgagaaaccccataaatgtagtgactgtgggaaagccttcagttggaaatcacaccttattgagcatcaaagaactcacactggtgagaaaccttatcactgtaccaaatgtaagaagagctttagtcgaaattcattgcttgttgagcatcaaagaattcacactggggaaagaccccataaatgtggtgaatgtgggaaagcctttcgattaagcacataccttatacaacaccaaaaaattcacactggcgagaagccttttctttgtattgagtgtggaaaaagtttcagtcggagctcattccttattgaacatcagaggatccatactggtgaaagaccttatcagtgcaaagagtgtgggaaaagtttcagtcagctttgcaaccttactcgtcatcagagaattcacacaggagacaagccccataaatgtgaggaatgtggaaaagcctttagtagaagctcaggtcttattcagcatcagagaattcacaccagggagaagacttatccatacaatgaaactaaggaaagttttgatccaaattgcagtcttgttatacagcaggaagtctaccctaaggagaaatcttataaatgtgatgaatgtgggaaaacttttagtgttagtgctcatcttgtacaacatcaaagaatccacactggtgaaaagccctatctatgtactgtctgtgggaaaagcttcagccggagctcatttcttattgaacatcagagaatccacactggtgagagaccctatctgtgcagacagtgtggaaaaagctttagtcagctttgtaatcttattcgacatcagggtgttcacacaggtaataaaccccataaatgtgatgaatgtggaaaggcctttagccggaactcgggtcttattcagcatcagagaatacacacaggagagaaaccttataagtgtgagaagtgcgacaaaagtttcagtcaacagcgcagtcttgtcaaccatcagaagatccatgcagaggtgaaaacccaagaaacccatgaatgtgacgcttgtggtgaagcctttaattgccgtatttctcttattcagcatcagaaattgcacacagcatggatgcaataaatgtagagcaatacataagctcaatttgatttgagactagtacccaagtgcagttttagtatggctcaacatgggtcagatttagtgataaagcaaattctccttggcctcaggcaaatagtttctaaagattctgtgaatagtggacaactgcccatgagcatttgacttcccttactctttgatgatcgtagagaaagacttggtaatttatctaagtatctttaataaatctttcagcagagagattaaacctaggttcagagcatgggtgctctgagggacaaagttggattagtataagggagctggagcagctgatagtggaaaacagaataatgattcaaagagtcttctgtcaccatgtcatattgtggttctttcagttccatgatatgtttggctctgcatgccaaagtccagtgattaagcatatataagttgtcaaggaaacaaagcccaaatgtttttaaaacaagtatacagtttttgtcattgtttaagaaagccagttgtttggcatgtgagttaaaggcagttccaatgcctgatggttcccagatctatgaaatgagtggaccattaaccttacatgtaaagattatgttagtaattaagaaacctaacaaaggtgttaccaaggaacctttgggagtgccttttttgtttttcaagatggacccaaaaaagtggaggaagatattgttcttttgtgccctcctacctgtgagagatatttgtagtcctatgtgaatgagcttatccctccacaaccaggtgcatatgaaagtgtacatattatgactgccaagtattggaaatgaaaagacctggagtctatgctaggaagctgagatattttggtattgcattggtttttatggtaactaggttttgcatgcaattaaaaatccttatttcttgttctagggcttcccttagttaatggttattataaacctattaattcatctgttttaaccattaaaacctgttttgtttttagctttgaaaaaaaaaaaaaaaaaa

SEQ ID NO: 1243 - DNA, 2743 bp, Homo sapiens
acaagcgtgacgcacttccggcctcctaaccgttctcgctagcggtgcgcttctggcctgttttgagtccgcgctcaaaggtctctgaggatccccgggtggaaactcctcccgggagtaaaaccacacaaccactgagaagaccgctccggcatcctagagagtacgcgtgtgagcctgggtgcaaggccaaagtagtgacgcacttccgttcacgcaccgctttctgtttttcctgagcctttgcctgctaagagggagaccaggtcatggcagccatgcctctgaaagctcaataccaggagatggtgaccttcgaggatgtggctgtgcacttcaccaagacagaatggactggcctttctcctgcccagagggccctgtacagaagtgtgatgttggagaattttgggaacctgactgctttggggtacccagttcccaaacctgcactgatctcacttttggagagaggggacatggcttggggcctggaagcacaggatgatcccccagcagagaggaccaaaaacgtctgtaaagatgttgagaccaacattgacagtgagtccacattaatccagggaatttctgaagaaagagatgggatgatgtcacatggtcagctgaagagtgtccctcagagaactgacttcccagaaacacgtaatgtggaaaagcaccaggacatccccacagtgaaaaatatccaaggaaaggttccaagaatcccctgtgcaaggaaacctttcatatgtgaggagtgtgggaaatccttcagctacttttcttactatgctagacaccagagaatccacactggggagaaaccttttgagtgtagtgagtgtggaaaagcctttaatggtaattcttcgttaattcggcaccagaggattcacactggagagagaccctatcagtgtgaggagtgtgggcgagcctttaatgataatgcaaatctgatcaggcatcagagaatccacagtggggacagaccctattactgtacagagtgtgggaatagtttcacgagtagttccgagtttgttatacatcagagaatccacactggggagaaaccctatgagtgtaatgagtgtggcaaagcttttgttggtaattcacccctacttcggcatcagaaaatccacactggagagaaaccctatgagtgtaatgagtgtggcaaaagctttggaaggacttcccatctaagccaacatcagcgtattcacacaggggaaaagccttattcttgtaaagtatgtggacaagccttcaattttcatacaaaactaactcggcaccagagaattcacagtgaggagaaaccctttgactgtgtagattgtggaaaagccttcagtgctcaggaacaattaaaaaggcatctgagaattcatactcaggagtcttcctatgtatgtgatgagtgtggaaaagccttgactagcaaaagaaatcttcatcagcatcaaagaatccatactggagagaaaccctatgagtgtagcaagtatgagaaggcctttgggacttcttcccagctaggtcaccttgagcatgtctactctggagagaagcctgtgctggacatttgtcgttttggcctcccagaattttttacccccttttactggtaatagtacactccagtgaaatgtactgagtggattccgtcttctactcaggaatggaatgtgtgacacaggcctgactcagcctctgatccatccctcaagccacagttaatgattcagatgtcagtagatgaccaaagatggttcaattagagtcccaggattgcaagagctaataggaacaaatactctccccccgcccacccccattggttttaatgctgagaagaagaactagactcttacagaggtgagaatgaagtccacacagcaaaaatgcatctgagaattggagagcagtaaaagactgaagataatgtttgaacagccacatacaccatgcctgaagctaaaaatatatacgggtttttgaattgcagcagccaataaattccatttttgtttggttggttttggctttggcacacctgagttaggttttcttgccttggaacagaattttgacttaaacagtgttgtcattgtagcagttgtttgaagttttcagggataacatacctgatggagaaatgttttgtgtgtatgatatatgggaaagtctttagttatagtcatggcagctcctcaaccccatgattgtgatgagattgggaagcccactgtaacactggagagcccaggttatatcagacaccactagtagatagaagttctaacaacttgagctctgtaacaaaaatctcattgtactacaaaattatgtctgcaccagtgaatccattctcaagaaaagtcttaactaggaaactaaaagctttcactcttaaagctttcattttctgtttattcagttttttatttggaatggatgctactctaggccttaaactgagaaatgccaggctattgtagctattatatcttggtatttgccattttaattcctaggacagcacgcccgctttgcccttgacctggctagggagccaaggaaatgccatggttcttggtcataagacacactgcagagatctctcagtaggaaaacagggctggcccttttctttggtgatgaacacaaactgcaccctttttttctcccacgtgtccttccgctgccagccagtgttggaatctcc

SEQ ID NO: 1244 - DNA, 5362 bp, Homo sapiens
gctttcatcgcctttactccccgaccttccttcgagtctgtttatccgttgcagcctcccttccccacgacggggcgcctctgcaactcacaaagtacccttagaaagaggccctcagaagagtcttctcttaagaagataaagaaggtagtggaaacgaacttcctgagcttttcaggctctaatggctgaagaatcaagaaagccttcagccccatccccaccagaccagactcctgaagaggatcttgtaatcgtcaaggtagaggaggatcatggttgggaccaggaatctagtctgcatgaaagtaaccctcttggccaagaagtgttccgcctgcgcttcaggcagttacgctaccaggagacactaggaccccgagaagctctgatccaactacgggccctttgccatcagtggctgaggccagatttgaacaccaaggaacagatcctggagctgctggtgctggagcagttcttgaccatcctacctgaggagctccagacactggttaaggaacatcagctagagaacggagaggaggtggtgaccctattagaggatttggaaaggcagattgatatactaggacgaccagtctcagctcgcgtacatggacatagggtactctgggaggaggtagtacattcagcatctgcaccagagcctccaaatactcagctccaatctgaggcaacccaacataaatctccagtgccccaagagtcacaagagagagccatgtctacttcccagagtcctactcgttcccagaaaggaagttctggagaccaggaaatgacagctacacttctcacagcagggttccagactttggagaagattgaagacatggctgtgtcccttattcgagaggagtggcttcttgatccatcacagaaggatctgtgtagagataacaggccagaaaatttcagaaacatgttctccctgggtggtgagaccaggagtgagaacagggaattagcttcaaaacaggtaatatctactggaatccagccacatggagagacagctgccaaatgcaacggggatgttatcaggggtcttgagcatgaagaagcccgagaccttctgggcagattagagaggcagcggggaaatcccacacaagagagacgacataaatgtgatgaatgtgggaaaagctttgctcagagctcaggccttgttcgccactggagaatccacactggggagaaaccctatcagtgtaatgtgtgtggtaaagccttcagttacaggtcagcccttctttcacatcaggatatccacaacaaagtaaaacgctatcactgtaaggagtgtggcaaagccttcagtcagaacacaggcctgattctgcaccagagaatccacactggggagaagccatatcagtgcaatcagtgtgggaaggctttcagtcagagtgcgggccttattctgcaccagagaatccacagtggagagagaccctatgaatgtaatgagtgtgggaaagctttcagtcatagctcacacctcattggacatcagagaatccacactggggagaagccctatgagtgtgatgagtgtgggaaaaccttcaggcggagctcacatcttattggtcatcagaggagccacactggggagaaaccctacaaatgcaatgagtgtgggagggccttcagtcagaagtcaggccttattgaacatcagagaatccacactggagaaagaccctataaatgtaaagaatgtgggaaagctttcaatgggaacactggtctcattcaacacctgagaattcacacaggggagaagccctaccaatgtaatgagtgtgggaaagcctttattcagaggtcaagtctcattcgacatcagagaatccacagtggtgaaaaatctgaatccataagcgtttaggaacaacatcagttagagtttgagcattattcagcattagggaaaccacacactggtgagaggtctttcagtgtactaaaaggcagaaaggtcatcacaactttagtgtcagaatctatagtggtggcaaagttaggatagctctttagtaatttgggcccagtgccttggtgaaggttgattagcttgactgtctttgaaagtatctgatggagctcctgatgacctaatgtatcctttagaaatttaaaatagcattagagcaagttgcttgtcatggcttgaagagcttaactttgtcttttgggtgagtagctataggtttgagagaggctggctactcctagttcctgtgcttcttcccatctcctgtgatccccctctcccatttattcccttgaaggtgcccttgtattcctaatctgatctaagaagctgctgtagagtcagaagtagcttctgtgtgaaacttatatttgtatgtagctttctaggaaaattttacagacacttaaagtatttatgcttaagtgtgcatttttttattctaatattccttctagtcagtggaaatttgtattcccatacaaactcagaatgctatatttttaacagcactccagcatttttcttcatgtatcaccttcactgactccattgagtcattgagcatctgtacatatccttcaccacccccagtcccagcacctgtgtcagtaaagaaagtggacacattagtaatggttatgggagtaatacagagaaagaggtgagtggagactcagcccagctgctcttgagcttggatagttatacattttggtgacttctgactctccttccacctccccactgtacactgtggtacagatagttggcactatcctagttatggcatcaggtaggagaaggagacgaagatgctttaggaagataaaaaccttacaaagaatgtatactcatcttttttggcccattacaatactgctttctcaggttcttaacagcctgtgcaaactccctgactagatggtctgtcactcctatcattaccttgcacccatctctttagatggcctcagcacctcactcgttattctccatctgtttcttgccattagtttatatgactttaatatccacagtggtaatctaataccttacctcacaggttttcattcttttgaactctggtgcactccatctgtaatccatgtctataatctaccaacaaagatgtactcttaaactcagtatcaccaggcactatatttcatctttgaggcttttgttataccaaggaatactatataaagtaatgagactggtttaaagtaacatgccagaacttacgcatccaatgtgggttgtcacttgttattcccaagtactattattccatactactatattcttccaaatatttggaacactcttagaattcccatttaataaaccatatgagaaaaccctctattactcttacactttagttttaccatttgagtagccacttattcaccagagttggaattgagaaattttgggctttccaaaattaacctttaaacttaaaattgattacattgagcctattcagaaaaaaaattatataggttctgatgaaagcttcataatttcaccctgtgactatcctgaaaagaaataataatcattttatgattgatgggccaaaaaaagcaatcaaagtcttacgtcatagaggaccaccttttggatcataaattctttccctataacattccttctctgcctctctatggcccactttgaccactaacaacatcagaattatctacatcaatttcattgagccattggtgaatgaagacacccatcacttgtcatgttggtttccaacagtcctttcgattatcctttattttcttatcctcccttctcttgtttcttttatttataagttaccattcctagtttctttgtacttgaaattttaagaaaccagaaacaagtaaatctggttgtatctagatctttgctctgtgtttcagttgtgccttaccctctgtaagatactgattcttcctggggccagtattaccttgtatgcaaatattacatatgatgggtgcattgtcagagggaaaatatatgtgtatgtacacatgtgtatgtacacacacacacacacctgccatacactttagaagaacgcttctcttctattccaataaaaagtccttttagcaatgcaacatattaacaaaattgggtgcattcagggtggtatggccatagaccagagcaacacattgaaatgtatacagatgtactagctaaagtctctttatgtgtcagtattaagagtaatatgtagccagattacttaaatctcagaattactaagcatgtggcataaatttggagaaaataatatgactagaaaaattagtgttatattgggtgtgagaaaagactgtgtcttgaaagaattatcaaagctgatacagcacatatacagaattagccaaatggtataagacaatagaaaaaggctgtggattctttgaggacatcactagaaatcattctttgtctcaagttcacactcttagcatagaatattattgactaggctgtatgacattttgagctcttaactgtgaatggcattcattaagctcctttatcctatagattctatctttatgttcatctgaaatgaactattcatcagtactttctcctcccatcctaagcttctcattttaggaactgacatgataaggtggttctttcataactctaatgccatccaacatagccctgggagaggcatgttaggtttcagagattttctccatggagcaaggtgcagtgctagaatatggtggttgattcccaaacagagcagttaactttactcttggttctgagtctccaaataataatagccgacgtttattgagcacttactatgtgcccaaccctgttatgcctttctcaggctcatgataaatgtattagtctgttctcatgctgctattaaagacatacctgacactgggtaatttataaaggaaagaggtttaatggactcagttccacatggctggggacgcctcacaatcatggtggaaggcaaggaggagcaaatcatgtcttatacatggatggcagcaggcaaagagagaacttgtgcaggggaactctttataaaaccgtccgatcttgtgagacttattcactatcacaagaacagcacaggaaagttctgcccccgtgattcaattacctcccacttggtcccacccacgacacgtgggaattgtgggagctacaattcaagatgagatttggatgggacacagccaaaccatatcaataggtattattttatcccccattttataaatgaggaaacggaggcttagttgagtgagctgaccaatatcaccc

SEQ ID NO: 1245 - DNA, 1667 bp, Homo sapiens
gggcattgttcgtgccgcgcttctagcaacgccgggccggtaaccccctctccctccttgcgcgttccgggtctcgcaagcgcctccaaggtttgtcttgaagcatagctccagctggagggtaccttttaagctgttcaaggtcaagatgaatacaaactcaaaggaggttttatccctgggtgttcaagttcccgaggcatgggaagaacttctgacaatgaaagtggaagcaaaaagtcaccttcaatggcaggaatccagactgaaacgcagtaatccactggcaagggaaatcttccgaaggcactttcgacagctgtgctaccaagagacccctggaccaagggaggctcttactcgactccaggaactttgctaccagtggttgaggccacatgtgagcacaaaggagcagattttggatctgctggtgctggagcagtttctatccattctgcccaaggagctccagggctgggtgagggaacactgtccagagagtggagaagaggctgtgattttgctggaggatctggagagagagctcgatgaaccacaacatgagatggtggcccacagacacagacaagaagtcctctgtaaagagatggtgcctctagcagagcagacaccactgacccttcagtcccagcctaaggagccacagctcacatgtgactctgctcagaagtgccattctattggagagacagatgaagtaaccaagactgaggacagagagttggtgctaaggaaagactgtcctaagatagtggaaccacatgggaaaatgtttaatgagcagacctgggaggtatcacagcaggatccctcacatggagaagttggtgaacataaggataggatagagaggcagtggggaaacctcttaggagaggggcaacacaaatgtgatgaatgtgggaagagctttactcagagctcaggtctcattcgacatcaaagaattcatactggagaaagaccttatgaatgtaatgaatgtgggaaagccttcagtcgaagttctggtctttttaatcaccgaggaatccacaatatacagaaacggtaccactgcaaggagtgtgggaaggtcttcagtcagagtgcgggtcttatccagcatcagagaatccacaaaggagaaaagccgtatcagtgcagccagtgcagtaagagctacagtcggcgttcatttctcattgaacatcagagaagccacacaggggagcgacctcaccagtgcattgaatgtgggaaaagctttaatcgacactgcaacctcattcgccatcagaagatccacacagtggctgagctggtctagggcttggctatgagcaagttttccagatcaccacccaagttgtgtggggcaggttgagactagaaaatgcctctttcttcctttctccatgaaatgtgtttgaaacaaatcctgacttaaggcccagggacttccttaaaggaaagttgggtgtttgaagctactgttttctcttttgttcattttacctctttcttactcttactagctgtgtccctcttatttataatttatttatttttttgagatggctgctaaacccttctaataatataataaatggcactgccacagccaacatgcccaaaaaaaaaaaaaaaaaaaaaaaaaaaaa

SEQ ID NO: 1246 - DNA, 2189 bp, Homo sapiens
aatcaggcacatgtctggagaggagaggacggcttccgggatctagcggggcctttgtcccgacagagctccacttcctgtccccgcggctctgtgtcccctgctagccgtaggtcgtgtgacccgcaggcaccgggagatccagaagtgaaacgccaggctctctggaggccaggagatgactctgttgacgttcagggatgtggccatagaattctccctggaggagtggaaatgcctggacctcgctcagcagaatttgtacagggatgtgatgttggagaactacagaaacttgttctccgttggtctcactgtctgtaagccaggcctgatcacctgcctggagcaacgaaaagagccctggaatgtgaagagacaggaggcagcagacggacatccagctatgtcttctcattttacccaagaccttctgccagagcagggcatacaagatgcattcccaaaaagaatactgagaggatatggaaattgtggccttgataatttatatttaaggaaagactgggaaagtttagatgagtgtaagttgcaaaaagattataatggacttaaccaatgttcatcaactacccatagcaaaatctttcaatataataaatatgttaaaatctttgataacttttcaaatttacatagacgtaatataagtaatactggagagaaacctttcaaatgtcaagaatgtggcaaatcctttcaaatgctctcattcctaactgaacatcagaaaattcacactggaaaaaaattccaaaaatgtggagaatgtggcaaaacctttatccagtgctcacactttactgaacctgagaacattgacactggagagaaaccttacaagtgtcaagaatgtaacaacgtcattaaaacttgctcagtccttactaaaaatagaatttatgccggaggggaacattacagatgtgaagaatttggcaaagtatttaaccagtgctcccaccttactgaacatgagcatggtactgaggaaaaaccctgcaaatatgaagagtgcagcagtgtctttatctcttgctcaagcctttctaatcaacagatgattcttgctggagagaagctctccaaatgtgaaacatggtacaaaggttttaaccacagcccaaatccttccaaacaccagagaaatgagattggagggaaacctttcaaatgtgaggaatgtgacagcatcttcaagtggttctcagaccttactaaacataagagaattcacactggtgagaaaccatacaaatgtgacgaatgtgggaaagcctatacacagtcctcacacctcagtgaacacaggaggattcacaccggagagaaaccctaccaatgtgaagaatgtgggaaggtcttcagaacttgctcaagcctttctaaccataagagaactcattctgaagaaaaaccctacacgtgtgaagaatgtggcaacatctttaagcagttatcagacctcactaagcataagaaaacccatactggagagaagccctacaaatgtgacgaatgtggaaaaaactttacccagtcctccaaccttattgtacataagagaattcatactggagagaaaccctacaagtgtgaagaatgtggcagagtcttcatgtggttctcagacattaccaaacataagaaaacccatactggagagaaaccctacaaatgtgacgaatgtggaaaaaactttacccagtcctcaaaccttattgtacataagagaattcatactggagagaaaccctacaagtgtgaaaagtgtggcaaagccttcacccagttctcacacctgactgtacatgaaagcattcatacttgagaaaaaaataaacaaatataaaaataggcaaagccgttagtatctgctcgcatcccactttacatcagagttcagacttaataaagttatcataaatgtaattactattgaaagacctttcatgaaatataagtctccagagcacacaagagtatttcttctgaaaaaaatgttacaattatactagatggaagacttgcatcagttgcttaaactttcagaaaatttgtagagaaacccaacaaatctcataaatgtggaataacatttgttcaaaaatgatagcttagaaaacactagagttcatactaaaagatattttgcaaatacactaaat

SEQ ID NO: 1247 - DNA, 4338 bp, Homo sapiens
agtattctcggctcggccattattctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttgtgaaggggaaggatgatacctggaaatggggaaccagcttccaaggaagtagctcctctgtttgggagacctcccacctacactttagacaattacgttaccatgagacatctggaccccaggaagccctgagccggctcagggaactctgtcgccggtggctgagaccagaagcacgcaccaaggcacagatcctggagctgctggtgctggagcagtttctgagcatcctgcctggggagattcggacctgggtacagctccatcaccctggaagtggcgaggaggctgtggccctggtagaggagctgcagaaagaccttgatggaccagcaatacaagttccagtccttgtcaaggatcaggacactctccagaaggtggtgagtgccccaggaacaacacttcctcctgtacttcctggcagccacatagcagctgaaatttgcccgcatcctcctactgacctagtggcattcaacctccaggatcctcagcatgattctcctgcccctgaagcttctgccctttcccaggaagagaacccaagaaatcaattaatggcacttatgctcctaacagcccagccccaggagttggtgatgttcgaggaggtgtcagtatgcttcacttcagaggaatgggcatgtctgggcccaatccagagggccttgtactgggatgtgatgctggagaattatggaaatgtgacctccctagaatgggagaccatgaccgagaatgaggaggtgacatcaaagccaagtagttctcaaagagcagactctcataaaggaacatcaaaaagacttcaaggaagtgttccccaggtccttgattttgaagaagagtgtgaatggcaagttttggcaagtcagtggggaaatgaaacagatgaaagggcagatacagtgaagaaagtttccctttgtgaacgagacaagaagaaaaggactccaccagagaaacaaggccaaaagtggaaggaattaggagacagcttgactttcggttcagctatttctgaaagtttaataggtactgaaggaaagaagttttataaatgtgatatgtgttgtaaacattttaataaaatctcccatcttataaaccatcggagaatccacactggtgagaaacctcataaatgtaaggaatgtggaaaaggctttattcagcgttcgagccttctaatgcatttacggaaccattcaggggagaaaccttataaatgtaatgaatgtgggaaagcattttctcaaagtgcttaccttctaaaccatcagaggatccacactggggagaaaccttataagtgtaaggagtgtggaaagggcttctataggcactcaggcctaattatacatctaaggcgccattcaggggagagaccttataagtgtaatgaatgtgggaaagtcttctctcagaatgcttacctcattgaccatcagaggctccacaaaggggaagaaccttataaatgtaataagtgtcagaaagctttcattctgaagaagagcctcattctgcaccagagaatccactctggggaaaaaccctataaatgtgatgaatgtggaaagacctttgctcagaccacttatcttattgaccatcagcgactccacagtgcagagaacccttacaagtgtaaagaatgtggaaaagttttcattcgaagcaaaagcctcctcttacatcagagagtccacacagaaaagaaaacctttggttgtaaaaagtgtgggaagattttcagttctaagtcaaacttcattgaccataagaggatgcacagcagagagaaaccttacaaatgcactgaatgtgggaaagcctttactcaaagtgcttacctttttgaccaccagagactccacaatggggagaagccctatgaatgtaatgaatgtgggaaagtttttattctgaagaagagcctcattttacatcaaaggttccacactggagagaatctctatgaatgtaaagattgtggtaaggtcttcggttcaaacagaaacctcattgaccatgagagactccacaatggggagaagccatatgaatgtcgagagtgtgggaaaacctttattatgagcaaaagttttatggtccatcagaaactccatacacaagagaaagcctacaaatgtgaggattgtgggaaggctttcagttacaattcaagcctgcttgtacatcggagaatccacaccggagaaaaaccctttgaatgcagtgagtgtggaagagctttcagttcaaacagaaacctcattgagcataagagaatccacagtggtgagaaaccctatgagtgtgatgagtgtggcaaatgcttcattctgaagaaaagcctcattggacatcagagaattcacacgagggaaaaatcttataaatgcaatgactgtgggaaggtcttcagttaccgctcaaaccttatagcccatcagaggatccatactggtgagaagccctatgcgtgtagtgagtgtggaaaaggttttacgtacaacagaaacctgattgaacatcaaagaattcacagtggagaaaaaacctacgaatgtcatgtatgtaggaaagtccttacctctagtagaaatcttatggtacatcaaagaatccatactggagagaaaccttataaatgtaatgagtgtggaaaagactttagtcagaataaaaaccttgttgtacatcagagaatgcacactggggaaaaaccttatgagtgtgacaagtgtaggaaatcctttacttctaagaggaatttagttggccaccagagaattcacacaggggagaaaccctatgggtgtaatgattgtagtaaagtttttaggcaaagaaaaaaccttactgtacatcagaaaatccacacagatgaaaaaccttgtgaatgtgatgtgtctgaaaaagaattctctcagacttccaaccttcatcttcaacagaaaatccataccattgaggaattctcttggctacaaaacaccaatgagtccaagattgagattcagaaaatctagtgtcatatgtaaaatggaatagaatccctgcctacttaagtaactgttggacaaatgatatatatttcttctaaggaaaaagtttattatttactctttactagacaaatgagtagcatatagaagaaagttaataggccgggcttggtggctcatgcctgtaatcccagcactttgagaggccgaagcgagtggatcacctgaggtcaggattttgagaccagcctgaccaacatggtgaaaccccatctctactaaaatacaaaaattatccgggcatgggggcacacaccggtaatcccagctactcaggaggctgagacaggagagtcgcttgaacctgggagggcggaggttgcagtgagccaggatcgcgccattgcactccagcctgggcaacaagagcgaaactcttgtctgaaaaaataaagttcatcccaactttcaagtctacaaaaacataatccaaatctaataacatagttgtaaatgagagcaacaataaaaagtagacatgggctgggtgcagtggctcactcctgtagtcccaggactttgggaggccgaggtgggaagatcccttgagcccaggagttcgagacaagcctgggtaacacggggagacccgtctttagtaaataaaaataaatttattaataaaactaaaaatttaataataaaaagtggacattgttttttaaaatgtgtatagtatgcattttaaagatagtgtcactgctgtggaaaacctgaacagacagtatgatccagaatgtcaggtgtggagttgggcggacaagagtctgctgatgaggacaacctaaaagagcactggatttggaatcagaagacctacctttgattcctggctttcccttaatggccatgtgatgttattaagtcagcctctaaagctttagtttcctgtcagtcaaatgttgacatgatacctacctcacagggttgttgtgagggttaagtgaaaggatctttgtgaaagtactttttgaaatcattcagttgtcaataaagttggataaaa

SEQ ID NO: 1248 - DNA, 334 bp, Homo sapiens
aatcgaaaaaataccgacctctaggttcttgtgagatctgttctaaaagcttggttagtagtgaggaatgtggacggtaaatcctgctgcctcgaaagctcggcagtcggactgcatgtaaatgcgcatgggggccatcccagtagctgcctcatctcagctatccctcacgtttcagggccggcggcggcccgcggaagccagatcccggagggtcccgcccccgacgccaatttagacggtgagggattcccgctccaggattcttatgctgacttaacggaccccctccggtcctcaaatacccgcccaaaaaaccctccccccaaattcc

SEQ ID NO: 1249 - DNA, 2188 bp, Homo sapiens
gctctgccacaacttctgtcgctctgccgcctgcaccgtgacccgcactattcacgggagccctagagaggacaccgggacacccagaagccgggaaatgatgtttcaggattcagtggcctttgaggatgtggctgtcagcttcacccaggaggagtgggctttgctggatccttcccagaagaatctctacagggatgtgatgcaggaaaccttcaagaacctgacctctgtaggaaaaacatggaaagttcagaacattgaagatgagtacaaaaatcccaggagaaatctaagtcttatgagagagaaactctgtgaaagtaaagaaagtcatcactgtggagaaagcttcaaccagattgcagatgacatgctgaacaggaaaactcttcctggaataacaccatgtgaaagcagtgtgtgtggagaagttggcacgggtcattcatctcttaatacgcatatcagagctgacactggacacaagtcatctgagtatcaggaatatggagagaatccatatagaaataaggaatgtaagaaagccttcagttatcttgactcctttcaatcacatgataaagcttgcactaaagagaaaccctatgatggtaaagaatgtacagaaaccttcatttcccattcatgcattcaaagacacagggtaatgcacagtggagatggaccttataaatgtaagttttgtgggaaagccttctattttctcaatttatgtcttatccatgaacgaattcacactggtgtgaaaccatataagtgtaaacaatgtggtaaggcctttactcgttccactacccttccagtacatgaaagaactcacacaggagtgaatgccgatgaatgtaaagaatgtgggaatgcattcagttttcctagtgaaattcgtagacataaaaggtctcacactggagaaaaaccctatgagtgtaagcaatgtgggaaagtcttcatttctttcagttccattcagtatcataagatgactcacactggagagaaaccctatgaatgtaagcagtgtgggaaagcctttagatgtggctcacaccttcaaaagcatggaaggactcacactggagagaaaccctatgaatgtaggcaatgtggtaaagccttcagatgtacctcggaccttcaaaggcatgaaaagacacacactgaggataaaccctatggatgtaagcagtgtgggaaaggctttagatgtgcttcacaacttcaaattcatgaaaggacgcacagtggagagaaaccccatgaatgtaaggaatgtggaaaagtattcaagtatttttcttccttgcgtatacatgaaaggacgcacactggagagaagccccatgaatgtaagcaatgtggaaaagcattcaggtatttctcttccttgcatatacatgaaaggacacacactggagataagccatatgagtgtaaggtatgtggcaaagccttcacttgttccagttccattcgatatcatgaaaggactcacactggagagaaaccctatgaatgtaagcactgtggtaaggcctttatttccaattacattcgatatcatgaaaggactcacactggagagaaaccctatcaatgcaagcaatgtggcaaagcctttattcgtgccagttcatgtcgagaacatgaaagaactcataccattaatagatgagaaatccttttagtggaagcaacgggagaagctttctgttgtcccacttcctttgaaacacaagaaaagagagtggtgaaagaacctctggataactgctttttgaattgagaagagagacttgcgataggacaataaaatctagaagaacttggatggtttcgtaatacaattcacctatagccaatcttgcatgagatttcaaaggcacagaaaaggaaggcatcagtcacatattagaggccccacacagggagagaggtgtgtggctacccgcttccagcccattttcctgattctttggcttgttaatcgagaatatcccccaaatcacttgtctctgttcctcagagttgtaggtctccagatatgtccccagtgctccacattaaagataacatgcccactttgctgtttcttcagaaatgttaaaatgtttaccagagaactaataaatgttgttatggctggaaataaaaaaaaaaaaaaaaa

SEQ ID NO: 1250 - DNA, 3387 bp, Homo sapiens
acttcccagaaggcaccgagtccctgccgttctcctcaactggcggcggcgcgaacgaatagtcgccggcgacctgtgagggcactcggaagggcgaggggagggctcgaccgctcgcgcctagtttttctatctctcccggagcctgagtctctgagccgtccccagcaaacgctcaggggctgcagaggccccgagaggtgaggggctccgtgagggcgggaaccaggctgaggccgcctctggggagcggagcgtgtccgttgctgagggagcaaggccgggtagggagcctggtgagcgcctcaggcaggggcgcacgctgagctttacggtaaaggtgttccttgaccagcggaagaggccccagagtgagcctggcccggcggtccttagtgggatgtcgcctgccgctctcagcagagctttgacggcggagaggagtcggcaggcggtgtgtggacacctcctcggccttgcatctgctccccgggagagtcaccaaccgcctccccgcccaaagggcaccggagggagcttcggttcgagggcttggctctctggcagatttcctctagtaagaggtggctctggaggccccgcgaaacgagtgtggtgtgtggttgcaaggcatgatggctgcaaaagtggttcctatgcccccaaagccaaagcagtcctttatactgagagttccgccagactccaagctgggccaagacctacttcgagatgccactaacgggcccaagaccatccaccagctagtgctggagcacttcctcaccttcttgcccaagccaagcctggtccagcccagtcagaaagtcaaggagaccttggttattatgaaagatgtgagctcaagccttcagaacagagtgcatcctcgtcccttggtgaagcttctgcccaaaggagtccaaaaggaacaagagacagtgtctctgtatttgaaagctaaccctgaggagctggtggtctttgaggatttgaatgtatttcactgccaggaagaatgtgtgagcttggatcctactcaacaactcacgtcagagaaggaagatgacagcagtgtcggggaaatgatgttactggcagtcaatggcagtaatcctgaaggtgaagatcctgagagggaacctgtagaaaatgaagattatagagaaaagtcttcagatgatgatgaaatggattcttccttggtctctcagcagcctcccgataaccaggaaaaggaacgactaaatacatccattccacaaaaaaggaaaatgagaaatctgttagttaccattgagaatgatactcctctagaggaactctcaaaatatgtagacatcagtattattgcccttactcgaaatcggaggacaaggagatggtacacttgtccactgtgtgggaaacagtttaatgaaagttcttacctcatttcccaccagaggacccacactggagaaaaaccctatgactgtaatcactgtgggaaaagcttcaatcataaaacaaacctcaataaacatgagcgaattcatacaggagagaaaccttattcctgttctcagtgtggaaaaaacttccgtcagaattctcatcggagtcgtcatgaaggaatccatataagggagaagatatttaagtgtccagaatgtgggaaaaccttcccaaagaatgaggagtttgtgcttcatctgcagagtcatgaggctgagagaccatatggttgcaaaaaatgtgggagaagatttggtcggctgtcaaactgtacccggcatgagaaaacccactcagcctgtaagacccgaaagcagaagtaatactgggaaccctttctgggtctgatggtgctgcctcaacctgagagctttcataagtagttctgaattcccaagctgcctaaaaaggtataaatgtgtaaaaatctcattattgccaaaattggataaatgcccatcttagctaaaacctcaaattgctagaaaattcacagggaagaaaacatttcaagggctatacctcagcatctaggctttttggactaaggagctttcctttttgaagttatatgataatgtacaggtcacagatcccctttcccaacactttgaagatgaatctggagtctgcttacttggaaggcaaagagtgacttgtgtctattgaaagtatatccgttttccccccacatggggattcatacttgagaaatagtgcaaagatgcttatctggaactgtgttctggtgaaagaaccaaattactggcttgttagccaacagcttctgatagcaattcatataaccctctaagaatacctgtttaagtcttgagtgttgaaaggaattgtttactttggaatataggaaaacagttgaatgtcagactctcatttgtatgtgatctaaatttgcaatcaatttcaataatatttacaatttgtgataaaactgacttttacagattccttttcacaacataatttaggtgtctactgttcttattgtattttgttctgctgttgatctctccagcagccgtctcatgcttctcccttgctaaaagaagtttggattactcaggcagggccatccagccccaccactagaaaagctcttcagaatcttgtccctctgttgagcccagatctcatgtgctacgaaggaaaccccaagacccagagaggaagggtcaacctggaggcaggaaaaagttggcttggatccatgtctcatcaataaccttaccatatgcttaggtcccctctatgctgtcatcagacctttggcaatggggtggtcactacctcacaaggcaaagtgttgtatgattagaaattacgtctccagtggttagctcacattgcctctcaagagacaggtttccaggtgtcttcattgtagtgggtattaattgtcttcagcctcttgatatccataccttcctgtcctctgcctagaagcaaggccagcggtgcctttacggactgatcgtgtggtgcgatttagggattcttcagttttgcttgctttaggtttccaaaagttatacattggtgttttgattggaataaagaaatcctataagctatttgggaaaaattatagtgtatgtttcccatccagaaacatgcctttctatttattagagtattatattcctgtgaaaatttttctaattttcttcacttgttttacacaattttgttattgtagttttttccattatatttttatagttgattattgcttttacatgggaaagttatttttaattatatatttgtatagtcatctcactgttgttaattttcaatagtttgttggtttagttctgttaacttttggtaaaatgacaccatctacaaagaatagtttttgtttcttgc

SEQ ID NO: 1251 - DNA, 4055 bp, Homo sapiens
ccgacccgctaggccccgcgcggctcggatccggcggcgctgtttcggtcgggagtgggtgggagagaagccggggcaggggaggagccgccggagctgtcggagccgtgacacccagggcagctacactcagaagccacaaggaatgctagtggagcccctcatccctcccagcttctcttccaagctgccccgtggggcttgatccaggaagctacttcagaaagtagacaatcattccaagggtacaacaaggtttaccacaatgtgagggactcagccattgcaaattgtacagatgagggcccttggaagaaaatcctcgctgtgtccaggctgaggcggggggctaatgacagtgtgagctctagatggtgtgagaccaccccaaagccaagaaatggctacagccgtggaaccagaggaccaggatctttgggaagaagagggaattctgatggtgaaactggaagatgatttcacctgtcggccagagtctgtcttacagagggatgacccggtgctggaaacctcccaccagaacttccgacgcttccgctaccaggaggcagcaagccctagagaagctctcatcagactccgagaactttgtcaccagtggctgagaccagagaggcggacaaaggagcagatcctagagctgcttgtgctggaacaatttcttaccgtcctacctggagaactacagagctgggtgcggggccaacggccagaaagtggcgaggaggcagtgacgctggtggagggtttgcagaaacaacccaggagaccaaggcggtgggtgactgtccatgttcacggccaggaagtcctgtcagaggagacggtgcatttaggagtggagcctgagtcacctaatgagctgcaggatcctgtgcaaagctcgacccccgagcagtctcctgaggaaaccacacagagcccagatctgggggcaccggcagagcagcgtccacaccaggaagaggagctccagaccctgcaggagagcgaggtcccagtgcccgaggacccagaccttcctgcagagaggagctctggagactcagagatggttgctcttcttactgctctgtcacagggactggtaacgttcaaggatgtggccgtatgcttttcccaggaccagtggagtgatctggacccaacacagaaagagttctatggagaatatgtcttggaagaagactgtggaattgttgtctctctgtcatttccaatccccagacctgatgagatctcccaggttagagaggaagagccttgggtcccagatatccaagagcctcaggagactcaagagccagaaatcctgagttttacctacacaggagataggagtaaagatgaggaagagtgtctggagcaggaagatctgagtttggaggatatacacaggcctgttttgggagaaccagaaattcaccagactccagattgggaaatagtctttgaggacaatccaggtagacttaatgaaagaagatttggtactaatatttctcaagtgaatagttttgtgaaccttcgggaaactacacccgtccaccccctgttagggaggcatcatgactgttctgtgtgtggaaagagcttcacttgtaactcccaccttgttagacacctgaggactcacacaggagagaaaccctataaatgtatggaatgtggaaaaagttacacacgaagctcacatcttgccaggcaccaaaaggttcacaagatgaacgcgccttacaaatatcccctaaaccggaagaatttggaagagacctcccctgtgacacaggctgagagaactccatcagtggagaaaccctatagatgtgatgattgcggaaagcacttccgctggacttcagaccttgtcagacatcagaggacacatactggagaaaaacccttcttttgtactatttgtggcaaaagcttcagccagaaatctgtgttaacaacacaccaaagaatccacctgggaggcaaaccctacttgtgtggagagtgtggtgaggacttcagtgaacacaggcggtacctggcgcaccggaagacgcacgctgctgaggaactctacctctgcagcgagtgcgggcgctgcttcacccacagcgcagcgttcgccaagcacttgagaggacacgcctcagtgaggccctgccgatgcaacgaatgtgggaagagcttcagtcgcagggaccacctcgtcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaaataagaaaaagctgttgctggcaagaccatcaagactgttctgacaccctgtccccatcatccctgactgagtactctgacatcacggaaagtgttgaacctgggaccctgaggaattcaccaggagtaaatggctttcatgtatttgtgttgtttgctttttcttacgtgattttatgttcatagagctagaaagtagcatctcatgatggcccaacaatctctgttgccagttaaaggttccttggagatgaggctgaataattatgaacctcaccttctctgattgtgggagtggcaagaactggggagacgtcctccataagtggagcacagggtatggggttaaagcatgacagggagagtcttctgtgcctggtttcttctcctctatctcataatgcattatgggcccgaggaataggggagggttaataagactccaaccctaatggcccaacagggaaattctcattttggtcgatgatattctgatggactggtttggtcttaataccagtcaaccgttgtccttctggaaatatacatatatgaaataaataaaggtaacacttgcagccaagttccctggtttctgggacttcccatcttacccattccttttccagggcttc

SEQ ID NO: 1252 - DNA, 2077 bp, Homo sapiens
ctgtcttccctactcccagtctccacccaactcccccgcccgccccgtgcaggctgtggagactcccttcccgggggagggggcccccactgccgcaggtgccccctctgcctccaccccggctcctggccagaagctggagggggcttggccaaaaagagggagaaacaactcagctgttctttctagctctgaaatagaaaatgtctgcagacggcggaggcatccaggacacccaggacaaggagacacccccggaggttccagatcgtggacatcctcatcaggaaatgccttctaagctgggggaggcggtaccttcaggggacactcaggagtcactgcacattaagatggagcccgaagagccacactccgagggggcatcgcaggaggatggggctcaaggtgcctggggctgggcacccctaagtcacggctctaaggagaaagctctcttcctgcctggcggagccctcccctccccccggatccccgtgctttcccgagaggggaggaccagagaccggcagatggctgcagcgctcctcactgcctggtcccagatgccagtgactttcgaggatgtggccttgtacctctcccgggaggagtggggacggctggaccacacgcagcagaacttctacagggatgtcctgcagaagaaaaatgggctgtcactgggctttcccttcagcaggcctttctgggcccctcaagcgcacggcaagggtgaggcctcgggctccagccggcaggcaggagatgagaaggagtggagaggcgcgtgcacaggagccgtcgaggtggggcagagggtgcagacctcatccgtggcagcccttgggaatgtgaagcccttcagaaccagggcagggagagtccagtggggcgtcccgcagtgcgcgcaggaagcagcctgcggccggagctcagggccggccaaagactccgggcagccggctgagccagatcgcaccccggatgcagctccgccagaccccagtcccacggagccccaggagtaccgcgtcccggagaagcccaacgaggaggagaagggcgccccggagagtggcgaggagggcctggcccctgacagtgaggtgggcaggaagagctaccggtgcgagcagtgcggcaagggcttcagctggcactcgcacctggtgacgcaccggcgcacgcacacgggcgagaagccctacgcctgcactgactgcgggaagcgcttcggccgcagctcgcacctcatccagcaccagatcatccacacgggcgagaagccctacacctgccccgcctgccggaagagcttcagccaccactccacgctgattcagcaccagcgcatccacaccggagagaagccctacgtgtgcgaccgctgcgccaagcgcttcacccgccgctcggacttggtcacccaccagggcacccacacgggcgccaagccgcacaagtgccccatctgcgccaagtgcttcacgcagagctcggcgctagtcacccaccagcgcacccacactggggtcaagccctatccgtgccccgagtgcggcaagtgcttcagccagcgttccaacctcatcgcgcacaaccgcacacacacaggcgagaagccctaccactgcctcgactgcggcaagagcttcagccacagctcgcacctcaccgcgcaccagcgcacccaccgtggcgtgcggccctacgcctgcccgttgtgcggcaagagcttcagccggcgctccaacctgcaccggcacgagaagatccacaccaccgggcccaaggccctggccatgctgatgctgggggcggcggcggcgggggctctggccacacccccacccgctcccacctaggaggccaggaaagggggagcggggcgcccagggccactggaacagccccactggagtcaaggctccgagggaggagagaggggctcgggaagggagctggggcggtgagggcatggggtgaggcatggcgatgggggagggcgagggcgagaaagggcaggcactctgcgaattaaaggccttggacttgaaaaaaaaaaaaaaaaaaa

SEQ ID NO: 1253 - DNA, 2285 bp, Homo sapiens
cggagcggggaacgaggccgtcggccattttgtgtctgcttcctgtgggacgtggtggtagccgttgggttgggaaagtgagggatttttggcctcgtttctcctgcttcttttctcctcccttttactttgccggtagaacacagttatgggtcgcaagaagaagaagcagctgaagccgtggtgctggtattgtaatagagattttgatgatgagaagatccttattcagcaccaaaaagcaaagcattttaaatgccatatatgtcacaagaaattgtatacaggacctggcttagctattcattgcatgcaggtacataaagaaacaatagatgccgtaccaaatgcaatacctggaagaacagacatagagttggaaatatatggtatggaaggtattccagaaaaagacatggatgaaagacgacgacttcttgaacagaaaacacaagaaagtcaaaaaaagaagcaacaagatgattctgatgaatatgatgatgacgactctgcagcctcaacttcatttcagccacagcctgttcaacctcagcaaggttatattcctccaatggcacagccaggactgccaccagtaccaggagcaccaggaatgcctccaggcatacctccattaatgccaggtgttcctcctctgatgccaggaatgccaccagttatgccaggcatgccacctggaatgatgccaatgggtggaatgatgccacctggaccaggaataccacctctgatgcctggaatgccaccaggtatgcccccacctgttccacgtcctggaattcctccaatgactcaagcacaggctgtttcagcgccaggtattcttaatagaccacctgcaccaacagcaactgtacctgccccacagcctccagttactaagcctcttttccccagtgctggacagatggggacacctgtcacaagctcaagtacagcttcatccaattcagaaagtctgtctgcatcttctaaagctctgtttcctagcacagcacaagctcaggcagctgtccaaggacctgttggtacagatttcaaacccttaaatagtacccctgcaacaactacagaacccccaaagcctacattccctgcttatacacagtctacagcttcaacaactagtacaacaaatagtactgcagctaaaccagcggcttcaataacaagtaagcctgctacacttacaacaactagtgcaaccagtaagttgatccatccagatgaggatatatccctggaagagagaagggcacagttacctaagtatcaacgtaatcttcctcggccaggacaggcccccatcggtaatccaccagttggaccaattggaggtatgatgccaccacagccaggcatcccacagcaacaaggaatgagacccccaatgccacctcatggtcagtatggtggtcatcatcaaggcatgccaggataccttcctggtgctatgcccccgtatgggcagggaccgccaatggtgcccccttaccagggtgggcctcctcgacctccgatgggaatgagacctcctgtaatgtcgcaaggtggccgttactgatcttacttcatccagtctaataggtttggagattaaaccttttctcaacttgtgctgtttatatagccaagcttccgtcaataaggcttcattgtgactttaacaaacattatcttcccacataccaggaactattggacatttattttacatgggaaaaattatttggaataataaagcaggaacttttcctgaagttgcaatttatactgtatggcttctttttcatgtttcatctaggtttttagaagtgaagtatagtaaatttggttcgttaaattgtgaaggcgctggaattacatgaacataccaccctagtaaaggcaagttctgtaagcttacattgctatttgtaaagtttgccttcacagcatttcagatgctgttggacttcatgtccccaacctagcttggtgagggctgtaactgtttccaagtacttgtacattggaagtctgaatgtgtaacaatatttaatgtatttagagttcctcatgttgcagggtttaagaaatctgacccaccaaggtcatgtgacttttctgtactgttaaacttcattgtaataaaatgagagaaaaatttatgcctttttattcataacccagctgtggaccactgcctgaaaggtttgtacagatgcatgccacagtagatgtccacataataaaattcatagttaccaatgcaaaaaaaaaaa

SEQ ID NO: 1254 - DNA, 9088 bp, Homo sapiens
cctttgtctctcgctgcagccggaggtcaaggtctcgtccttactgctgtgtgtcctctgctcctagagtcccagcctctgtggccctatgacctgcaggtattgggagatccacaactaagtcgccaggaccccctggaagcctagaaatgggatcattgacatttagggatgtggccatagaattctctctggaggagtggcaatgcctggacactgcacagcagaatttatatagaaatgtgatgttagagaactacagaaacctggtcttcctgggtattgctgcctttaagccagacctgatcatttttctggaggaaggaaaagagtcctggaatatgaagagacatgagatggtggaagaatccccagttatatgttctcattttgctcaagatctttggccagagcagggcatagaagattctttccaaaaagtgatattgagaaggtatgaaaaatgtggacatgagaatttacacttaaaaattggttataccaatgtggatgagtgtaaggtgcacaaagaaggttataataaacttaaccagagtttgacaactacacagagcaaagtatttcaacgtggcaaatatgcaaatgtctttcataaatgttcaaattcaaacagacataagataaggcatactggaaagaaacatttgcaatgtaaagaatacgtcagatcattttgcatgctttcacacctatctcaacataaaagaatttatactagagagaattcctacaaatgtgaagaaggtggcaaagcttttaactggtcctcaacccttacttattataagagtgctcatactggagagaaaccctacagatgtaaagaatgtggcaaagcctttagtaagttctcaatccttactaaacataaggtaattcatactggagagaaatcctacaaatgtgaagaatgtggcaaggcttttaaccaatctgcaatccttactaaacataagataattcatactggagagaaacccaacaaatgtgaagaatgtggcaaagcctttagtaaggtctcgactcttactacacataaggcaattcatgctggagagaagccctacaaatgtaaagaatgtggcaaagccttcagtaaggtctcaacccttattacacataaggcaattcatgctggagagaagccctacaaatgtaaagaatgtggcaaagcctttagtaagttctcaatccttactaaacataaggtaattcatactggagagaaaccctacaaatgtgaagaatgcggcaaagcctataagtggccctcaacccttagttatcataagaaaattcatactggagagaaaccctacaaatgtgaagaatgtggcaaaggttttagtatgttctcaatccttactaaacatgaggtcattcatactggagagaaaccctacaaatgtgaagaatgtggcaaagctttcaactggtcctcaaaccttatggaacataagaaaattcacactggagagacaccctacaaatgtgaagaatgtggcaaaggctttagtatgttctcaatccttactaaacataaggtaattcataatggagagaaaccctacaaatgtgaagaatgtgataaggcaactcatgctggagagaaaccctacaaatgtgaagaatgtggcaaagctttcaactggtcctcaaaccttatggaacataagagaattcatactggagagaaaccctacaaatgtgaagaatgtggcaaaagcttcagtacattctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccaatctgcaattcttattaaacataagagaattcatactggtgagaaaccctacaaatgtgaagaatgtggcaaaacctttagtaaggtctcaacccttactacacataaggcaattcatgctggagagaagccctacaaatgtaaagaatgtggcaaaacctttattaaggtctcaacccttactacacataaggcaattcatgctggagagaagccctacaaatgtaaagaatgtggcaaagcctttagtaagttctcaatccttactaaacataaggtaattcatactggagagaaaccctacaaatgtgaagaatgtggcaaagctttcaactggtcctcaaaccttatggaacataagagaattcatactggagagaaaccctacaaatgtgaagaatgtggcaaaagctttagtacattctcagtccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaagcttttaaccgatctgcaatccttattaaacataagagaattcatactgatgagaaaccctacaaatgtgaagaatgtggcaaaacctttagtaaggtctcaacccttactacacataaggcaattcatgctggagaaaagccctacaaatgtaaagaatgtggcaaagcctttagtaagttctcaatccttactaaacataaggtaattcatactggagagaaaccctacaaatgtgaagaatgtggcaaagcctataaatggccctcaacccttagttatcataagaaaattcatactggagagaaaccctacaaatgtgaagaatgtggcaaaggttttagtatgttctccatccttactaaacatgaggtaattcatactggagagaaaccctacaaatgtgaagaatgtggcaaagccttcagctggttgtcagtctttagtaaacataagaaaactcatgctggagagaaattctacaaatgtgaagcatgtggcaaagcctataagtcatcctcaacccttagttatcataagaaaattcatactgaagagaaaccttacaaatatgaagaatgtggcaaaggctttagtacattctcaatccttactaaacataaggtaattcatactggagagaaaccctacaaatgtgaagaatgtggcaaagctttcaactggtcatcaaaccttatggaacataagaaaattcacactggagagacaccctacaaatgtgaagaatgtgacaaagccttcagctggccctcaagccttactgaacataaggcaactcatgctggagaaaaaccctacaaatgtgaagaatgtggcaaagccttcagctggccctcaagacttactgaacataaggcaactcatgctggagaggaaccctacaaatgtgaagaatgtggcaaagctttcaactggtcctcaaaccttatggaacataagagaattcatactggagagaaaccctacaaatgtgaagaatgtggcaaaagctttagtacgttctcaatccttactaaacataaggtaattcatactggagagaaaccctacaaatgtgaagaatgtggcaaagcctataagtggtcctcaacccttagttatcataagaaaattcatactgtagagaaaccctacaaatgtgaagaatgtggcaaaggctttgttatgttctcaatccttgcaaaacataaggtaattcatactggagagaaactctacaaatgtgaagaatgtggcaaagcctataagtggccctcaacccttagatatcacaagaaaattcatactggagagaaaccctacaaatgtgaagaatgtggcaaagcctttagtacgttctcaatcctcactaaacataaggtaattcatactggagagaaaccctacaaatgtgaagaatgtggcaaagccttcagctggttatcagtcttcagtaaacataagaaaattcatactggagagaaactctagaaatgtgaagaatgtggcaaagcctataagtggccctcaacccttagttatcataagaaaattcatactggagagaaaccctacaaatgtgaagaatgtggtgaggctttcaactggtcctcaaaccttatggaacataagagaattcatactggagagacaccctacaaatgtgaagaatgtggtaaaggctttagtatgttctcaatccttactaaacataaggtaattcatactggagagaaaccatacaaatgcaaagaatgtggcaaagcctataagtggtcctcaaccctcagttatcatagaaaattcatactggagagaaaccctacaaatgtgaagaaagtggcaaagccttcagctggttctcagtctttagtaaacataagaaaattcatgctggagagaaattctaaaaatgtgaagaatttggcaaagcttttaaacagttcccaaccctcctacacataagaaaattcatgctggagagaaactctacaaatgagaagaatgtggcaaaggcttcaaccagtcctcaaaccttatggaacataagagaattcatactggtgagaagccctacaaatgtgaagaatgtgataaagacttcaactggtcctcacaccttactactcataaaagaattcatactggaggaaaaaccctacaaatatgaaaaatgtggcaaaactattaattaattctcaacgcttactgaacataagggaatttgtacaggagggaaaccctacaaatctgaagaatgtggcaagccttttagctattcctcaatccttactaaacattcatgtaattcatactggagggaattcctacaattgtgtggaatgttgcaatgcccttaaccagtccttaaggcttactacatataagacaactcatactggagagaaaccatgcatgtgtgaagaatgtgggaaagcctctaatagatcctcaattcttaagagacataagctaattcatacacaagagagactctacaaacctgaaagatgtgacaatgcttttggcaacacctcagacttttctgaatataaaagaaatcgtacagatgagaaatcctagaaaagtgaagaatatgacaaagcctttaagtggctgtcacacttgattgtaggtaagataactcatactggagaaaactactgtaataaacaatgtgacaaacatttaaccagtgctcatgccttattgcaaaggaaagcatttacactagcctgggcaacagagagagactgtctggaaaaaaaaatttttgttaatgccagtaatatcttctcacagcttattaaacatcagagagttcatactaaataaaagtattaaaagtgcaatcactgtcactagatctttcagaaaataaaagctgttaaagtacagaagaatatttattttgaggaaacacattataaatattaagagggttgtagtacatgtacttgtatcacagattttattgtacacattttgtactacaggaaaacctgaggtagttgttccaactttgctcaacatcagggaatttatattgaagaataaccctgcaaatttaataaatttggaaaaacattttttcaaaaactacagattataaaacacaaatgcgtttatactaaaatatgtttttgcagatacagtaaatataaaaaatatttaatccaaaattaagtttatgtaaatatcagctaattcacagtagaaatacctgtcactcaaacttcagatattacactaaatcagactgctgagtataggaaaaaatccaaaactaaagttggcaaaaagaagaattatttgtatataactttaaaagaagtagatctttgaagagttataattaaatttaaagtatacttttttcttcaaaacacagattttttttttttccagacacattggcttactgtggccaatactttgtgatgccaaggtgggcagatcacctgaggtcaggagttcaagaccagccttgccaacatagtggaactaaaaagaaatgtttactaaacatgtttactaaaaagaaataaagaaattagccaaggtctagcttccaggttcatgccattctcccacctcagcctcccaattagctgggactacaggcgcccgccgccactcccagctaattttttgtatttttagtacagatggggtttcaccatattagccaggacggtctctatctcctgacctcatgatatgcccaccttggccacccaaagtcctgggattgcaggcatgagccacagtgcctggcctaataacagaagtctttagcagagcaaaaatgtataaaatgtataatgacattgtataagtaataataaacctactaaccataaaaagccctggatcatatgaaatcacagcgaagttttaccacattgcaaagagttttacctaagcctactgaatgcattcgaaaaaatcaaggtgggatttcaccctaacttgttatattaaatcagtgaaatatatgaaactaaaatctagtgaaggcaccacaaaaaaaggaaagtacaggtcaatattctgggtgaatattggaataataatcctccatgaaatactagcaaactgaattcaaaagcaaatcagaaagttattttgctacattaatgtgagcttttccatatatatgaaggtgtttcatgatatggaagtcaataagtgtgattcaccatgtaaagataattaaaagaaaaaaaaataacagtaggggcagaaaaagcattcaagaaaacccaatattaactcaaaaatgttgtcaacacactggacattgatgaaaatatcttaataagagtcatctatgacaaatccttagccaacatcatactaaaagagcaaaaactggaagcattctccatgagaataaaaataagaatatccattctaaacagtcctattgaagttatgaaatcctagccagagaataaaaggaatccaaacagaaaacaaagaaagtcaaattatctttactgatgaaagaattgtccacctagaatactttaaaggtttcaccaaaagagttctaagcctggaaaaagacttcaaaaaaaatcttagaatacaaaatcagcacaaatgcatagcatttctgtacaccaataatattcaaactgagaacaaaataaaaaacacagctctatttacaatagcaacaaacacacaaaaaaatacctagaaatacattaaatcaagggggtaaaatatctctacaaagaacaacaaaacattgctgaaagaaacgagagacaatgcaaataaatggaaaaatattgctcatggattcaaataatataattaaaatggtcattctgcctaaagcaacctacagattaagtgctatttttatcagactatccatgacgatttttattgaattagaaaaagaaaactattctaaaatacattcaaaagaattaaagagctcaaatagccaagaaaacttcagactaaaagaataaatctgggccaagcatggtggctcatgcctgtcatctcagccctttgggaggctgagatggatggatcacctgaggtcagaagtttgagaccagcctggccaacatggtgaaacctgcatctctactaaatgtaaaaaattagccaggtgtggtggtgcatgcctgtaatcccagctacttgggaggctgaggaaagagaaccatttgagcctgggaggtggaggttgcagtgagccaagattgcatcagaataaccagtataacatggttctggtacaaaaataaacatctagaccaatgaaatggaagagagagtactgaattaagctatactttgcaatcaggttatttttacaaagccaacagaaataaacaaaaggggaattaactccctatttagtaagtaatactgggaaaactggttagtcatatgtggaagaaaactgtactacctttttctataaaaaaaaaacaactcaatatagattaaagacttgatctgtgagtctccaagctacaaaaatcttagaataacacttagataatactggcctctgtaaagaatttatgactaacatctaacatgagtgcaacaaaaataaaaataaaaaatggcatctaagccaaagagcttctgcacagtaaaagaaactatcagcaaagtaaacagatgacctacagtatgaaataaaatatttgcaaactgcagacaatgaaggattaatgtacagaatctataatacatttaataaaaaagcaaacatgatatgaatagccagcttcttctcaaaggaagacataagagctgccaataaacatgtaaaaattgctcaacgttcctaattatcagaaagatgtaaatcaaagtgacagtgtgatactatttcataccagtaagaatgacttattaaaagtaagataaataagatgttgaagttgtagagataaggaaatctttctacactgttggtgggaatgcaaattaattcagaacctgtgcaaagcagtttggggacttctcaaagaactagaaatagaattgccatttgaccaatcaagccgattactggatatctgcccccaaaaagaataaataattttgccaaagagacaccagcactcacatgttcattgcagcactattcacaatagcaaaaacagaatttaaccagttacccatgaatcttttattggataagaaaaatgatgtacttatacaacctccaatactatgcagcaacagaagagaatgaagtaacgtcttttgcagcaacatgaatgcagctctgcttcaggccattctaagcaaattattgcatcagaaaaacaaatgccacatgttctcactcatacatggatgctaaaaattgggcgcacatggaaacaaagatgaaaacaataaacactgagaattctaaaaagaaggaggaaggatgggagacaagcatagaaaatctgcttaggtatgatgtacactacttgggcaatggaattattaagtatccaaacctcaacatcatgtagtctacctgttttacaaatctgcacatgtaccttaaatataaaataaaaataataaaatgttttttggtataa

SEQ ID NO: 1255 - DNA, 168 bp, Homo sapiens
tatgaatgtcctgtgtgttggaaagcttttagccagaagtcacagctcataatacatcagagaacgcacacgggagagaaaccctatgcatgcactgagtgtggcaaagccttccgagaaaagtcaacattcactgtacatcaaagaactcatactggagagaaaccc

SEQ ID NO: 1256 - DNA, 2512 bp, Homo sapiens
cagggcgggacttgtggcgtcttcgcagcggtcattttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactgagggacccggcttcggttcccatagctacagaggtgcttttcaaacttacacagggaagtgtgacctttgaagatgtggccgtgtacttctcctgggaggaatgggatctccttgatgaggctcagaaacacctgtacttcgatgtgatgctggagaactttgcacttacgtcctccctgggttgttggtgtggagtggaacatgaggaaacaccttctgaacagagaatttctggagaaagagtgccacagttcaggacttccaaagaaggttcatcttcccagaatgccgactcctgtgaaatatgttgcctggtcttgagagatattttgcacttggctgaacaccaaggaacaaactgcgggcagaaactacacacatgtggaaaacaattctacatcagtgcaaatcttcaacagcaccagaggcagcacattacagaggcacctttcagaagttatgtggacactgcctcgtttacacagagttgcatagtccatgtgtcggagaaaccctttacctgcagggagatcaggaaagacttcctggccaacatgaggtttctccatcaagacgccactcaaacaggggagaagccaaataacagtaacaagtgtgcggtggccttttacagtggaaaaagtcatcacaactggggaaaatgcagtaaagcctttagccacatagacacacttgttcaggaccagagaatcctcactagagaaggactttttgagtgcagtaaatgtgggaaagcatgtacgcgaagatgtaacctcattcagcaccagaaagtccacagtgaagaaaggccttatgaatgcaatgaatgtggaaaattctttacctactactccagtttcattatacatcagagagttcatactggagaaaggccttatgcgtgccctgaatgtgggaaatcgtttagtcagatatacagcctcaatagccataggaaagttcacactggagaaaggccttatgaatgtggggaatgtgggaaatcttttagccaaaggtccaacctcatgcagcatcgcagagttcacactggagaaaggccttatgaatgcagcgaatgtgggaaatcttttagccaaaactttagcctgatctaccaccagagagttcacactggagaaagacctcatgagtgcaatgaatgtggaaaatcctttagccgaagctccagcctcattcaccaccggagacttcacactggagaaagaccctatgagtgcagtaaatgtgggaagtcatttaagcaaagctccagcttcagttcacatcggaaagtccacacaggggaaaggccttatgtgtgtggggaatgtgggaaatcctttagccatagctccaaccttaagaaccaccagagagttcacactggagaaagacctgttgagtgcagtgaatgtagcaaatcctttagctgtaaatctaacctcattaaacacctgagagttcacactggagaaaggccttatgagtgcagtgaatgtgggaaatcctttagccaaagttctagcctcattcaacaccgcagagttcacacgggaaaaaggccttatcagtgcagtcaatgtgggaaatcctttggctgcaaatctgtcctcattcaacaccagagagttcacattggagaaaagccttagctgtactgagaatatgcaatttccttttagtgtaattatactgaaggagtacacctgtgagagagacaagtacctgatttggaagccccaacatctaaggatatacagtgggcggattccccttaagttccaggtatgtgttacactttctaacatgccatttagaaagtgttagactttctcacctgccatttatggctcttgccgtttatgtcactgacagtttctgaggcagaagccgtatcatgtctaccacctgtgaggtccacacagtgtgtatcatttacctcctgaacctgctcaaggaagcagacctctgcttctccccatttgctagaagaaatcatgaatagtctgagtcttcctctctgacaagttagggcatggacttgacccagctttgtgccagagaacccaatatgagtgttgttggcagcttgccaagaaggactgtctttttcaagacatactggtttcatgtgacacctccatggatttttttccagcctctaagtcaccaacttgggaactgcttgtctcacgttgctttgttttttacaataataaaagcattattatttaagctacctttatcttg

SEQ ID NO: 1257 - DNA, 2796 bp, Homo sapiens
gcggcggcttccaacaggctctggggcgccgagcggacaggaacgcagcacgggggctccgaggcggggtctgggtgttgaggggcgactggagccatggcggagtcggcgcctgctcggcacaggagaaaacgacgctccacacctttaacttcttccacacttccttcacaagcaacagagaaaagctcctattttcagaccaccgagatttcactctggacggtggtggccgctattcaggctgtggagaagaagatggagtcccaggctgcccggctacagagcctggaggggcgcacggggacagccgagaagaagctggctgactgcgagaagatggccgtggagttcgggaaccagctggagggcaagtgggccgtgctggggaccctgctgcaggagtatgggctactgcagaggcggctggagaacgtggagaacctgctgcgcaacaggaacttctggatcctgcggctgcccccgggcagcaagggggaggcccccaaggtgtccaggtcactggagaatgatggcgtctgtttcaccgagcaggaatgggagaatctggaggattggcagaaggagctctacagaaacgtgatggagagtaactatgagacactggtctctctgaaggtccttggccagacagagggagaagcggagttgggtacagagatgctgggtgacttggaagaggaaggtcctggtggtgcccacccagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggccaagctgcatcagtgtgatgtgtgcctgaggagcttcagctgcaaggtgagcctggtgacccatcagcgttgccacctgcaggaggggcccagtgccggccagcatgtccaagagaggttctcacccaacagcctggttgccctgcctggccacatcccttggaggaaaagccggagttccctcatctgtggttactgtggcaagagcttcagtcacccatctgacttggtgcggcaccagcgcatccacacgggtgagcggccctacagctgcactgagtgtgagaagagctttgtccagaagcagcacctcctgcagcaccagaagatccaccagcgggagcggggtgggctggccctggagcccggaaggcccaatggcctgctttaagggtgcagcccctcgcccgtctgggggatggaggggggtggcattggttcccccgaagagacactgcagtcagggactgagttcttcctgagggcagttgtttgtgattgccttcccttgtcccagtaccaagccaagcccaaaggctgtcctgaaaaccctgtggaagaagagtccaggccaggtcttcatcctgctgccaagtttgctgtttcttggcaccttcaggtctctggttttctcattcatgccaatgcttgtgggctggggttggcgttctgaccccacagggactggtggctggttccagggctcgtcccggcatttcatgtcttcccacggggttgagtcgggccataggggtgagcagctgcctggaagagttctgggaagtataaccctccattttttcttgttttataatctctttgtttaataataagtagaagaaataatttaaatgaactgcttagccctgctctgaagaaccttttttggaattagattttagttgattttttaaagaatacagcccaacacttgttttttacattttaagagttgtagaagttgttcctaacttggggactggacctaccctctaggagggagttgttaatggggctcttttagcccactgatgcttacttaggccggagagcaggggacacggtgctaggttccctcgtgcagtgcctggtgctctcaaattgtctcaaaaggaccaagaggaaaagagtcggaggggtagaccctgcagccctgttgagaagaaagattccagtgaagttgctgatggtatggctgtggtctgggacttgcggtgtctcggcatacccctctcctcttcccacctcctcctggctatgttctgcagcctcccagagtagaaaactactttgttacttaaggttgttcaccttgtaccagtggttatttgagtttgttcctattacaccaatccttacttgaggtggttcggattacagtttccaaatgcattctgggattgcctattccagagagggtacagaaaaagcacacagatggcttgtctcaggagtgttgaatgtgtgccccgctgctgtctggggggatgggagtgggctctggggtcatatgtgaacatccccttggatgatttgcggttgcttagaataaaacttgctactagcaaaagaaaaaaaaaaaaaaaaaaaaaaaaaaaaaaaa

SEQ ID NO: 1258 - DNA, 3200 bp, Homo sapiens
ttcctgttcattggccatcggtcatggagaaggcgggctcagtggacgaacggctttctgggagctggggaatgcttgcgtacgtagtttcccagcgagccccgcgaggacttccggcgccgggagctcgcggcggaagtgggatctcctgggccgtagtgggcgttgtgtgtttcgggggcgaggctgcggtggacagcgcggggctccggctggctcgccttcccgcctgccgtgtcctgctgagcgaccctggagtacacatccagatgccagcccagctaccacaggggatccctctgggagactgaaagtacaggttctggggcccaggttgaagccgaccaaccctgagcctcaggccaggggaatggcagcccccttggaggcccaggaccaggcccctggggagggagaagggcttctgattgtgaaagtggaagattcctcctgggaacaggaatctgcccagcatgaggatggcagggattccgaagcctgccgccagcgcttccggcaattctgctacggggatgtgcatgggcctcatgaggccttcagccagctctgggagctctgctgccgctggctgcggcccgagctgcgtaccaaggagcagatcctggagctgctggtgctggagcagttcctgacagtgctgccaggggagatccagggctgggtgcgtgagcagcacccgggaagcggtgaggaggctgtcgccttggtggaggacctacagaagcagccagtgaaagcctggcgacaggatgtgccctcggaggaggcggaacccgaggctgcaggccggggatcccaggccacggggcctcccccgacggtgggggcacggaggcggccgtctgttccccaggagcagcacagccatagcgcccagcctcctgctcttcttaaagagggtcgtcccggagagacgacggacacctgctttgtctctggggtccatggacctgtggcattgggagacatcccattctatttctcccgggaagaatggggcaccctggaccctgctcagcgggatctcttctgggacataaagcgggagaactcccggaacaccaccctgggttttgggctcaaaggccaaagtgagaagtccctgctgcaggagatggtgccggtggtgccaggccagacaggcagcgacgtgactgtgtcctggagccccgaggaggctgaggcctgggagagcgagaaccggccgagggcggccctgggcccagtggtgggcgcgcgacgggggcggccacccactcgccggcgccagttccgggacctggcagccgagaagccgcacagctgcgggcagtgtggaaagcgcttccgctggggctcggacctggcgcggcaccagcgcacgcacacgggcgagaagccacacaagtgccctgagtgcgacaagagcttccgcagctcctcggacctggtgcgccaccaaggcgtgcacacgggcgagaagcccttctcctgttccgagtgcggcaagagcttcagccgcagcgcctacctggccgaccaccagcgcatacacacgggcgagaagctttcggctgcagcactgcgccaagagcttctcgctgcgctcctacctgctggaccatcggcgtgtgcacaccggtgagcggcccttcggctgcggagagtgcgacaagagcttcaagcagcgcgcgcacctcatcgcgcatcagagcctgcacgccaagatggcccagccgtggggtgagcagctggcttgccggaaacccgggggaggcccagccacggcacatcctgctttgttcaccactgggactctccttccatctgtggccacctcccgggctgtccgagggaccccagggtacctcacactcggagctcgcctgccctgcttggctctgaggacctgcccagcgctcaaagggaacggaagccttcccctcccgcccccgatcttgtcctctttcccccttctgcgcctagcgttcctcttcccctctagtttcctggagccccaacacattcctggcagggacagcagggtggcaaggactcaggtctaggtcccttcccagaagcccccgagcctcatttgactgtgtggctctttggcccccaccctgtggggtgggtccatgggtcaggcctctgccctaccaacctgtgcctttcagtgggcgtggaggactggccttggccccccagggggctgctggactttgggagagacagccacacctgtgggaccgcgggtcttagtcacggcggcaggggctttctggccccctcccactcccgtttccaggccatgaccactctgccctgtcctggccatacggactcggcctgcctttgccctcggcctacttgccctagcatgaggctctgagagccacctgcccaccaatctggtgaggataatggtggctccagcgacaggaggccaaccctggagaccaagaacagggcgcctggctgccatcttttcctccagaggtggggctgcaccagactcagcactagcactccatcagcactagcacctcactccatcagcactagcacctcactccatcggccccggcaccctgctccatcggcactggcgccctgctccatcggcactaatgctccactcggcgccccactccatcggccccgctccatcggcactaatgccccactcggcgccccactccatcagcactaatgctccactccattggcactaacgccccaactccagcggcactaatgacccgctcctttgacattggtgccccactccatcagcactaacgccctgctccatcggcactggtgtcccactccattgtcactaacgtccggctccatcggcactaccaccccgctccatcatcactatggtccagctccgtcggcactaccaccctgctccatcatcactacgtccagctccaatgcactggtgccccattccatcgggaataacgccccgctccaccggcaccagtgcctcgctccattggcaccaacgcccagctccaccggtactggctccctgctccatcggcactaacgccctgcttcattggcactttgctgctgcctcctgagcactgccttccatgaacagggacagaccagaggccctgcaagactccccctcagacctccaaagggcaacagaagagtattaataaacgtgaaaactt

SEQ ID NO: 1259 - DNA, 2668 bp, Homo sapiens
aagacctgggacttccgtttcggtccagccgggctgcggccattgtttgtgtggactgagtgttttggccatcccggtccactctcacaggctccgttaagtgacatgaactctcaggaggactgagccagaagcggacagggcaagacgagctgtgcttgaaggaagaggggcagaaaatcgagggtcagggactgagaagctactccggtttagaaaccccagagacacccgtgtagatgggtacatcacggcttctctcccacgttaagacttaataaagaaagcctgatctttgaccagatggcagtaacatttgaagatgtgactattatttttacatgggaggagtggaaattcctggattcttctcaaaaaagactctacagggaggtcatgtgggagaactacacaaatgtcatgtcagtagaaaactggaatgagagctacaaatcccaagaagaaaaattcagatacttagaatatgaaaatttttcctactggcaaggctggtggaatgctggcgcccagatgtatgagaatcagaactatggggaaactgttcaagggacagattccaaagacctcacacagcaagatcgttcccagtgtcaggaatggttaatactctccacacaagtaccagggtatgggaactatgaactgacttttgaaagcaaaagtctcaggaacttaaaatataaaaattttatgccttggcagtccttagaaacaaaaaccactcaagactatggtagagaaatctacatgagtggttcacatggttttcaagggggcagataccgtcttggcatatccaggaaaaacctctccatggaaaaagaacagaagctcatagttcagcattcttatatcccagtggaggaagcccttccacagtatgttggggtgatatgtcaagaagacctactgagagattcaatggaagaaaagtactgtggatgtaataaatgtaaaggaatttattattggaactcacggtgtgttttccacaagagaaatcaacctggagaaaacctctgtcaatgctccatctgtaaagcatgcttctctcagagatcagacttgtatagacatccaagaaaccacataggtaagaagctgtacggatgtgatgaagttgacggtaactttcatcagagctccggagttcactttcatcagagagttcacataggggaggtaccttatagctgtaatgcatgtggtaagagcttcagccagatctctagtcttcacaatcatcaaagagtccacacagaagagaaattctataaaattgagtgtgataaagacctcagtagaaattcattacttcacattcaccagagacttcacataggagagaagccttttaaatgtaatcagtgtggtaagagttttaatcggagttcagtacttcatgttcatcagagagtccacacaggagaaaaaccatataagtgtgatgagtgtggtaagggtttcagccagagctcaaatcttcgaattcatcagttagtacacacaggagagaagtcttataaatgtgaagactgtggtaaaggctttacccagcgctcaaatcttcaaattcatcagagagtgcatacaggagagaaaccttataaatgtgatgactgtggaaaggactttagtcacagctcagatcttcgcattcatcagagagtccatacaggggagaaaccctatacttgtcctgaatgtgggaagggcttcagtaagagttcaaagcttcacactcatcaaagagtacatactggagagaaaccctacaaatgtgaagagtgtggcaagggattcagtcagcgttcacatcttctcattcatcagagagtccatacaggagaaaagccctataaatgtcatgattgtggaaagggttttagtcacagttctaatcttcacattcatcagagggtccatacaggagagaagccttatcaatgtgctaagtgtggtaaaggtttcagtcatagctcagctcttcgaattcatcaaagagtccatgcaggagagaaaccttacaaatgccgtgaatattataagggatttgatcataattcacatcttcacaataatcatagaagaggaaacttataaatattgttcatttagttaacagctttaatcaaagtttacctaacctttaaaccctataaatcctgctgttaaggaaatcttataaataacacaagtaatcccaagcaacatttatagtttcccctatctcccactaagaattatttgcttcaaaaggagatctttagaaaaaaccctatatatttaaaattatagtgtatttttctttacctactataaatataatacagtcataaatatattaaacatttaaggagaaaactcttcattctatttcattctagtctttttttctgtgcattttaatgtgcatgaaattgtgtgttcaattttgtattttcactgtcttcaaaatatttacttaaattttggtttgaattgaaactggttggccaactgttaaacgacatctcttaactcccctaaaaactccctaggaagtaacagaaaagatggaaacacatagaacttaaaactcagttttggccggtagaattcaattgtttatggacaaaagccacctaataaaagataggaaagcatt

SEQ ID NO: 1260 - DNA, 3658 bp, Homo sapiens
tgcagaaagggacggggctggcaaaggcctggtctacctcaccgatccgggtcgcgggggctcctagggggttccttccacagctggtgcgcgtgcgcaagagtgcgtcgaggttgttccgcggcaatttatgaaactcggagccggcagtgagttgagggttcggcgaggtcagggattcctagttgcagcgtgattaccaacgccagctcccttcactgtccaagacagcgattccgcggctcctctgagaactggcgctttgttcatcatttgccacttaagctacttgcagtcacgtcacaccttggatctctatcatcaaaactattccacctcggaaatcttacctaaatgcagcatgccatcctgaacgtctctccctgtcctagctctgtaactgtttacattgctcaggtacctgaatattggctttgtgtctaaagtttctggaactttcctccttaccgtgaaataacttggcttaaatcacactgcatatagtacacaggtgcttagctcaagcctgagaattactgcaatctagtaaggcggatttgaactactgtgggagttctatttaggaagatgcagcctctgagcaagttgatggctatctcaaaacctcgaaacctgtctctacgtgaacaaagagaggttctgagagcagatatgtcttggcagcaggaaaccaaccccgtcgtggagacacatgactctgaggcatctcgtcaaaagttcagacatttccagtatttgaaagtgtctgggccccatgaagccctgagccaactctgggagctctgtcttcaatggctgagaccagagattcatacaaagaagcagattatagaactgttggtgctggaacaattcctggcaatcctgcctgaagaagtcaggacttgggtgaatttacaacatccaaacaacagtaaagatatggtgaccctcatagaagatgtgattgaaatgcttgaagatgaagatatgccctgcaaggactctgccctgcagatggggagcatcaaggagaaaatgaaagctggctcacgaacaggcaaaccacaggaaccagtgacattcaaagatgtggttgtggaattcagcaaggaagagtgggggcaactggactctgctgtaaagaacctgtacaggaatgtgatgctggaaaactttaggaacctgaattcattgcgtaaagcacatctactttccaaaccatttgagagccttaagttggagagtaagaaaaaaagatggataatggagaaagaaataccaaggaagactatttttgacatgaagagtatttctggagaagaatcatcccatggagtgattatgacaaggcttaccgaaagtggacacccttcttcagatgcctggaaaggtgagaattggttatataggaaccagaaaaaatgggacataaatttgccacaagaggctttcattcctgagacaatttacactgaggaggaagattttgaatgtagtgaaaataagaaaagctttgatattaattcagttagctcaatttgtgctatacaagtgggaattccttcaagaaaggggtctccaaaatgtgataagtttaaaacttacttcaaatttaatttagactcagtaggtaagcaacattcagaatatgaatatgggaatgacttgagtttgagtacagatattcgacaccaaaaaagtcatactacaatgaattcctatgaatgttatcaatgtgggaaagccttctgccgaagttcatcccttattcgacatcagatcattcacacaggagagaaaccctataaatgcagtgaatgtgggagattcttcaaccgacgtacaaaccttactaagcatcaaaaacttcatgctgaagcaaaggcctgcacaagcaataaatgtggaaaggccttcagtaaaagtgaagacagtaataatccaacactccattttggaaacaatttctatcaatgtgttaactgtggaaaatccttcaaccggagctcctctcttattcgacaccaaatgattcacacgggagagaaaccattcaaatgtaaggaatgtagtaaagccttcaacaggagttcaaaccttgttaaacatcaaaaactgcatactcgagataagtcctgaaaaaagaaaaaatgaaagattaccttcagtcagaatgcagaactcatttaacatcatgaatttatgctggataaaatctcatgaatataatgtaagaaaacatttgtcagatttttctttaaatgatatcacagaattaatgttggatagaaatatcattggatagaaatctgtttgaaggaattttcctggttttcagatgaagccataaggctttggagttaaaccacagtatcaccatacaagtatttgtttatcattattttgatatccattaccctcacctctccctagttcataaataggtctatagcatactaatatccacctgatttattgacgaagtagacattaggcaaagccaaacaatactcttggagttgatatttaataaaactcagcccttttaagaaggtcacaagaaatcattagctcatgcgaatataagagaatacttctaaggacagaaatctctgaatcaatggctaagacaacagtaacagccatttactccactcctgacaataccctttgttgtcttgctgttgaatggagactagagttgggaaagggttatcaactgcaatgggagaagtatgtattgctgttaatctatatgtattcttaaaatctgcatttgtttatagcaggtccttgaaaaatgtttttgttttgttataatgttataattgttatgatgttgatgagaaaaatatcgattcccagccagggacactgtgtggagttcgcacactctccctatgtctccgggtgctccagtttcaaaccccaaagatgtatacattaggttaattgacatatctaaattatctcagtctgagtttgtgaggaagtgtgccctgcagtggaatggctcctaatcagggtttgttcccaccattgccctgagctgctaggatgcgctctgtccacccatggccctgtactggaataacagggtaaataattatcttatctgtttttattaatccgtcttaaatgtgtatatagctcagatttattttaatgtctgatattggaagcgtttggggtctttagaagtttgatgatgttgtgaccagacatttgccttaggaacttaactcttgtttgtatccattagtctatggtaaaattggttttgttatacatcatttcacttaaagttgcagttcctaagaacctattgatgatgttcagtgcagacttactgtacctttgggaatttaggctggagagacgtccatagccttaggtatatcatttataccagacattatgaagttattaaagtctcctatactctgtacaccagaactgtgtcttctgtaaactacctcaggatcccatctggttcttgagccaagaagtatgacttaatctgccccaaaaaattcacactggagacattcccaattaatgatgatggtagctttttgtgaaggttcataccttattcaaaggcagaaaaggtatactggagtgaactcctatgattaaataatgtcaaaatcta

SEQ ID NO: 1261 - DNA, 5747 bp, Homo sapiens
ctcttttccctcacagcccgggcgccgggcggcgagtgcgttagtcggccgggacgcggagctgtgtgcatctcctacgcgggctcgctcgctcccgggagccgcgcagcttccccggcggtggcaggagcggcgaagagcgccatcagcgggcccttacggccccaggcctcgcggcgcgcggtccgctcgccctcctcgtccgcccaacctgcggcctgtggaggcgtgaggcgacgacaggcgagcgcctcgagcagcgttagccgctgcggccgccggtcctccctccacctcctcctcggccccccctcgcttccctcctcccacttcccgagctccggcgtgtcccggccacgctcgacgctgctgcaggaacaaaggaagaccccgcggcggcggcggcgccacctccgcctgctgctccgacccgctcccggcccgcggcggcggcaccagggcgcccggctcagccttcccggaggcctcggcccggcctcatcgtgccggcttcgcgcgcgaacccggctttcgcatttgggaccctgcaggaaaaatatggctcaggagactaaccagaccccggggcccatgctgtgtagcacaggatgtggcttttatggaaatcctaggacaaatggaatgtgttcagtttgctacaaagaacatcttcagaggcagcaaaatagtggcagaatgagcccaatgggaacagctagtggttccaacagtcctacctcagattctgcatctgtacagagagcagacactagcttaaacaactgtgaaggtgctgctggcagcacatctgaaaaatcaagaaatgtgcctgtggctgccttgcctgtaactcagcaaatgacagaaatgagcatttcaagagaggacaaaataactaccccgaaaacagaggtgtcagagccagttgtcactcagcccagtccatcagtttctcagcccagtacttctcagagtgaagaaaaagctcctgaattgcccaaaccaaagaaaaacagatgtttcatgtgcagaaagaaagttggtcttacagggtttgactgccgatgtggaaatttgttttgtggacttcaccgttactctgacaagcacaactgtccgtatgattacaaagcagaagctgcagcaaaaatcagaaaagagaatccagttgttgtggctgaaaaaattcagagaatataaattacttcttgtgaagagactgaaactttgtttttattttaatatatcgtaggaaaacattaaagagcagatgcatggccatttttctttgatgttctccagagttttacattacacttgtctgtcttataattgatattttaggatgtttgggtgtttgttacaggcagaattggatagatacagccctacaaatgtatatgccctcccctgaaaaaaattggatgaaaatctgcacagcaaagtgaaacacacagataataggaacaaaatgtagttcccatgtgccaaacaaaataaatgaaatctctgcatgtttgcagcatatctgccttttgggaatgtaatcaaggtataatctttggctagtgttatgtgcctgtatttttttaaaatggtacaccagaaaaggactggcagtctacttctaccatagttaaacttcaccctctttaatttcacaacatattctttggaagcaggaagaaatgctcataaagaggatcagaccttctttcccgtgaaaccagtatttggcgccatatataagcctggttaaattggtcatctaaagctgtcaaataagacattctgtgaaaggtaaacatcgaaactggttataagtaaaaccatcaagccaacaacagggtcttgagataacctttgaagcttattgtactggcctgcaccagaagatgtctgcattactcattgctaaaaatgtgtagcacagaactgcactaggattaatttgtttacaagaagaaatttaaactctacgtttggttttcacatacagcagctctattgaataacatgcatctgaattttaagttgcaaaggtatctgaataatttttcatgtgcatcttttgtcgaatgttttggttcaagaaagaatgtttaaagctttttaaaagacttcagttcttaatgtaactgtacccttctgcatggaaaatcataaccaacatggctgcagtagacttcttagtggtatccagcaccacttgcagagggctgctttatcatattgtacttgggtgtaggactctagtgttcttgggtgtattgcatgggctgcattatctacagcattgtacaataacaactagaaaaggcagtatacttcactgatgcttgtctggtaataatcacttctgtgttataatggaaggttttttgtgatgtatgaaacttgtgttttttatatataaatgagtatagttagtgttgtggtaatgcctgttttcatctgtaaatagttaagtatgtacacgaggcactacttctgatttattgcaatgttcagtcctagtttttacttttattcttaaagcattcagttttgctttcaattttatgtaccttagttctgagttagacctgcagatgtgtacagatagttcatatttatgtattgcacataatcatgctattcagcattgatgctatattgtattatgtaaataataaaagccatgtacagagggaaacttcacttgttcattgggtttttaagccatagttggagtcctaaagggggaaaattagaaaatgttactttacatggctatataattttttttcctttgccatcgctgaacttgttcaagtgataatcaagagatattagaagcatttgcaggtatgatacctgataggcagtttatttttgaagaattcaataggcacctttgggattaaaacaattttaaaatttgagaaagatgaaatttgaacaattatggcctacctcgcttctccatgttgtaaaagatgatgttttatgacaattctgaagaagaaagtaggtatgacttagtttacaaaaagagttctgttttatttctgttttgggtttggctctaatacagagattcacccatggacttggtctctgtagcgtttatgccagatcataaagaacaaggggtgacaggtacatgttgactttacctggggtaaatgattaccagagtgcaactgttgcttctctgtgatggagtttggggtggaaataccctagttttatctgtcagttctttgcatgctgctacttttgcttcaagttagggaggtacatatgtatgtcaaagttcctatactgacatagggtagtatttctctgaatatgaaaagtcacaattgagttgaaaatttagaagttgaagatttagaagggcaacttaatttttcaagttaaaaatggaagtaagagtggtatagagaaggtaagatgagccctcggactccatcactctgaaggtctgagtagtagcaagagatagatttttgtttggccaggctgcagtgcaatggcgtaatcttggctcactgcaacctctgcctcctgggttcaagtgattctcctgcctctgcctcctaagtagctgggatcacaggcaccagccaccacgcccagctaatttttgtatttttaatagagacagtttctccatgttggtcaggctggtcttgaactcctgacctcaggtgagctgcccgcctcggcctcccaaagtgctgggattacaggcgtgaggcaccgcacccggccaatcagttttttttgttttttttttgtttgtttgttttacaagaaacattaaaccagatcagaacaaagatttgtcagggttgtccattgactggggagaaagggaatcagtgtgtaaggcacctgagaggactcagttctacccaaattcttgcattcaaacctgaatgcaaggccatgaagtcctttgaaatgtacagatattaagcaatttaataatataccatgtttcccttacataagcagacaaatatttacacccccatgacctgaagttttgttaggctgtgaccacatgaattcgcagtataaatgggtgagtcctttttgaaaacctcatcttcagtgtgcctgatctgtaaaactagagcctcaggtttgatcctaggtaggcttcccacaacgtggggaaaattagtttgtgagggaaagctgtttctgagcattatggcatagtgattaagatgagggaccctggaaccagcccgtgattttgggcaagttattttaggtccactttggactgcttcatctcttaaatgaagacagcaaccaccttcaggagtgtgaaggtgacaacacttaaaactgtgcctggcacattgtatttgctattgtcttaatgttctggaataatggtttccataacttgggaagaaaactttgagaacaggattggttacatcaagttgtatagtgaaaagataaagatttgttatttaaacttgcagtttaaagtcattagaatcattcttttccgtaaggctttctttgcaagagatctgcattaaataaagttgctaggaaataactaaaattggggaaataatctaataatagcaagatgttaagcatactattattgtattttgggggttggtaataacattcacatggatttatcaatacacactgagaagcaaagcctctcaagctgtcccatatcctccatttcaaaggcacacatacattttaggtaactcataatttagaaaggttatttaatcttttccacatgtaaatatttgaatatgtacaaagacttgatttgactcttgtctgtttttgttttgttttgtttgtttgagacagaggctccgtcgcccaggctggagtaaaatggcatggtctcagctcactgcaagttccgcctcccgggttcacgccattctcctggctcagcctccggagtagttgggactacaggcacccgtcaccacacctggctaatgttttttgttttttgggtttttttgtatttttagtagagagagggtttcaccgtgttagccagggtggtctcgatctcctgacctcatgatccgcccaccccggcctcccaaaatgctgggattacaggtgtgagccactgcgcctggccgactcttgtctgtttgaatgcaaagttctcaatagtggtttttgtccataagtattaacttataattttggagagtgataggtatggttgctggttgattagcaataagattatgtagccttaaactagctagaagagtttgcatgggtgaggcaacaggctgttaacaaaaagaaactggaaatacagtttcccctgtttgtttctcctgtttgtacaatctgctttaaaaacaagtgaacatgcaccatgtcagtcatggtgaatcggccaacagccagcccttgccagttgacatcacagtctaagatgggaaactggtacagatagacatgaagagagcttagcagtggttgaggtggtgactaaatatacagtcattgaataaataccgtgtagcaaatgtaaaaaaaaaaaaaaaagtacaacagaatacaaaagtgccatttaatattttatagctatttctatgcacaagtgctggttttaaatttatataaaagcaaagactgtttctgtgttttcttccagagtatttctgttacagccatagaagtaaagttaataaatgtaagactttttttgtttaaaaaaaaaaaaaaaaaaa

SEQ ID NO: 1262 - DNA, 5653 bp, Homo sapiens
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaacggaactttgagattatatgcaatcgaaagtgacaggaaacatgccaactcaatccctcttaatgtacatggatgggccagaagtgattggcagctctcttggcagtccgatggagatggaggatgccttgtcaatgaaagggaccgctgttgttccattccgagctacacaagaaaaaaatgtcatccaaatcgaggggtatatgcccttggattgcatgttctgcagccagaccttcacacattcagaagaccttaataaacatgtcttaatgcaacaccggcctaccctctgtgaaccagcagttcttcgggttgaagcagagtatctcagtccgcttgataaaagtcaagtgcgaacagaacctcccaaggaaaagaattgcaaggaaaatgaatttagctgtgaggtatgtgggcagacatttagagtcgcttttgatgttgagatccacatgagaacacacaaagattctttcacttacgggtgtaacatgtgcggaagaagattcaaggagccttggtttcttaaaaatcacatgcggacacataatggcaaatcgggggccagaagcaaactgcagcaaggcttggagagtagtccagcaacgatcaacgaggtcgtccaggtgcacgcggccgagagcatctcctctccttacaaaatctgcatggtttgtggcttcctatttccaaataaagaaagtctaattgagcaccgcaaggtgcacaccaaaaaaactgctttcggtaccagcagcgcgcagacagactctccacaaggaggaatgccgtcctcgagggaggacttcctgcagttgttcaacttgagaccaaaatctcaccctgaaacggggaagaagcctgtcagatgcatccctcagctcgatccgttcaccaccttccaggcttggcagctggctaccaaaggaaaagttgccatttgccaagaagtgaaggaatcggggcaagaagggagcaccgacaacgacgattcgagttccgagaaggagcttggagaaacaaataagggcagttgtgcaggcctctcgcaagagaaagagaagtgcaaacactcccacggcgaagcgccctccgtggacgcggatcccaagttacccagtagcaaggagaagcccactcactgctccgagtgcggcaaagctttcagaacctaccaccagctggtcttgcactccagggtccacaagaaggaccggagggccggcgcggagtcgcccaccatgtctgtggacgggaggcagccggggacgtgttctcctgacctcgccgcccctctggatgaaaatggagccgtggatcgaggggaaggtggttctgaagacggatctgaggatgggcttcccgaaggaatccatctggataaaaatgatgatggaggaaaaataaaacatcttacatcttcaagagagtgtagttattgtggaaagtttttccgttcaaattattacctcaatattcatctcagaacgcatacaggtgaaaaaccatacaaatgtgaattttgtgaatatgctgcagcccagaagacatctctgaggtatcacttggagagacatcacaaggaaaaacaaaccgatgttgctgctgaagtcaagaacgatggtaaaaatcaggacactgaagatgcactattaaccgctgacagtgcgcaaaccaaaaatttgaaaagattttttgatggtgccaaagatgttacaggcagtccacctgcaaagcagcttaaggagatgccttctgtttttcagaatgttctgggcagcgctgtcctctcaccagcacacaaagatactcaggatttccataaaaatgcagctgatgacagtgctgataaagtgaataaaaaccctacccctgcttacctggacctgttaaaaaagagatcagcagttgaaactcaggcaaataacctcatctgtagaaccaaggcggatgttactcctcctccggatggcagtaccacccataaccttgaagttagccccaaagagaagcaaacggagaccgcagctgactgcagatacaggccaagtgtggattgtcacgaaaaacctttaaatttatccgtgggggctcttcacaattgcccggcaatttctttgagtaaaagtttgattccaagtatcacctgtccattttgtaccttcaagacattttatccagaagttttaatgatgcaccagagactggagcataaatacaatcctgacgttcataaaaactgtcgaaacaagtccttgcttagaagtcgacgtaccggatgcccgccagcgttgctgggaaaagatgtgcctcccctctctagtttctgtaaacccaagcccaagtctgctttcccggcgcagtccaaatccctgccatctgcgaaggggaagcagagccctcctgggccaggcaaggcccctctgacttcagggatagactctagcactttagccccaagtaacctgaagtcccacagaccacagcagaatgtgggggtccaaggggccgccaccaggcaacagcaatctgagatgtttcctaaaaccagtgtttcccctgcaccggataagacaaaaagacccgagacaaaattgaaacctcttccagtagctccttctcagcccaccctcggcagcagtaacatcaatggttccatcgactaccccgccaagaacgacagcccgtgggcacctccgggaagagactatttctgtaatcggagtgccagcaatactgcagcagaatttggtgagccccttccaaaaagactgaagtccagcgtggttgcccttgacgttgaccagcccggggccaattacagaagaggctatgaccttcccaagtaccatatggtcagaggcatcacatcactgttaccgcaggactgtgtgtatccgtcgcaggcgctgcctcccaaaccaaggttcctgagctccagcgaggtcgattctccaaatgtgctgactgttcagaagccctatggtggctccgggccactttacacttgtgtgcctgctggtagtccagcatccagctcgacgttagaaggaaaaaggcctgtgtcatatcaacacttatctaacagcatggcacaaaagagaaactatgagaattttattgggaatgcacattatcgaccaaatgacaaaaaaacttgattcactaattagggggaaaaaaggtcttggtggatgtcagtgcttactccccatgaaattaaattttacttcatcctttgagaagcgaatggtgaaagctactgaaataagctgtgattgtactgtacataaaacatatgaggaatctgcaaggaacactacagttgtgtaaagttgttctgttaacttttgtaccaaatagcaatacaaactagttggaacagttggaacttacatacatggggactggaaatctctattttgtccctgaataatatttttcttagaattgaccaaataagaagtggaatttttgcatacttgagcgctgctgaaaagaaatcatttgggttgggtggggcgggatgggggaaaagtatataatgcttgcacctcaggtaaaaatctgtaaatatctaagttgtaaacctgcttgttcaaatactgtgtgtattccttttctctaatgcagctcatcacttggagcagtttctgctattgtgctctttcatttaaaatgtatgtttttttttttttaaactgtcaatgattttgtattatgttgaatccacccaaatctattgttgtcttaaaattgttaatggaagtattgaccctctatgatatgtgctgcagatatcgaggtcagccattcggaagctggcagcattttatcgcaactttgagcatctcagatggggaaggcaccttcttcctcgcctctccagattgtcctggaacctccaggatccttgactgagggcgttgggatggcttgtaggatttttaagagagtgtgtctacagacaagcattttctctgtagagcagccacacgttgtataaacataaactgtatgtgcagttatttaaatttgtttctgtcaaattaatcatttttgttggacgattcagtggcgggggggttttgcctaaattagtatataaaaacaaaaatgctaaattatatctgtgaattgcaggtattggggaacagttttaagggaaattttggggggaacattttaggtttgtatttggtagtcttaatgtatctggcatttgggtgaactgtggacatactagagttgattatagacacattgattttgaataaggaactgctggccgagcccgctgggagtctagaaagagaaaatctgtttctagacctcagttattttcccatttttggttgttttgaagcagtaacatttttctcagtgcacatgcaatttgggttttagagaagatggccaccagctggcttcctagatattttaaacttttgttctttaatatgctgtccatggctgagtttattagtacatgggcttagtgaccacaaaatattttattaagaaactgtttcaaaaataaatttgcactgttcatttttctggcctcgctgttctccatagagcaagggtaatcctagaaaaaattttttttttttaaattatgcaacgtaagatgtcctccttgatagaagtcttagctcctgtgttacaagggagaactcatttgagatcagtctgttggcattgcaatgaagtgctttgtatcaggaaagtgtacactattgaccttttttcctgttcacaagctgagccatatgtacataatctagattttgttttcatagttttgcacttttatagcctatttttgaagattaacacatttgcaagatgattgactcaatctttgcctaatccaatgagtgttacagagagcttgctgtgactagaaccataaatcttaaagggggtatgtgataatagagggctggaatttaaacctgtatttaaaaaaaagaatcaccaaatctatttgaaaacaagtcgatttgtattatgctggaattttttgggctttcagatttctctttttaaccacatttctgaatgtataaaaataccaattattttcctacagccctttgtacttcaaaatatgtttttgtgtccatcagtattaactattggtatactactggttttatatttttttttctttgagacaacagtacatataatagaggtacaattcgttggatttttgtttatgtatttatttcattccagtttgatttattttaattgttgatacttaagttgtcgaacagtagacattacttgttttatttatgatatatttcagcttaaagttatgttattatatgtggaagtgtaaatatagatttggtgttttgcaaaaaaaaaaaaaaaaaaaa

SEQ ID NO: 1263 - DNA, 3098 bp, Homo sapiens
aaaccgcccgcaccccgcccctggcggccgcctctcgcggctcccggggtccccagctccctgtccccggagccagagcccggctcccgcgcggctcccagccccgccgcgccgccccccgcatgctaatggccgggccgcctcccgccgcacacaatgcgggccagggccgggggcgggggaccggggagggggcgggggccgggccgggggcgggggggccggggcccggcgcatctcccccggccccacgtaacgctgacgcccgcgccgccggcccgccgcccgccgccgccgccgccgccgccgcccgctccgccgccgcccgcccggggctcctccacagcacctgttgccttcattagcagcttttcctcctcttccctgcacttcccagaaccaaagaatgtgaagggggtccatggagggctcacgtccccgcgccccgagcggccacttagcgccgtcgccgccggctttcgacggcgagctggatctgcagcgatactccaacgggccagccgtgagcgcagggtcgctcgggatgggagcggtgagctggtctgagagtcgtgcaggcgaacggcgcttcccctgccctgtatgcgggaagcgcttccgcttcaactctatccttgctttgcacctgcgggcgcacccaggagcccaggccttccagtgccctcactgcggccaccgcgcggcgcagcgggctctgctgcgctcgcacctgcgcacacaccagcccgagcgcccacgtagtcctgctgcacgcctgttgctggagttggaagagcgcgcgctactacgcgaggcccgactggggagagcccgaagctcagggggcatgcaggccacccctgccactgagggtctggcgcggccccaggctccttcatcgtccgccttccgttgcccctactgcaaaggcaagtttcgcacctcggcggagcgcgaacgccacctgcacatcctgcataggccctggaagtgcggcctgtgcagtttcggctccagccaggaggaggagctgctgcaccacagcctgacggcccacggggctcccgagcgtcccctggcggccacctccgctgcgcctccgcctcagcctcagcctcagcctccaccccagcccgaacccagatcagtcccccagccggagccggagccggagcccgaacgtgaggcaaccccgaccccagctcctgccgctcccgaggagcccccagcgcctccggagttccgctgccaagtgtgcggccagagctttacacagtcttggtttctcaagggccacatgcgtaagcacaaggcctccttcgatcatgcgtgtccggtgtgcggccgctgcttcaaggagccctggttccttaagaaccacatgaaggtgcacgccagcaagctgggcccactgcgtgccccggggcctgcctccgggcctgcccgcgccccccagcctcctgacctcggcctgctggcctatgagccgttgggcccagcgctcctcttggccccggctcccaccccggccgagcgccgtgagcccccgagcctcttgggctacctgagcctgcgagctggcgagggccggcccaacggcgagggtgctgagcccggtcccggccgcagcttcggaggcttccgcccgctgtcctctgctctcccggcccgggctcgccggcaccgtgcggaggagcctgaggaagaagaggaggtggtggaggccgaggaggaaacctgggcccggggcaggtcgctgggctctctggcttccctgcacccgcgcccgggtgagggaccggggcactctgcctctgctgctggggcccaggcaagatcgaccgccacgcaggaagagaatgggctgttggttggagggacccggcctgaagggggccggggcgccaccggcaaggattgtcctttctgcggaaaatctttccgctcagcacatcacctcaaagtgcatctgcgagtgcacacaggcgagcggccctacaagtgtccgcactgcgactacgcgggcacccagtccggctcgctcaagtatcacctacagcgccaccaccgggagcagaggagcggggccggccccgggccacccccggagccaccgcctccttcccagcggggttcggccccgcaatctggagccaagccgtctccgcagcctgcgacctgggtggagggcgcctcaagtccccggcctccttctagcggtgctgggccggggtcccgtcggaagcccgccagccctgggaggaccctgcgcaacgggcgaggcggtgaggccgaacccctggacctgtccttgcgggcagggccgggaggcgaggccgggcctgggggtgccctccaccgctgcctcttctgcccgttcgccactggagccccagagctcatggccttgcaccttcaagtgcaccacagccgccgggctaggggccgccggccaccccaggctgacgcgtccccgccctatgcccgagtaccatcaggagagacccctcccagtccttcgcaggaaggggaggagggctccgggctgtccagacccggagaggcagggctgggggggcaagaacggtagtgggccctcaggggcgattagcttagtgagcttaccccgccggagcgggggagcgctagaggtagttgggtagagaagccagcagggggcagcgtgggacccatatcccagccccaggcggaccagaggtggaaggcgcggcgggcgtaggagggtgggctggcggtacccacccagcccaagggagtcacagtgccttagaagtggcagaggtgagggtcaaagaacggggtccctgggctggcagagaaggtttgtgtccctgttgaggagccactctgccagtctttgctggtccataggcgtgagagtttatttttgtacaaggggtgagggtggggggcactgtacccttctagccccatcaggggccctgtagacgtcgctatttttggtacgattcctgtcatccctattgcagagtcgtgtccccaataaacaggtgtcttgaggcacagggccctgtgtctgtctgcctacctatgtcctgaaaaaaaaaaaaaaaaaa

SEQ ID NO: 1264 - DNA, 2204 bp, Homo sapiens
aaacgaacaacgctttcgggtgggcccgggaccatagagggtcgctccgccactttcctagagcgaccgcggcggcgccagagcgcggcgaggccctcacttccggcggcgcgggaggcgcccagcgagccagagtggtggctggtcccgcgcgaaaattctgagctgtacacctctaggaaatgaaacactagttcagaagaagcctgtaaactctcttacaaatacatttggttattcaccatgaggttagcaaagcctaaagcgggtatttctcggagctcaagccaaggaaaggcctatgagaacaagcgcaaaacaggccggcagcggcagaagtggggcatgactattcgatttgactcaagcttcagtagactcagaagaagcttggatgacaaaccctataaatgtactgaatgtgaaaagagtttcagtcagagttcaactctttttcaacaccagaagatccatactggaaagaaatcccataaatgtgctgattgtgggaaaagtttctttcagagttctaatctcattcagcatcgacggatccatacgggggaaaagccctacaaatgtgatgagtgtggagaaagcttcaaacagagctcaaatctcattcagcaccagagaattcatactggagaaaaaccctatcagtgtgatgagtgtggccggtgtttcagccagagctcccaccttattcaacatcagagaacccacactggggagaaaccctaccagtgcagtgaatgtggcaaatgtttcagtcagagctctcatctgaggcagcacatgaaggtgcataaagaagagaagcctcgtaaaacccggggcaaaaatatcagggtgaagactcacttaccctcttggaaagctggtacaggaaggaagtctgtggctggtctccgttaagtatagggctttttgacagctttttgagacctcttaagaaaaaataaaaagtaaaaaatgaaaggaatcttttttagaaatagagatgctttatagtagatcacttaaatactggatcttttgctagtgtgaaaacattgggaatttaatgacattattgagctgaaagaaattacatgagtccagctaccctcatttcttttttatgtgacatggagcacaaagaactgaaaatatgttttgagggagcatgacatccttgacctcatttgaaattacttccattttcaaaaaccatcatgttttgtagatacattttgagaaaaaccatcatgttttgaggatacatttgtgaaagtgcaggcatgccaatgactactcagttttaggactttctgtggaagaaaaaagggagaagaaatcaattccactacttttgaagttctgcaacagatgagattttgtttgtaaagttttgtagtatattaaccattggtttatcactctagattcaacatattaaaatgtattcaagctcacagatttttaatcagtaaggcctatctatattagttgtcttttatttcttctccttgtggacagttgttaatgaaaggagtaaggatttccctttttttgttttgtttgttttgttttttttaaccaaattcttagagatactatagaatccaaatgagaactgaattggacctcaagtcttctattcctactaatagagttctttgtgatggtaactgctgtgtcgtttgttttccacaagttgggatggattcatgtcgatacatccccatgcccttgacctcttctggcattctcctgtgctctgacaaactgagccagccttttagatctacatgaataaacaaactattttaccaagaaaaatctcagcttgcttactgcttaattaaaaacctacaatttacacacctccctgccttcaagactgtgagctttggatagccctgcttaaatgtttgtcaacaacaagagtcgtaatgtgtcagtacattgtagctcctttgaaatttaactctttctgtgttacatgaattgttttaaggagtccggcaaacatgtttcttcacttccatgagaatggtgccaagtgtcagactctaatgagccctcagctcaggttttaatttctattgaatgctaacattcttctgattttttggtatcttttataatcatatcggtttctgctgtattaatgacaattattcatgaaaataaaaaatgaaatattttgtatactacta

SEQ ID NO: 1265 - DNA, 9153 bp, Homo sapiens
actgtctccaagatggcggccgtgtcagtttggggcatctccgcggtccggcccggggccccgggatctcggctgtccttcctcccggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataagccggttgctgaaccaatccccatctgtagtttctgtcttggtacaaaagaacaaaaccgagaaaagaagccagaggaactcatctcctgtgccgactgtggcaacagtggccatccatcctgtttaaagttttcccctgaactaacggttcgagtgaaggccttacggtggcagtgcatcgagtgtaaaacatgcagctcctgtcgagatcaaggcaaaaatgcggataacatgctcttttgtgattcatgtgaccgaggttttcacatggagtgttgtgatccgccactcacccgtatgccaaaaggcatgtggatatgtcaaatatgtcgacctaggaaaaaaggacgaaaacttctacaaaagaaggcagcacagataaaacggcgctatactaatccaataggacgtccaaaaaacaggttaaagaaacaaaacacggtatcaaaaggtcccttcagcaaagttcgaactggccctggaaggggtaggaaacgaaaaatcactctttccagccaatcagcatcatcatcatcagaagaaggatatttagagcggatagatggcttggacttctgcagagatagcaatgtctccttgaagttcaacaagaaaaccaaagggctcattgatggccttaccaaattttttaccccttcccctgatgggcggaaagctcggggggaagtggtggactactctgagcaatatcgaatcagaaagaggggcaacaggaaatcaagcacttcagattggcccacagacaatcaggatggctgggatggcaaacaagaaaatgaggagcgactttttgggagccaggaaatcatgactgagaaagatatggaattatttcgtgatatccaagaacaagcactgcagaaagttggagtgactggtccccctgatccacaagtccgctgtccctctgtcattgagtttgggaagtatgaaattcacacctggtactcctccccatatcctcaagaatactcaaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggaaaagcactgccaacagaagtacaatgtttcctgtataatgattcttcctcaataccagcgtaagggctatggcaggtttctcatcgatttcagttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccaatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaagaaaccatttctccaccgaaggaggagagtccgaaagcgcaaacaccacaatagcagtgtagtcacagaaactatttctgagaccactgaagtgttagatgaaccttttgaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatgacactcctatcttaaagccagtatctcttttgcgaaaacgtgatgtgaagaattctcctcttgagccagatacatccacacctttgaaaaagaaaaagggatggcccaaaggcaagagccgcaaaccaatccactggaagaaaagacctggtcgaaaaccaggatttaagttgagtcgggaaatcatgccagtttctactcaagcatgcgtcattgagcccatcgtttccattcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagcatctgtgggaacagctcttcccagagcagctgctcctacggtgggctgtcgtcctccagcagcctcacccagagcagctgtgtggtcactcagcagatggccagcatgggcagcagctgcagcatgatgcagcagagcagcgtccagcctgctgccaactgcagcatcaagtcacctcagagctgcgtggtggagaggcctcccagtaaccagcagcagcagccgccaccaccgcctccacagcagccacagccgccgccgccacaaccacaaccagcaccacagcctccaccaccccagcagcagccgcaacagcagccgcagcctcagccccagcagcctccacccccaccccctccccagcagcagcccccgctgtcacagtgtagtatgaataacagtttcaccccagctcctatgatcatggagataccagaatctggaagcactgggaacataagtatctatgagaggattccaggggattttggtgccggcagctactctcaaccatcagccaccttcagcctagccaagctgcagcagctgaccaacaccattatggaccctcatgccatgccttatagccattctcctgctgtgacttcctatgcaaccagtgtttctctgtccaatacaggactggctcagctggctccatctcatcccttagctgggactcctcaagcacaagccaccatgacgccacccccaaacttggcatccactaccatgaacctcacatctcctctgcttcagtgcaacatgtctgccaccaacattggcattcctcacacgcagagattgcaagggcaaatgccagtgaaggggcacatttccatccgctccaagtctgcgccactgccctctgcggctgctcaccagcagcagctgtatggccgtagcccatcggcagttgccatgcaggctggccctcgcgcactggctgttcagcgtggcatgaacatgggggttaatctgatgcctactcccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaaaaatatatatatatatatatacacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttgga

SEQ ID NO: 1266 - DNA, 2426 bp, Homo sapiens
gcgggagctacggctgcgggagttaccctttattctgtgatattttgagctgttctgcgtctcgcaggcccttctgaatttcctggacctactctcggaaccctcaacgagctagcgatagatttagaggaaaggaagcaccgtcggaaagcaaagggatttctggaagcttgaacttaagagtgataacttagggtacctggcaaaagaaatttctgagcagcaaagcattcaagaagtggcctggctgcctcactgcttcaaacagcctacaattatatatgggagcaaaaaaatgacttaaagttggaatttatatttaaaaggcatgatttcaccttcacttgaactgcttcattcaggactctgcaaattccctgaagtagaaggaaaaatgaccacattcaaagaggcagtgacattcaaggatgtggctgtggtcttcactgaggaggagctggggctgctggaccctgcccagaggaagctgtaccgagatgtgatgctagagaacttcaggaacctgctctcagtagggaatcaaccattccaccaagatactttccacttcttagggaaggaaaagttttggaagatgaagacaacaagccaaagagaagggaattcaggaggcaagatccaaattgagatggagactgttccagaagcaggaccacatgaagagtggtcctgtcagcaaatatgggaacaaattgcaagtgacctaaccaggtctcaaaactccataaggaacagctctcagttcttcaaagaaggtgatgtcccctgccagattgaggcaagactatctataagtcacgtgcaacagaaaccttaccgttgtaatgaatgtaaacagtccttcagtgatgtttctgtctttgatcttcatcaacaatcacactcaggagagaaatctcatacatgtggtgagtgtggaaaaagcttctgttacagcccagcccttcatattcatcagagagtccatatgggagaaaaatgctataagtgtgatgtgtgtggtaaggaatttaatcagagctcacatctgcaaactcatcagagagtccatactggagagaaaccattcaaatgtgggcaatgtgggaaaggcttccatagtagatcagcacttaatgttcattgcaaattgcacacaggagagaaaccttataattgtgaggaatgtgggaaagccttcattcatgattcacagcttcaagaacatcagagaatccatactggggagaagccattcaaatgtgatatatgtggtaagagcttccgtgttagatcaagacttaataggcattccatggttcacacaggagaaaaaccattcagatgtgatacatgtggcaagaactttcgtcagagatcagcacttaatagtcattccatggtccacatagaagagaagccatacaaatgtgagcaatgtggaaaaggcttcatttgtaggcgagatttttgtaagcatcagatggtccacacaggagagaaaccatataattgtaaagaatgtgggaagaccttcagatggtcctcatgtcttttgaaccatcagcaagtccacagtggacaaaaatccttcaaatgtgaagaatgtgggaagggattttatacaaattcacgacgatcttcccatcagagatcccacaatggagaaaagccatataactgtgaggagtgtggtaaggactataaaaggaggttggatcttgagtttcaccagagggtccacacgggtgagagaccctataattgtaaggaatgtggcaagagctttggctgggcctcctgtcttttgaaacatcagagactccacagtggggaaaaacctttcaaatgtgaagagtgtggaaagagatttactcagagttcacaacttcattcccatcagacatgccatactggagaaaagctatacaaatgtgagcagtgtgagaaggggtacaacagtaaatttaatcttgacatgcaccagagggtccacgggggagagcgaccctataattgtaaggaatgtggaaagagctttggctgggcttcatgtcttttgaaacatcagagactccacagtggagaaaagccattgaaatctggagtgtgggaagagatctactcagaattcacagcttcatttacatcagtaagtctatgtgggagaaaagccatataaatgtgagaagtgtgggaagggctttggctgggcctcaactcatctgacccatcaattctccacagcagagaaaaaccattcaaatatgagaactgtgggaagagctttgtacatagatcatatcttttttttttttttttgagacagagtctcactctttcacccaggcctgactgcagtggcgctatctcagctcactgcaagctccgcctcccaggttcacgccattctcctgcctcagcct

SEQ ID NO: 1267 - DNA, 1648 bp, Homo sapiens
gttgctatttcatttaccacagtagtttgagtcatttccacatcttgcgagtccttccgaacgagtctcctttccttggggctcgcaaccacccaatgatcgattcaggagaaaagaagcctgggcggagagcagagcccgacctttctaaaagagctgcaggaagggacttcttggctactgatggcaaagctctacgaggcagtgaccttcaaggatgtggctgtgatcttcactgaggaggagctggggctgctggaccctgcccagaggaagctgtaccgagatgtgatgcttgagaacttcaggaacctgctctcagtgggaggcaagatccaaactgagatggagactgttccagaagcaggaacacatgaagaattttcctgcaagcaaatttgggaacaaattgcaagtgacttaaccaggtctcaagataccaccataagtaactctcagttatttgaacaagatgacaacccctcccagattaaagcaagactatctacagttcacacaagagaaaaacctttccagggtgaaaattgtaaacagttcttcagtgatgtttccttctttgatcttcctcagcagttatattcaggagagaagtctcatacctgtgatgagtgtggaaaaagcttctgttacatctcagcccttcatattcatcagagggtccacatgggagtgaaatgctataagtgtgatgtgtgtggtaaggaatttagtcagagctcacgtctgcaaactcatcaaagagtccacactggagagaaaccattcaaatgtgagcagtgtgggaaaggcttcagatgtagatcagcacttaaagttcattgcaaattacacatgagagagaaaccttataattgtgagaaatgtgggaaggctttcatgcacaatttccagcttcagaaacatcacagaattcatactggggagaagccattcaaatgtgaaatatgtggtaagagcttctgtcttaggtcaagtcttaataggcattgcatggtccacacagcagagaaactgtacaaatctgaaaagtatggaagaggtttcattgataggctagatttgcataagcatcagatgattcatatgggacagaaaccatataattgtaaagaatgtgggaagagcttcaaatggtcctcatatcttttggtccatcaacgagtccacactggagaaaagccatacaaatgtgaggagtgtgggaagggctacattagtaagtcaggtcttgacttccaccatagaacccacacgggagagagatcttataactgtgataactgcgggaagagctttagacatgcttctagtattttgaatcataagaaactccactgccaaagaaagccattgaaatgtgaagactgtggaaagaggcttgtatgccggtcatactgtaaagaccaacaaagagaccacagtggagaaaacccatccaaatgtgaggactgtgggaagcgctacaagaggcgcttgaatctggatataattttatcattatttttaaatgacatataagttatacatatttatggagtgtgaaatttgatacatgtatataatgtgtgctgattaaatcagtttaatttcacctgaaaaaaaaaaaaaaaaaaaaaaaaaaaaaaaa

SEQ ID NO: 1268 - DNA, 2414 bp, Homo sapiens
gcagagaggacacttccggtctcctagtctgaggttcctgctttaatgaccggggtagtttgagccatttctgcgtcttgcaggacattttgaacgaaccccctttgcttgaggctcgcaaccacccgatgatcgatgatcgtctcaggggaaaagaagccttggcgaagagcagaggtttagaggcacaattctgctttccctggaactgtgtcattcaggactctgcaaattccctaaagtaggaggaaaaatgaccatgtccaaggaggcagtgaccttcaaggatgtggcagtggtcttcactgaggaggagctggggctgctggaccttgcccagaggaagctgtatcgagatgtgatgctggagaacttcaggaacctgctgtcagtggggcatcaaccattccaccgagatactttccactttctaagggaggaaaagttttggatgatggatatagcaacccaaagggaagggaattcaggaggcaagatccaacctgagatgaagacttttccagaagcaggaccacatgaagggtggtcctgccagcagatctgggaagaaattgcaagtgatttaaccaggcctcaagactctaccataaagagctctcagttctttgaacagggtgatgcccactcccaggttgaggaaggactatctataatgcacacaggacagaaaccttccaattgtgggaagtgtaaacaatccttcagtgatatgtccatctttgatcttcctcagcaaatacgctcagcagagaagtctcattcctgtgatgagtgtggaaaaagcttctgttacatctcagcgcttcatattcatcagagagtccacctgggagagaaactctttaagtgtgacgtgtgtggtaaggaattcagtcagagtttacatctgcaaactcatcagagagtccatactggagagaaacctttcaaatgtgaacaatgtgggagaggcttcagatgtagatcagcacttacagttcattgcaaattacacatgggagagaaacattataattgtgaggcatgtgggagggccttcattcatgatttccagcttcagaaacatcagagaattcacacaggggagaagccattcaaatgtgagatatgtagtgtgagcttccgtcttaggtcaagtcttaataggcattgtgtggtccacacaggaaagaaaccaaacagcactggggaatatggaaaaggcttcattcgtaggctggatttgtgtaagcatcagacgatccacacaggagagaaaccatataattgtaaagaatgtgggaagagcttcagacggtcctcctatcttttgatccatcagcgagtccacactggagaaaagccatacaaatgtgacaagtgtgggaagagctacattactaagtcaggtcttgacttgcaccatagagcccacacaggagagagaccttataactgtgatgactgtgggaagagctttagacaggcctcaagtattttgaatcataagagactccattgccgaaaaaaaccattcaaatgtgaggattgtggaaagaagcttgtataccggtcataccgtaaagaccaacaaaaaaaccacagtggagaaaatccatccaaatgtgaagactgtgggaagcgctacaagaggcgcttgaatcttgatataattttatcattatttttaaatgacacgtaagtgttgtacatatttatggggtacagtgtgatatttaaatatatgtatatgatgtataatgatcaaatcagtgtaattagcacatttatcacctcaattatctcttttttgtgttgagaaaattaaaaattcattgttccagcagtttgaaaataaattgttgtcgatgatagtcacctttagtgctgcagaacagcagaacttcttcctcttatctacctgtacttttgcatccattagccaacctttggccatcccacctatcccttacccttccctgcctctagagccactgttctcactacttctaagaaatcagctttttaagcttccccatgtgattgaggacagtttgaagttagtgtttcagccatagctcagcataccccagtggtcgtgggactgtcagagcagagaatgctgcagggtttctaacagaagtttgacaattagttattattcaggagacaggtcttagtataagagtttgttcacacactttcaaaacactaatgatgaacatgtcaaaattgatgaccactagaatgtcagccacatgtgtctttgtatttttgctgcatccttacattgcttgagtctggaagattgaggctgcactgacctatggtagtgctactgcactccagccagggcaacagagtgagaccctgtctccaaaaaaaaaaattaaataaatacctttctttgtttc

SEQ ID NO: 1269 - DNA, 2483 bp, Homo sapiens
gaattctgggaagtggagtccaaacattcggtggagtcgcggacacttccgctcggggactgaggttgctgcagtttttccgcgatagtttggggcagttccgcgcgttgcaggcccttctgaatttcctggacctacgcattggatcctcaaagaactgctgaataccactagaaacatacctgtaaccagagacagctgattatagctttctgcagcaaggaagcccacgtaccaggggctgtcttggcacaattctgctttcccaggaactgcatcactcaggactctgcaagtttccagaagtaagagggaaaatgaccacgttcaaggaggcaatgaccttcaaggacgtggctgtggtcttcactgaggaagagctggggctgctggaccttgctcagaggaagctgtatcgagatgtgatgctggagaacttcaggaacctgctctcagtgggacatcaagcattccacagggatactttccacttcctaagggaagaaaagatttggatgatgaagacagcaatccaaagggaagggaattcaggagacaagatccaaactgagatggagactgtttcagaagcaggaacacatcaagagtggtccttccagcaaatctgggaaaaaattgcaagtgatttaaccaggtctcaagacttgatgataaatagctctcagttctccaaagaaggtgatttcccctgccagactgaggcaggactatctgtaattcacacaagacagaaatcttcccagggcaatggatataaaccatccttcagtgatgtctcccactttgattttcatcaacaattacactcaggagagaaatctcatacgtgtgatgagtgtggaaagaacttttgttacatctcagcccttcgtattcatcagagagtccacatgggagagaaatgctataagtgtgacgtgtgtggtaaggaattcagtcagagttcacatctgcaaactcatcagagagtccacactggagagaaaccgttcaaatgtgtggaatgtgggaaaggcttcagtcgtagatcagcacttaatgttcatcataaattacacacaggagagaaaccttataattgtgaggaatgcgggaaggccttcattcacgattcccagcttcaagaacatcagagaatccatacgggggagaagccattcaaatgtgatatatgtggtaagagcttctgtggtagatcaagacttaataggcattccatggttcacacggcagagaaaccattccgatgtgatacgtgtgataagagctttcgtcagagatcagcacttaatagtcatcgcatgatccacacaggagagaaaccatacaaatgtgaggagtgtggaaaaggctttatttgtaggcgagatctttatacgcatcatatggtccacacgggagaaaagccatataattgtaaagagtgtgggaagagcttcagatgggcctcgtgtcttttgaaacatcagcgagtccacagtggagaaaaaccattcaaatgtgaagaatgtgggaaaggattttacacaaattcacaatgctattcccaccagagatcccatagtggagaaaaaccatacaaatgtgtggagtgtgggaagggctacaaaaggaggttggatcttgactttcaccagcgcgtccatacaggagagaaactgtataattgtaaggaatgtgggaagagctttagtcgggccccatgtcttttgaaacatgagagactccacagtggagaaaaaccattccaatgtgaagagtgtgggaagagatttactcaaaattcacatcttcattcccatcagagagttcacactggagaaaagccatacaaatgtgagaagtgtggaaagggctacaatagtaagtttaatcttgatatgcaccagaaggtccacacaggagagagaccatacaattgtaaggaatgtgggaagagttttggctgggcctcgtgtcttttgaaacatcagagactgcacagtggagaaaaaccattcaaatgtgaagagtgtgggaaaagatttactcagaattcacagcttcattctcatcaaagagtgcacactggagaaaagccatacaaatgtgatgagtgtgggaagggcttcagctggtcctcaactcgtctgacccatcagagacgccacagcagagaaacacctctcaaatgtgagcagcatgggaagaacattgtacagaattcattctctaaagtgcaagaaaaagttcacagtgtagaaaagccatacaaatgtgaggactgtgggaagggctacaacaggcgcttgaatcttgatatgcatcagagggtccacatgggagagaaaacatggaagtgtagggagtgtgatatgtgctttagtcaggcctcaagccttcgacttcatcagaatgttcatgttggagaaaaaccttagtgatgtgatggtgcaataaagtcttcactcagtcttcatgaa

SEQ ID NO: 1270 - DNA, 2731 bp, Homo sapiens
actcagtggagtagcgggccacttccgctccgttactgtgaggttgctgcagttttgtccctggtagtttgggtcagttccgcgagacccttctgaatttcctggacctacgcattggatccttaacgaactggtgatcgaattaggggaaaagaaacctcgtcggagagcagaggcaggattctgctttcccttggactgtatcactcaggactctgaatattccctgaaataggaggaaaaatgaccacgttgaaggaggcagtgaccttcaaggacgtggctgtggtcttcactgaggaagagctgaggctgctggaccttgcccagaggaaactgtaccgagaagtgatgctggagaacttcaggaacctgctctcagtggggcatcaatcactccacagagatactttccacttcctaaaggaagaaaagttttggatgatggagacagcaacccaaagagaagggaatttaggaggcaagatccaaatggagatggagactgtttcagaatcaggaacacatgaaggcttgttcagtcatcaaacctgggaacaaatttcaagtgacttaaccaggtttcaagactccatggtaaacagctttcagttctccaaacaagatgatatgccctgccaggttgatgcaggactatctataattcacgtaagacagaaaccttctgagggtaggacgtgtaaaaagtcctttagtgatgtctccgtccttgatcttcatcaacaactacagtcaagagagaagtctcatacatgtgatgaatgtggaaagagtttctgttatagctcagctcttcgtattcatcagagagttcacatgggggagaaactctataattgtgatgtgtgtggtaaggaattcaatcagagctcacatctgcaaattcatcagagaatccacactggagagaaaccattcaaatgtgagcagtgtgggaaaggctttagtcgtagatcaggactttatgttcatcgtaaattacacacaggagtgaaacctcatatttgtgagaaatgtgggaaggccttcattcatgattcccagcttcaggaacatcaaagaatccatactggggagaagccattcaaatgtgatatatgttgtaagagcttccgtagtagagcaaatcttaataggcattccatggttcacatgcgagagaaaccattcagatgtgatacatgtggtaagagctttggtctgaaatcagcacttaatagtcatcgcatggtccacacaggagagaaacggtacaaatgtgaggaatgtggaaaacgcttcatttataggcaagatctttataagcatcagatagaccacacaggggagaagccatataattgtaaagaatgtggaaagagcttcagatgggcctcaggtctttcaagacatgtgcgagtccacagtggagagacaacattcaaatgtgaagaatgtgggaagggattttatacaaattcacaacgttattctcaccagagagcgcacagtggagaaaagccatatagatgtgaggagtgtgggaagggctacaaaaggaggttggatcttgactttcatcagagggtccacagaggagagaaaccctataattgtaaggaatgtgggaagagctttggctgggcctcgtgtcttttgaatcatcagagaatccacagtggagaaaaaccatttaaatgtgaagaatgtgggaaaagatttactcagaattcacaactttatacccatcgtagagtccacagtggagaaaaaccattcaaatgtgaagagtgtgggaaaagatttactcagaattcacaactttattctcatcgcagagtccacactggagtaaagccatacaaatgtgaagagtgtgggaagggcttcaacagtaagtttaatcttgacatgcaccagagggtccacaccggagagagaccttataattgtaaagaatgtgggaagagctttagccgggcctcaagtattttgaatcataagagactccatggtgatgaaaagccattcaaatgtgaagagtgtgggaagagatttactgagaattcacagcttcattcccatcagagggttcacactggggaaaagccatacaaatgtgagaagtgtggaaagagcttcagatgggcctcaactcatctaacccatcagagactccacagtagagaaaaactacttcaatgtgaggactgtgggaagagcattgtgcacagttcatgccttaaagaccaacaaagagaccaaagtggagagaaaacatctaaatgtgaggactgtgggaagcgctacaagaggcgcttgaatcttgatacgcttttgtcattatttttaaatgacacataactgttgtactcatttatggggtacagtgtgatagttaatgcaagtatacaatgtgtaatgatcaaatcagtgtaattaacatacctatcacctcaaacatttatcatttatttatgttgggaacccttaaaattcactgtcctagctatttgaaaataatacgttgttaattactgtcaccctgtagtggtgtaaaacactagaacttattcctcctacctgcctgtatttctgtattcattaaccaacctttggctaccaccctgcctcctcacctctaagaactactattctactctctacttctatgaagttaactttttgagcttccacatatgtgtgagaacatgtggtatgtatctttctg

SEQ ID NO: 1271 - DNA, 2786 bp, Homo sapiens
ggaacctttcaaacttccccgaaatgcacttgtggtcagcagctagcggtcttttgtttggggaaaaaaggagtagcggctaagagcggaaccctgacttctcaaaaagcactgcacagaggaggaggcagcagaaccccatgggctgttttgggagagggactgagtacagtgcaacactactcaaactgtggttcacaaagcagcaacattggcatcacccaggtagaaaggctcattcttgagcctaccgaaggccttctgatttagcatttttgcagataggacccagaaatctgcatttcaacaaaatcccaagttcagcttcttaggactctgcacttccccagaaggaagaattaaaaatgaatatgttcaaggaagcagtgaccttcaaggacgtggctgtggccttcacggaggaggaattggggctgctgggccctgcccagaggaagctgtaccgagatgtgatggtggagaactttaggaacctgctgtcagtggggcatccacccttcaaacaagatgtatcacctatagaaagaaatgagcagctttggataatgacgacagcaacccgaagacagggaaatttaggagagaaaaatcaaagtaagttaattactgttcaagacagagaatcagaagaagagctttcttgttggcaaatctggcaacaaattgcaaatgacttaaccaggtgtcaagactccatgatcaataattctcagtgtcacaaacaaggtgatttcccttaccaggtagggacagaactgtctattcaaatttctgaagatgagaactatatagtaaataaagcagatggtcccaataatactgggaatccagagtttcctatcttgagaacccaggattcttggaggaaaacattcctgactgagtcacagagattgaacagagatcagcaaatttccataaaaaatgaattatgtcaatgtaagaagggtgttgatcccatcggttggatttcacatcatgatggtcatagagtacacaaaagtgaaaaatcttatagacccaatgattatgaaaaagacaacatgaagattttgacatttgatcacaatagcatgattcacacaggacagaaatcgtaccagtgtaatgagtgtaaaaaacccttcagtgatctctccagctttgatcttcatcagcagttacaatcaggagagaagtctcttacatgtgttgagcgtggaaaaggcttctgttacagcccagttcttcctgttcatcagaaagtacatgtgggagaaaaacttaagtgtgatgagtgtggtaaggaattcagtcagggcgctcatctacagacccatcagaaagtccacgtgatagagaaaccatacaaatgtaagcaatgtgggaaaggtttcagtcgtagatcagcacttaatgttcattgcaaggtccacacggcagagaaaccttataattgtgaggagtgtgggagggccttcagtcaggcctctcatcttcaggaccatcagagactccacactggggagaagccattcaaatgtgatgcatgtggtaagagcttcagtcggaattcacatcttcaatcccatcaaagagttcatacaggagagaaaccatacaaatgtgaggagtgtggtaagggcttcatttgtagctcaaatctttacattcatcagagagtccacacaggagaaaaaccctataaatgtgaggaatgtggtaaaggctttagtcggccttcaagtcttcaggcccatcagggagttcacactggagagaagtcatacatatgtactgtatgtgggaaaggctttactctgagttcaaatcttcaagcccatcagagagtccacactggagagaagccatacaaatgcaatgagtgtgggaagagcttcaggaggaattcccattatcaagttcatctagtggtccacacaggagagaaaccctataaatgtgagatatgtgggaagggcttcagtcaaagttcgtatcttcaaatccatcagaaggcccacagtatagagaaaccttttaagtgtgaggagtgtgggcagggtttcaatcagagctcacgacttcagattcaccagctgatccatacgggtgagaaaccatacaaatgtgaagagtgtggcaagggatttagtcgtagagcagatcttaaaattcactgtaggatccacacaggagagaaaccatataattgtgaggagtgtgggaaggtcttcaggcaggcctcaaatcttttggcccatcagagagtccacagtggagaaaaaccattcaaatgtgaagaatgtgggaagagtttcggtcggagtgcacatcttcaagcccatcaaaaagtccacactggagataagccatacaaatgtgatgagtgtgggaagggcttcaagtggagcttgaaccttgacatgcatcagagggtgcacacaggagaaaaaccatataaatgtggggagtgtggtaagtacttcagtcaggcctcaagtcttcaacttcatcagagtgtccacacaggagagaaaccatacaaatgtgatgtgtgtggtaaagtcttcagtcggtcttcacaactacagtctcatcagcgagttcacactggggagaaaccttataaatgtgagatatgtggtaagagcttcagttggcgatcaaatcttacagttcatcacagaatccatgttggtgataaatcctataaaagtaataggggtggtaagaacatcagagaatccacacaggaaaaaaaatctataaaatgattctttgtg

SEQ ID NO: 1272 - DNA, 3688 bp, Homo sapiens
gtagtccaggaggtctcggtaggcagagccacttccgccccaggtacgctaggccgcggccttcgttcctcccagaaaggagatggtgacattcaaggatgttgctgtggtcttcactgaggaggagctggggctgctggactctgtccagaggaagctgtaccgagatgtgatgctggagaacttcaggaacctgctcttagtagcacatcagcccttcaagccagacctaatatcccagctggagagagaagaaaagcttttgatggtggagacagaaaccccaagagatggatgttcaggaaggaagaatcaacaaaagatggagagtattcaggaagtaacagtaagctacttttcccccaaagagctttcctcccgtcagacctggcaacaaagtgcaggtgggttaatcaggtgtcaagatttcctgaaagtttttcaagggaagaattctcagttgcaagaacaaggtaattccctcggccaggtttgggcaggaataccagttcagatttctgaagataagaactatatattcactcatatagggaatggctccaattatataaaaagtcaagggtatccatcttggagggcacatcattcttggaggaaaatgtatctgaaagagtcacataattatcagtgtagatgtcagcaaatttccatgaaaaatcatttctgtaagtgtgacagtgtcagttggctctcacatcacaatgataaactggaagtacacagaaaagaaaactacagctgccatgactgtggagaagatatcatgaaggtatcattacttaatcaggagtcaattcaaacagaggagaagccctatccatgtactgggtatagaaaagccttcagtaatgactccagctctgaggttcatcagcagttccacttggaagggaagccctatacatacagttcatgtggaaagggctgtaattatagttcacttcttcatattcatcaaaatattgagagagaagatgatattgagaattcacatctgaaatcctatcagagagtgcatacagaggagaaaccatgcaaatgtggtgaatatggtgagaacttcaatcactgttcccctcttaacacttatgaacttatccacacaggtgagatgtcctataggcacaacatttatgagaaagccttcagtcatagcttagaccttaatagtatttttagggtccatactagggatgaaccccatgaatatgaggaaaatgagaatgtctttaatcagagttcatgtcttcaagtccatcaaaaaatccacactgaagagaaactatacacagatatagagtatggaaagagtttcatttgtagttcaaatcttgacattcagcatagggttcatatggaagagaattcatataattctgaggagtgtggtaatggcttcagtctggcctcacattttcaggaccttcagatagtccacactaaggaacaaccatataaacgctatgtgtgtagtaacagcttcagccataatttatatcttcaaggtcatccaaaaattcacattggagagaaaccacgtaaggagcatgggaatggcttcaactggagctcaaaacttaaagatcatcagagagtccacactggacagaagccatacaaatgcaatatatgcggcaaaggtttcaatcatagatcagttctgaatgttcatcagagagtccacacaggagagaaaccttataaatgcgaggaatgtgataagggattcagtcggagttcatatcttcaagcccatcagagagtccacactggagaaaaaccttataaatgtgaggaatgtgggaaggggttcagtcgaaattcataccttcaaggccatcagagagttcacactggagaaaaaccatacaagtgtgaggagtgtgggaagggcttcagtcggagttcacaccttcaaggccatcagagagtccacactggagaaaaaccattcaaatgtgaggaatgtgggaaggggttcagttggagctttaatcttcaaattcatcagagggttcacacaggagaaaaaccctataaatgtgaagaatgtggtaaaggcttcagtaaggcctcaacacttttggcccatcagagggtccacacgggagagaagccataccaatgtgatgagtgtggtaagagtttcagtcagagatcataccttcagagtcatcagagtgtccattctggagaaagaccatatatatgtgaggtatgtggaaagggcttcagtcagagagcatatcttcaaggtcatcagagagtccacactagagtgaaaccgtataaatgtgagatgtgtgggaagggctttagtcagagttcgcgccttgaagcacatcggagggttcacacaggagggaaaccatacaaatgtgaggtgtgtacaaagggtttcagtgagagttcacgccttcaagcacaccaaagggttcatgtggaagggagaccctataaatgtgaacagtgtggtaagggtttcagtgggtattcaagtcttcaagcccatcacagagtccacacaggagagaaaccatacaaatgtgaggtatgtggaaagggcttcagtcagagatcaaatcttcaggctcaccagagagtccacacaggagagaaaccatacaaatgtgatgcatgtggtaagggtttccgttggagctcaggtcttctcattcatcaaagagtccatagtagtgataaattctataaaagcgaagactatggtaaggactacccttcatcagagaatctacacagaaatgaagattctgttttgttttgaagtcctcaaatgggagctgaaattttccagtcactagagttctttcagtagaaaaagaatttttaaaaattaaaatgtaatgttgctgcccaacttcaacattcataatggccaggagaccacacaacagagacatttaatgagaggggtttcacgagggattttgttagaactttaacatcagtcattgcacaggagctaaggcttataaaatatgagtatggtcaggaatttaataaaagtacagtgatgagcatgcctaaatccatgttctctagaatgtaagcttggtgaaagaagggactttgttcattgctagtctacaaaactaggacatttcataacgcaatgtaggtgctcagtactttttgctaaataactaaaagtatgtaaaggtaaaaggtttgaaatttttaagcgcattttttaaaacttaaaatgtatttggaggagaaatcctgcaagtaatcttaataaaatcatttcaagtaaatatttgaaatgtagaacaataagcattatgatgatctgaaataacattaatttgattgtaaccctattggggttagttcccaccctttgttccatcttgagcagagatgtgctgcatttcttaacgtttggtctctatacattataccatctgctgaagtttagctttgtgtgtgtgtatatgtacccatgtgtgcacttgaaatatcagtacaaactgataaacaatgtttctggttaatgttgcaaaaatggaacactgtattttacataattgattttctactcctgccctgtgaattaaggcagagttttactgtaatatttgcaagtatccaaaatggttactgatgacaaatactttttaataaatgtcaaaatcacaataaa

SEQ ID NO: 1273 - DNA, 1696 bp, Homo sapiens
gcgtcaccttgattgcttcttaggcagtggtgaggcgtcttaggagacgtgcatctccatgcggttgtactgtcaggccatgggaattaggatcggctctataggaccagtgtgaagggacaacgtgcggcggagggtcgaagcccacggatttccatgagctcggcctggcttccttcttggaattgttcgtttctcggagataattgtataaaagaaggagaaataaccccacatctcttgacactagagctccaggtcccctgaccatgggaagcagtcacgctctggacagtaaaggtggagacaggaacttgtcagagcttggagagtttccggaatgaaaaaggcctggatcttctgcgtctccagcttaggaaagccagagaataaatacagttgctgctgctcgcagaaaacctagcagaagagaccatggagactttgacctcaaggcatgagaaaagagctcttcattctcaagcctcagccatttcccaagatagggaggagaagatcatgtctcaggagccattgagcttcaaggacgtggctgtggtcttcactgaggaggagctagagctgctggactctacccagaggcagctgtaccaagatgtgatgcaggagaatttcaggaacctactctcagtgggtgagaggaatcctctgggagacaagaatggaaaggatacggagtatattcaagatgaagaattaaggttcttttcacacaaagagctctcctcatgcaaaatctgggaagaggtggcaggtgaattacctgggagccaagactgtagagtaaatctgcaaggaaaagacttccagttctcagaagatgctgctccccatcaagggtgggaaggagcatctacgccgtgttttccaattgagaattccctggacagtctacaaggggatgggcttatcggtctagaaaatcaacagtttccagcctggagagctataagaccaatccccattcaaggatcttgggcaaaagcgtttgtgaaccagttaggggatgttcaagaaagatgtaaaaatctcgacacagaagacacagtatataaatgtaactgggatgatgacagcttttgctggatatcttgtcatgttgatcacagattccctgaaatagacaagccgtgtggttgcaataaatgcagaaaagactgcattaaaaactctgtacttcatcgcattaaccctggagagaatggcttgaaaagtaacgaatacagaaatggcttcagggacgatgcagaccttcccccgcatccaagagtacctttgaaagagaaactctgtcaatatgatgagtttagtgagggcttgaggcacagtgcccatcttaacagacatcaaagagttcccacaggagagaaatctgttaagagtcttgagcgtggtcggggcgtcagacagaacacgcacatacgtaaccaccccagagcccctgtgggagacatgccctatagatgtgatgtctgtggaaaggggttcaggtataaatcggttcttcttattcatcaaggggtgcacacaggaaggagaccctataaatgtgaggagtgtgggaaggcatttggtcgaagttcaaacctgcttgtccatcagagggtccacactggagagaaaccatataaatgcagcgagtgtgggaagggcttcagttacagctcagtgcttc

SEQ ID NO: 1274 - DNA, 2293 bp, Homo sapiens
gagactgacaatgatttgacaaaggaaatgtatgaaggaaaagagaatgtatcatttgaacttcaaagagacttttcccaggaaacagacttttcagaagcctctcttctagagaaacaacaggaagtccactcagcaggaaatataaagaaggagaagagcaacaccattgatggaacagtgaaagatgagacaagccccgtggaggagtgtttttttagtcaaagttcaaactcatatcagtgtcataccatcactggagagcagccctctgggtgtacaggattggggaaatccatcagctttgatacaaaactcgtgaagcatgaaataattaattctgaggaaagacctttcaaatgtgaagaattagtagagccctttaggtgtgactctcaacttattcaacatcaagagaacaacactgaggaaaagccttatcagtgttcggagtgtggcaaagctttcagcattaatgagaaattaatttggcatcagagacttcacagtggggagaaacccttcaaatgtgtggagtgtgggaaaagcttcagctacagttcccattatatcacacatcagacaatccacagtggggagaagccctatcagtgtaagatgtgtgggaaggccttcagtgttaatggaagcctaagtaggcatcagagaatccatacgggagagaagccctatcagtgcaaggaatgtggaaatggcttcagctgtagttctgcatatattacacatcagagagtccacactggagagaaaccttacgagtgtaatgactgtgggaaagcgttcaatgttaatgcaaaattaattcaacatcagagaatccatactggagagaaaccttatgaatgtaatgaatgtggaaaaggcttcaggtgcagctcccagcttaggcagcatcagagcatccacacaggagaaaagccctatcagtgtaaagagtgtggaaaaggcttcaataataatacaaaactcattcagcatcagagaatccacacaggtgagaaaccctatgaatgcactgaatgtggaaaagccttcagtgtcaaagggaagttaatccaacaccagagaattcacacaggcgagaaaccctatgagtgtaatgaatgcgggaaagccttcagatgtaactcccaatttcggcagcatctgagaattcacactggggagaagccctatgagtgtaatgagtgtggaaaggccttcagcgttaatgggaaactaatgcggcatcagagaattcacactggggagaaaccttttgaatgtaatgagtgtgggagatgctttacttctaaaagaaacctacttgatcatcaccgaatccatactggagaaaagccctatcaatgtaaggaatgtgggaaagccttcagtatcaatgccaaactaactaggcatcagaggatacatactggggagaaacctttcaaatgtatggaatgtgagaaagcattcagctgtagttctaactatattgtgcaccagagaatccatacaggagagaaaccctttcagtgtaaggagtgtggaaaagccttccatgttaatgcccatttaattcggcatcagagaagccacactggggagaaacccttcagatgtgtggaatgtggcaaaggcttcagctttagttctgactacattatacatcagacagtccacacttggaagaaaccctatatgtgtagtgtgtgtgggaaagcattcaggtttagcttccagctcagtcagcatcagagtgtccatagtgaaggaaaatcctaataatgagaaagatatagaaaactcttaaggttaatgccaaaatggatcaagtatcatcagattcatccattgaaaaacctccaagagggcatgaatatggcagagtcttcatatggaaacagtttttattctattcagtttaaatcaggaaaggatgaccagttaaagagaaacatccaaaaatagctttgttttgtaccaacaggaattagaaaatataatgaaaagatttcgttcccagcagcatcaagaaaagtagattttctagaaataaacagttatggaggacttgtatggagaaatttaagtcttcactgagggccactttacaaaggaaatttgaataaatggagagagagagaagccttgttgttggataggaaaacccgtactaaagatactctacctacattaatttatttgtttaatttttgacaacaagcatgtattacttttgaaaagatgaaaaataaagatttatttaaaaaaggaaaaaaaaaaaaaaaaa

SEQ ID NO: 1275 - DNA, 4132 bp, Homo sapiens
agacgctctgtggagacgcgagcacttccggtgtgtgagcctgcggttgctacataaccgcgtagtttgagccatttctgcgtctggcgggtccttctgaacttgtcaccttcgcttggggtcgcaacgacccgatgatcgatgatccaagcaagggaaaagaagccttggcggagagcggaggcacaattccaccttcctttgtgctccattactcaagacactgaagactccaaaaagtaggaggaaaaatgaccacattcaaggaggcagtgaccttcaaggatgtggctgtgttcttcactgaggaggaactggggctactggaccctgcccagaggaagctgtaccaagacgtgatgcttgagaacttcacgaacctgctgtcagtggggcatcaaccattccaccctttccacttcctaagggaagaaaagttttggatgatggagacagcaacccaaagagaaggaaattcaggcggcaagactattgcggaagcaggaccacatgaagactgcccttgccagcaaatctgggaacaaactgcaagtgacttaacccagtctcaagactccatcataaataattctcacttctttgaacaaggtgatgtcccctcccaggttgaggcaggactatctataattcatacaggacagaaaccttcacagaatgggaagtgtaaacagtccttcagtgatgttgccatctttgatcctcctcagcagttccactcaggagagaagtctcatacatgcaatgagtgtggaaaaagcttctgttacatctcagctcttcgtattcaccagagagttcacttgagagagaaactctctaagtgtgacatgcgtggtaaggaattcagtcagagctcatgtctgcaaactcgtgagagagtccacactggagagaaaccattcaaatgtgagcaatgtgggaaaggcttcagatgtagagcgatacttcaagttcactgcaaattacacacaggagagaaaccttatatttgtgagaaatgtgggagggccttcattcacgatttccagcttcagaaacatcagataattcatactggggagaagccgttcaaatgtgaaatatgtggtaagagcttctgccttaggtcaagtcttaataggcattgcatggtccacacagcagagaaactgtacaaatctgaggagtgtggaaaaggcttcactgatagcctagatttgcataagcatcagataattcacacaggacagaaaccgtacaattgtaaagaatgtgggaagagcttcagatggtcctcatatcttttgatccatcagcgaatccacagtggagaaaaaccatacagatgtgaggagtgtgggaagggctacattagtaagtcaggtcttaacttgcaccagagggtccatactggagagagaccttataattgtaaggaatgtgggaagagctttagccgggcttcaagtattttgaatcataagaaactccactgccggaaaaaacccttcaaatgtgaggattgtggaaagaggcttgtacaccggtctttctgtaaagaccaacaaggagaccacaatggagaaaactcatccaaatgtgaggactgtgggaagcgctacaagaggcgcttgaatctggatataattttatcattatttttaaatgatatgtaagttgtacatatatatgggatatggtatgaaattttaatatgtgtatataatacgtaatgatcaaattgatgtaattagtgtattaccttaaacaattaacatttctttgttttgggaaaattcaaaatccattgttctagcgatttgaaaagaaacaataaattattgttgattatagtcacctttggtgctttagaacactagaatgtatttctcctatctagcagtacttatgtatcttgttacccaatctttggctatctcacctaacccctacacttccctgcttctagaaccactgttttactcactaattctatgaaatcaacttttttagcttccatatgtgtgtgaggacagttagtatttatcttaccttgcttagcttatattgtttaacatgtcctccaaagctcatctatgttgccacaaatgacacaattttgttttctttttatgcccaaagagtattctattgtgtatatatgccaccttttcttcatttatctattgatggacacataggtgggttccatatcttaactattgtgaagaatagtgctccaatgaacatggtagtgtagatatctgatccacatactgatttcctttgctttggatatactcaatagtgggattgctagatcactcgaatcttatgcctcagaggcttgacacaagagcaaaactatggaagtgtggctagggtgatatggcttcataccacctcaggcctcaagtcctcaactgcaccagagtgtccacgttggacagaatccttagtaatgaggtgtgtgataaagtctctgctcagttgtctataatctcatttgagagttcacaaaggggcaaaacattaaaaagaggcatatggtaagcacttcagtgtgtgtttatatcataatttatcacagtccatactgataatatatttcatccaggcttgtaggacagaaaacatttgtttaagttaaattcagtgtttcaccatagctcagcattctcccatcatcctaggaccatcgtagtagagaactcttgtaaattgtgcagtagggttgcaaacagaacttacgcttgtcattcaggagacaggccttagaataagagtttgttcacacatttacaaaaccctaatgatgaacatgtcaaaagtggtgaccactagaatgtcaactacaggtaccttgttttctgcatcctcaggaccttaacactgattagcacttacatgtttagtatgtgttaaatgactcaaaaggagaaaatatgatattttaaaattgcatctaggagagaaaatctacaaaaaataattcagggacacgagttaaaatgcagaatacactcagttctgcaatccaaagcattattttgggtaatcttaccctgttgcacttggctgctggcttcccctcatcctctgttctgaagtttactactagtggctttgtctaatgctccattggttgcatacaatataaattcaacaatcatttgtaactcttctcacactacaggctgaaaatggtttgttaacttgtcaataacagtccactgcatatatcacaattacatttttttcaacagtgttaaggcaaaatttatagtaatactttttacgtggcagatgtagttacgttggaaaaaacttccttagttctgaattctcatgattgcttctgtatttccatgcaggccttgatataatggccttctaattgtggtagcatttattttatcaaacaactcaggtagaagctatgccaatttgacaatttttggaaacctaacctaatattctcttcctatctctatgaaataccaagagaaacctatcggagtttggtaatttcatgaaatgtatccatgattggggtaggagtgacatttacatgctcttctttattgttggcagtaaaaataagtcttttgtaagcagtgtatatcagaatgtataaggtacaagtgttttacctggaaatgatgggataggaaattatgattatgatgttaaaactgtgaaaagtagaaaaccacatggatgatatcaccccattttaaaatggaataagtattcaacaagaatttgtgtgaaatgcatttattcctataacataagaccaataaaatgagggaaccagacatacagtaaaaggagaaaaacataatgtgagctttgtgaaatctgactgtaaccttcataacataatcaaatatctttgtgtgtttctgggactttttaatgtgtatatacgtaatttgtgaacaactattctttcctctggcaatgaatatttgctggtatttttccattttataattttatgcattttttctcagtgaacatcagttttatcaaagcagtaaatttagtgcaataaatttgcaaacttattaacgttaatcacttacctaccaggactcagaatctcagaataaaattgctctatatt

SEQ ID NO: 1276 - DNA, 2125 bp, Homo sapiens
cgacgacaaggatggggcccatctcttcggagcctaaggatccagcccaggtccagccctgcgcagccgcccaccaagctgccagaagacgagccggacgcccaaggctacgagaggacgattgcagaattgtacaggctagtggttggggaatattttttcgtggaagggaccgtcttccttagctgtggccctctcatcaggtctgggaagaggtaattggaaaatagaactcatggagaagtgttaccacaggccatggacaaggccagaatttccctgacatctgtccgccagcaccgcccttcaggtacaattccacaagagaccccccaaacttgatgaagtcacccgcttacaagggctcactctccacctgcgcaaggactgcaattcccaggggcctccagggcacccggccgctccagtccagtcgtgcaggcggcgcgctctttctcgctccgctcaagtccaggaaccggttcccgggctcccagcctctcggcagcgcccacgcgcctgggccaaagtccgcgaacggaagccggcggcgaggaggattctgggagttggaggccgaggctgcgacctgcgcaggcgcaaacctgcccctggggtgagggctgtaagtggcgcgattcgcggcagcgccccgatggaacctcctggtcctgtgagggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtcccaggccctgcacatggacctgcacaggaagagccatgggagaagaaggaatctctgggagcagcccaggaagcactgagcatccagctccagcctaaggagacccagcctttcccaaagagtgaacaggtatatttacattttctgtcagttgttacagaagatggcccagagcccaaggacaaaggatcattgccacaaccacccattactgaagtggaatcacaggtgttctcagaaaaacttgctactgacacctctacatttgaagctacctctgagggtaccttagaactgcagcagagaaatcccaaagcggagagactgaggtggtcccctgcccaggaggaaagtttcaggcagatggttgtcatccataaggaaattcccacagggaagaaagaccatgaatgtagtgaatgtggtaaaaccttcatttataactcacatcttgttgtccaccagagagttcattctggagagaaaccctataagtgtagtgactgtgggaaaactttcaaacagagctcaaacctcggtcagcatcagagaattcatacaggagagaaacccttcgaatgtaatgaatgtgggaaggccttcagatggggtgctcatcttgttcagcatcagaggattcactcaggagagaagccctatgagtgtaatgagtgtgggaaggcctttagtcaaagctcatatctaagtcagcatcggagaattcacagtggagagaaaccttttatatgtaaagaatgtgggaaagcttatggatggtgctcagagctcattagacatcggagagttcatgccagaaaagagccttcccattgaattgaaggggagaacgtctccagacagaattctacatcggtctaatctactttaggactggatcccataaaagttataagttccttaaaaaaaaaaaaaaaaaaaaaaaaaaaaaaaaaaaaaaaaaaaaaaaaa

SEQ ID NO: 1277 - DNA, 2782 bp, Homo sapiens
ctatcccctctgggaggtgagtcagcgcggaacctctgcatctacggcgagctttcctggcctgggcgttggactcgcagttctgccttcccaggaccctgcccttccccagaaggagcaggagaaaatgaccaagtttcaggagatggtgacattcaaggatgtggctgtggtcttcaccagggaggagctggggttgctggaccttgcccagagaaagctgtaccaagatgtgatgctggagaacttcaggaacctgctgtcagtgggctatcaacccttcaaactagatgtgatattacagttgggaaaagaagacaagcttcggatgatggagacagaaatccaaggagatgggtgttcaggacacaagaatcaaaatgagatagatacccttcaagaagtaagattaagattcctttcatatgaagaccttatatgctggcaaatatgggaacaatttacaagtaaattaaccagtaatcaagacctaataataaatcttcaaggcaagaggtccaagttgctaaaacaaggtgattccccctgtcaggtgtggacaggagaatctagtcaggtctctgaagatgagaactatgtaataaagctacaaggggagagttcaaatagcataaaaaatcaagagcttccattgaggaccacctgggatttctggaggaaaatgtatctgagagaaccacagaattatcagagtaggtgtcagcaaattgatgtaaaaaataagctctgtaaatgtgatcattgtgttaggcaaagaattgctcatcaacatgatgatcatggagtacacaaaagagagaaagcttttagccacaataattgtggaaaagactgtgtgaaggaatcatcccagcatagcataatccaatcaggagagcaaacctctgatgaaaatggaaaaggcttaagtgttggctctaatcttgaacttcaccagcaactacacttaagagacaagcctcatgtaaatgttgagtacgggaagggcataggttacagctcagggcttcccaggcatcagtgtttccatataggagagaaatgctataggaatggtgacagtggtgagggcttcagtcagggctcacatctgcaacctcatcagagagtcagcacaggagagaacctctacagatgtcaggtatatgcccggagctccaaccagaactcctgtcttccctctcatgagcttactcacccaggagagaagttgtgtacatgtggcaggtgtgggaagggcttccatcatagcttagattttgacattcactgtgtagacagtgctggagagagagcctgtaaatgtgatgtatatgataaaggcttcagtcagacatcacaacttcaagcccatcagagaggtcactctagagacaagacatacaaatgggaagtaagtgacaggatatttaataggaattctggtcttcaccagagagttcacactggagagaaaccatataaatgtgaggtatgtgataagggcttcagtaaggcctcaaatcttcaagcccatcagagaatccacactggagagaaaccctacaaatgtgatgtgtgtgataagaacttcagccgtaattcccaccttcaggcccatcagagagtccatacaggagagaaaccctacaaatgtgacacatgtgggaaggacttcagtcagatctctcatcttcaggcccatcagagagttcacacaggagagaagccatacaaatgtgagacatgtgggaagggctttagtcagagttcgcatctccaagaccatcagcaagtccatactggagagaatccctacaaatgtgatgtgtgtgggaaaggcttcagttggagttcacatcttcaagcccatcagagagtccacacaggagagaaaccatacaaatgtgaagaatgtaggaaaggcttcatctggaactcatatcttcatgttcatcagaggatccacacgggagagaaaccctataaatgtggcatgtgtggtaagagcttcagtcagacttcacatcttcaagcccatcagagagtccatactggagagaaaccatacaaatgttttgtgtgtggtaagggctttagtaagagttcgttgtcttcagattcatcagagagtccatgatggtgatgaatctattaatcatgatgagtgtgataggggtgctcttcaagacttagacttcccattttcctcagaaaatccacacagcacagaatatttataaaatgtcatgttttaagaattcatgagctgagtttttatagttatctgaattccattgaagaaaacctatttttgtatgaatatgaccagtttcaagcagagcccaaaatgtcacagttgtcaagagaacacacaacagagaaaccctataaagaatgatacaatatgtttcaatcagaaccttcacatccaataagcaatatgcaggagtgaagccttcaaaatgataagtaaggtcagaatttagcaaaagtataatgagggacatgacaaaatctgtgtccactagaatctaagctccatgcaggaacattgtttactgctgcatgatcgtgaccttgaacaagtacctaagaaatagtggcttccctggaattgtttaacttgataggaaaaatctatcatatataggacatatatttgaatattttagtgagctcagccccaattcgtcattataattgtactgggaaaaggattcttgcaagaagccttaaaatgaattcaaggaaatgacatttaattaaaacacataaaacc

SEQ ID NO: 1278 - DNA, 2079 bp, Homo sapiens
ggagggactgaccttcaaggatgtggctgtggtcttcactgaggaggagctggggctgctggaccctgtccagaggaatctgtaccaagatgtgatgctggagaacttcaggaacctgctgtcagtggggcatcaccccttcaaacatgatgtattccttttagaaaaggaaaaaaagcttgatataatgaagacagcaactcaaagaaaagggaaatcagcagacaagatccaaagtgaggtggagactgttccagaagcaggacgacatgaagagctttactgggggcaaatctggaaacagattgcaagtgatttaatcaagtatgaagactctatgataagtatttctcggttccccagacaaggtgatttgtcctgccaggttagggcaggactatatacaactcacacaggacagaaattttaccaatgtgatgagtacaaaaaatccttcactgatgtcttcaactttgatcttcatcaacagttacactcaggagagaagtctcatacatgtgatgagtgtggaaaaagcttctgttacatctcagcccttcatattcatcaaagagtccacatgggagagaaatgctataagtgtgacgtgtgtggtaaggaatttagtcagagctcacatcttcaaactcatcagagagtccacactgtagagaaaccattcaaatgtgtggaatgtgggaaaggcttcagtcgtagatcaacacttactgtacattgcaaattacactcaggagagaaaccttacaattgtgaggaatgtggaagggccttcatacatgcttcccatcttcaggaacatcagagaattcatactggggagaaaccattcaaatgtgatacatgtggtaagaacttccgtcgtagatcagcacttaataatcattgcatggtccacacaggagagaaaccatacaaatgtgaggactgtggtaagtgtttcacttgtagctcaaaccttcgtatccatcaaagggtccacacaggagagaaaccttacaagtgtgaagaatgtggtaagtgctttattcagccttcacaatttcaggcccatcggagaatccacactggagagaaaccatacgtatgtaaagtgtgtggtaagggtttcatttacagttcaagttttcaggcccatcagggagtccacactggagagaagccatacaaatgcaatgagtgtgggaagagcttcagaatgaaaattcattatcaagtgcatctggtagtccacacaggggaaaaaccctataaatgtgaagtatgtggtaaagccttccgtcagagttcatatcttaaaatccatctgaaagcacatagtgtacagaaaccttttaagtgtgaagagtgtgggcagggcttcaatcagagctcacgacttcagattcaccagctgatccataccggtgagaaaccatacaaatgtgaagagtgcggaaagggatttaatcgtagagcagatcttaaaattcattgtaggatccacacaggggagaaaccatataattgtgaggagtgtgggaaggtcttcagtcaggcctcgcatcttctaacccatcagagagttcacagtggggaaaaaccatttaaatgtgaagagtgtgggaagagcttcagtcggagtgcacaccttcaagcccatcaaaaagtccacactggagaaaagccatacaaatgtggggagtgtggaaagggcttcaagtggagcttgaaccttgacatgcatcagagggtgcacacaggagaaaaaccctatacatgtggggcgtgtgggaagcacttcagtcaggcctcaagtctccaacttcatcagagtgtccacacaggagagaaaccatacaaatgtgatgtatgtggtaaagtcttcagtcggtcttcacaattacagtatcataggcgagttcacactggggaaaaaccttacaaatgtgagatatgtggtaagaggttcagctggcgatcaaatcttgtaagtcatcacaaaattcatgctgctggtacattttatgaaaatgatgagaatagtaagaacatcagagagttgtcagagggaggaagttc

SEQ ID NO: 1279 - DNA, 3190 bp, Homo sapiens
ggaggcacttccgctccaggaaggcgaggtcggatctgagatatctcccagggaggttcacttccccggaactctgccttttcccagaaggaggaggggaaaaatgaccaagttccaggaggcagtgacattcaaggatgtggctgtggccttcactgaggaggagctggggctgctggactctgcccagaggaagctgtaccgagatgtgatgctggagaactttaggaacctggtttcagtgggacatcagtccttcaaaccagatatgatatcccagttggagagggaagaaaagctttggatgaaggagcttcaaacccaaagaggtaagcattcaggagacaggaatcaaaatgagatggcaactcttcacaaagcaggattaaggtgcttttcactgggagagctttcatgctggcaaatcaagagacacattgcgagcaaattagccagaagtcaagactccatgataaatattgaaggaaagagctctcagttccccaagcaccatgattccccctgtcaagtgggagcaggagaatctattcaagcttctgtggatgacaactgtctagtgaatcacataggggatcattccagtatcattgaaaatcaagaatttccaactgggaaagttccgaattcttggagtaaaatatatctgaatgagacacagaattatcagagaagttgtaagcagactcagatgaaaaacaaactatgtatatttgctccatatgttgacattttcagttgtatttcacaccaccatgatgataatatagtgcacaaaagagataaagttcatagcaatagtgattgtggtaaagataccctaaaggtatcacctcttacccagcgtagtattcacacaggacagaaaacctaccagggtaatgaatgtgaagaagccttcaatgatagctccagtcttgaacttcataaacaggtacacttgggaaagaagtctccagcgtgtagtacacatgagaaggacaccagttatagctcaggtattcctgttcaacaaagtgttcgtactgggaaaaaacgctattggtgtcatgaatgtggtaaaggtttcagtcagagctcaaatctgcaaactcatcagagagtccacacaggggagaaaccctatacatgccacgagtgtggtaagagctttaatcagagctcacatctttatgctcatttgcctattcacacaggagagaagccctatagatgtgacagttgtgggaagggcttcagtcgtagcacagatcttaacattcattgcagagttcacactggagagaaaccttataaatgtgaggtgtgtgggaagggcttcactcagagatcacatcttcaggcccatgaaagaattcacactggagagaaaccatataaatgtggggattgtggtaaacgctttagttgtagctcaaatcttcatacccatcagagagtccacactgaagaaaaaccatacaaatgtgatgagtgtggtaagtgctttagtttgagctttaatcttcatagtcatcaacgagtccacacaggagaaaaaccatataaatgtgaagagtgtggtaagggttttagttcagcctcaagtttccagagccatcagagggtccatacaggagagaaaccatttcgatgcaacgtgtgtgggaaaggcttcagtcagagttcatactttcaagcacatcagagagtccacactggagaaaaaccatacaaatgtgaagtgtgtgggaagcgcttcaattggagcttgaatcttcacaatcatcagagagtccacaccggagagaaaccctacaaatgtgaagagtgtggtaagggtttcagtcaggcttcaaatcttcaagcccatcagagcgtccacactggggaaaaaccattcaagtgtgatgcatgtcagaagcgattcagtcaggcctcacaccttcaagcccatcagagagtccacaccggagagaaaccatataaatgtgacacttgtggtaaggccttcagccagaggtcaaatcttcaagtccatcagataattcacactggagagaaaccatttaaatgtgaggaatgtgggaaagaattcagttggagtgctggtctcagtgcccatcagagggtccacacaggagagaaaccctatacgtgtcagcagtgtgggaagggcttcagtcaggcctcacattttcacacacaccagagagtccacactggagagaggccttacatatgtgatgtctgttgtaagggcttcagtcagaggtcacatctcatctaccatcagagagtccacactggagggaatctgtagaaatgagaggtgtggttcagccttcagttagagctcacatctttgtctccgttgggaagtccatgctgatgattgtgaaaagttcctttaaaactagaagcttcaaagaatcttgacaggaaagaagtctctcaaatgctgtgttttagacttggttaggacatgaattctttacaaacgtcatatttcacagatgcgagaaaactttgttctgtaaatatgatcagtgtttatatcagagtaccaggtgtcccggttctcaagatgtaacacagcagaaaagtcttgtcggagtctgcacaggagagaggccttcctttaacaaaagtatgattgacagaaaaaatggatgtcaactaaaatgtaacctctatgtaaggaggtgtttttcaccactctatctctaccatgtagaattgtgcttggctcataatagggcccagcaattactgaagaaagtgaagaaaatacctataattaggacaaatacttgaaaattctagtctgttttctactctaaatttatattaatttatattcaaaaggaatcctgcaagtagccttaataacgttagtttcagtaagtactgaaaagtatataatactgccatccatactaacacaaatttggaaaaaagacatgaatggctcccatccttcagccttagttctttgtacagtgtatcatcagttgtgtacagtatgatttttagtgtcagtttatagactgaacaatactgtttttatctaatgtgaccctgcaatttacatgattagaatttttggacactaagctgtactgtaactctgaaagtgttaaaagtagttactgatgacaaaaagtttcttagtaaacttgaattgttaata

SEQ ID NO: 1280 - DNA, 8140 bp, Homo sapiens
gcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccagatggagttttaacattgaatgcggagaacactaattatgcctatcaagttccaaacttccataaatgtgaaatctgtctactatcttttccaaaagaatcccagtttcaacgccacatgagggatcacgagcgaaatgacaagccacatcgatgtgaccagtgcccccaaacatttaatgttgaattcaacctgacacttcataaatgcacccacagcggggaagatcctacctgccctgtgtgtaacaagaaattctccagagtggctagtctcaaagcgcatattatgctacatgaaaaggaagagaatctcatctgttctgagtgtggggatgagtttactctgcagagtcagctggccgtgcacatggaggagcaccgccaggagctggctggaacccggcagcatgcctgcaaggcctgcaagaaagagttcgagacctcctcggagctgaaggaacacatgaagactcattacaaaattagggtatcaagtacaaggtcttataaccggaatatcgacagaagtggattcacgtattcgtgtccgcactgtggaaagacgtttcaaaagccaagccagttaacgcgacacattaggatacacacaggtgaaaggccgttcaaatgtagtgaatgtggaaaggcttttaaccagaagggggcactgcagacccacatgatcaagcacacaggtgaaaaaccccatgcctgtgccttctgtcctgccgccttctctcagaaagggaatcttcagtcgcacgtgcagcgagtccactcagaggtcaagaatggtcctacctataactgtacagaatgtagttgtgtatttaaaagtttaggcagcttaaacacgcatatcagcaagatgcatatgggtgggccacagaattcaacaagttctacagagactgctcatgttttaacggccacactttttcagacgttacctcttcaacagacggaagcccaagccacgtcggcctcaagccagccgagctcccaggcggtgagcgacgtcatccagcagctcctggagctctcagagccggcgccggtggagtcggggcagtccccgcagcctgggcagcagctgagcatcacagtgggcatcaaccaggacattttacagcaagccttagaaaacagtgggctgtcttcaattccagctgcagcacatcctaatgactcctgccatgccaagacctctgcaccacacgctcaaaacccagatgtttccagcgtttcaaatgagcagacggaccccacagacgcagagcaagaaaaagaacaggaaagcccggagaaactggataaaaaagaaaaaaaaatgataaagaagaagtcaccgtttctacctggctccatccgcgaggagaacggcgtgcgctggcatgtgtgtccctactgcgccaaggagttccgcaagcccagcgacctggtccgccacatccgcatccacacccacgagaagcccttcaagtgcccgcagtgcttccgcgccttcgccgtgaagagcacgctgacagcgcacatcaagacgcacaccggcatcaaggcgttcaagtgccagtactgcatgaagagcttctccacctctggcagcctcaaggtgcacattcgcctgcacacaggagttagaccttttgcttgtcctcactgtgacaaaaaatttcgaacctcaggccataggaagactcacattgcttcccactttaaacatacggaattaaggaaaatgaggcaccagcgtaaacctgcaaaggtccgtgttggcaagacgaatattccagtccctgatattcctttgcaggaaccaatcctcataactgacttaggtctcatccagcccattccaaaaaaccagtttttccaaagctatttcaataataattttgtcaatgaagcagatagaccatacaagtgtttttactgtcatcgtgcatataaaaaatcttgccaccttaaacaacacatcagatcccatacaggtgaaaaaccttttaaatgttctcagtgtggaagaggctttgtttctgcaggcgtgctcaaagcacacatcagaacacacacaggactgaaatctttcaagtgtctgatatgtaatggggctttcactactggtggcagcttacggcgacacatgggtatccacaacgaccttcgtccctatatgtgtccctattgccaaaaaacatttaagacttcactaaattgcaaaaagcacatgaaaacccacagatatgagcttgcccagcagctccaacagcatcagcaggcagcctcgatagatgacagcactgtagaccagcagagcatgcaggcctccactcaaatgcaggtggagatcgagagcgacgagctgccgcagacggcagaggtggtcgcagcgaaccccgaggccatgctggacctggagcctcagcatgtggtgggcacggaggaagcagggctgggccagcagttggcagatcagcccctggaagcagatgaagatgggtttgtggctccacaggaccctctgcgagggcacgtagaccagtttgaagagcagagccctgcgcaacagtccttcgaaccagcagggctaccccaaggttttacagtgactgatacgtaccatcagcagcctcagtttccacctgtccaacagctacaggattccagcacacttgagtctcaggccctctccacaagcttccaccagcagagcttgctgcaggctcccagctctgatgggatgaatgtaacaactcgcttgattcaggagtcatcccaagaggaactggacctgcaggcacaaggttcccagtttctggaggacaacgaggaccagagcaggcgctcttacaggtgtgactattgcaacaaaggctttaagaagtccagccacctgaagcagcatgtgcggtcgcacaccggggaaaagccctacaagtgcaagctctgtggacgcggctttgtttcctctggggtcctcaagtcccacgagaagacacacacaggagtgaaggcgttcagctgcagtgtgtgcaatgcttccttcaccaccaatggcagcctcacccggcacatggccacacatatgagcatgaagccttataagtgtccgttttgtgaggagggtttccgaactacagtgcattgtaaaaagcacatgaagagacaccaaacagtcccctctgctgtgtcagccactggagagacagaaggaggagacatttgtatggaggaagaggaagaacattctgacagaaatgcatcacggaagtctcgtcctgaggtcatcactttcacggaggaggagacagcccagttagccaagatccggccgcaggagagcgccacggtgtcagagaaggtcctggtgcagtccgcggcagaaaaggaccgcatcagtgagctgagggacaagcaggcggagctgcaggacgagcccaagcacgccaactgctgcacatactgccccaagagcttcaagaaacctagcgacctggtgaggcatgttcgaatccatactggagaaaagccatacaaatgtgatgaatgtggaaagagttttactgtgaaatccactctcgattgtcatgtgaagactcacacaggtcagaagctcttcagctgtcacgtctgcagcaacgccttctccacgaagggaagtctgaaggtccacatgcgcctgcacacgggagccaagcccttcaaatgcccgcattgcgagctgcgtttccgtacctcgggtagaagaaagacacacatgcagtttcattataaaccagacccaaagaaggccagaaagcctatgactcgaagctcatcggaaggactgcagcctgtaaacctcctcaactcctcctctactgacccaaacgtgtttatcatgaacaactctgttctaacaggacagtttgatcagaatctgctgcaaccaggactggtgggccaagctattctccctgcctctgtgtcagctgggggtgacctgaccgtgtctctgacagatgggagcctggctaccctagaaggcatccagttacagttggctgctaacttggttggaccaaatgtacagatttctggaatcgatgctgccagcattaataacattacgttgcagattgatccaagcattctgcagcagacgctacagcagggcaacctattggctcagcagctcacgggggagcctggcctggccccacagaacagctctctccagacatcggacagcacggtccctgccagtgttgtcatccagcccatctcaggcctgtccttacagcccacagtgacctctgcgaacctgaccataggcccgctgtctgagcaggattcagtgctgaccactaacagcagtgggacccaagacctcactcaagtgatgacttcgcaaggtctagtgtccccctccggcggtccccacgagatcaccctgaccattaacaactccagcctgagccaggtcctggcacaggccgctgggcccactgccacgtcttcctcggggtctccacaggaaattaccctgactatctccgaacttaacactacaagcggaagccttccttcaacaacaccgatgtctccatcggccatctcgactcagaacctggtcatgtcctcgtcgggcgtgggaggtgacgctagtgtcacgctgacgctggccgatactcagggtatgctatctggaggcctggacactgtcacactcaacatcacctctcagggtcagcagttcccagcgctcctcacggatccctctctctcgggccagggtggagcaggctcgccgcaagtcatactagtgagccacacgccacagtcagcgtctgctgcttgtgaagaaatagcctaccaggtagctggcgtctctgggaacctggccccgggcaaccagccagagaaggagggccgggcgcaccagtgcctggagtgtgaccgcgccttctcatcggcggcggtgctcatgcaccacagcaaggaggtgcatggccgggagcgcatccacggctgccccgtgtgcaggaaggccttcaagcgcgccacgcacctcaaggagcacatgcagacacaccaggccggcccctctttgagctcccagaagccaagagtgtttaaatgtgacacttgtgagaaggcatttgccaaaccaagccagctggagcgccacagccgcatacatacaggggagcggccgttccattgcacgctttgtgagaaagccttcaaccagaagagtgcgctgcaggtgcacatgaagaagcacacgggggagcggccctacaagtgtgcctactgcgtcatgggcttcacgcagaagagcaacatgaagctgcacatgaagcgggcgcacagctatgctggagctctgcaggagtctgcaggtcacccggagcaggacggggaggagctgagccggaccctccacctggaggaggtggtgcaggaggccgccggcgagtggcaggccctcacccacgtcttctgatgcgagttggaagtacacctttaagaatgtttctgaagttacgttttgtgaagagcaaagcacttggaatctctgttttaaagcttcaagtgttaaaaatgctacaatagttttttatctataaaattatctaaagaatcattgtctttcagagactcataggaaaaaaaaactgggaaaagtgtcaccgcattgttctcttttgtctacaaatcactgaactcaggtactactgtaggcagtttcctcctcagtctcctccgtggctagtgtgtctagttcacgaagcaattaactgggtcttactatcattgtagtgtgatttctttgtattagcaaagacaaaaacgctaacattgaaaaagtatgtcagattttccttcatgtttctggttataagaagcatagcttacaaagcaagcgtaagattgaggcatgaagttcagaaaaaaaagtgttacaacacacagggaagttttttccactcttttctctgtgcattttgaaaattagtcaaaatggactcttttcagtctaccataagttaatataactgataccttgagagatggctggaccaattctctccatgacaaatgtttaatcattagttacaagaatgcagtatctggggcgtcaacatggggactcgagtaaacctgacccaccaataaggattcagctgtccacacgggctggcgacacacttaccgcatcaatctgtgttcaggtccagggttacataattgcagaagcacaagccatacatcgcaggtaggaaaccacagaaccgtctgcaaggagcaagcaacggtggccctgtccaccccagcaaataagaagcatatctgtagcttaaggccacgaatccgtaaaaaccccatgactttctcttcgtgcataaacagatgtatttttgatttcagggaattctttagtatcgtcaatggtgccacataaaacatgtcccaaaccaaatcccacccgtgctgggcagagtgcgtgcacgccattcctacagcattccaaagatggaaggttctttacttcatgttaatttttcctttgaaattatttatatgttctatatataaatacatatgtacatagatatatgggcctctgtgtggctgaacagtatattttgtaaatataagtactagtcctaattgcagaaagagcgtcagtttcacctccccacgagcacttcagatcagtattgtattcattttattcataaatggatatctttttcattgtcatataaagctgggttttatttttttttcctgaaaaataattgcctttattttctctcgttgcctccttggtttcagaagagagtagttttattataaatattgtatggactttgtatattaagagaggagctcatttcagattcctaaagaaatagacattttactgttattttgaaagggcatcttttgatttttttgttgttgttgttcacttttggcatatgtatataagtaatattgacggtgatatgaaaacttttgttatgtgaagatatttaagtcagaaaattgttaaataatattacttcttttccaaactgctttgtgtattgtatatttttttaagaaaaagaaaagccttatttgacttatgcttgtgatactggacttcttaccaatccggaggtttccttccttgaatgtcagtgtgtaaacctggctgtagccgcatatgcagaataactgtaattgtgctagagttttaaaggttctgcttttaatgcactttttattttataattttgtattgaaatattttagaaatgttgattaattttggtgaaaaaatatccccaaagtggaaattattggaattttaaacttttgttcttgctgggttatttattttgattttagcattaaatgtcatctcaggacatctctaaaaggggttgtttaattcctaattgtatagaaagctagtttggtgaattgtattggttaattgactgtttaaggccttaacaggtgaatctagagcctacttttattttggttaaagaaaaagaaaatatcaataattcaattttgtgtcttttctcaatttattagcaaacacaagacattttatgtattatttcgatttacttcctaattataaaagctgcttttttgcagaacattccttgaaaatataaggttttgaaaagacataattttacttgaatctttgtggggtacaggttgatctttatattttactggttgttttaaaaattctagaaaagagatttctaggcctcatgtataaccagggttttgaggataaagaactgtatttttagaactatctcatcatagcatatctgctttggaataactataaataaaagatgaagttaggaaaaaaaaaaaaaaaaaaa

SEQ ID NO: 1281 - DNA, 1622 bp, Homo sapiens
tttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccattgttcattggcatggaaaaatgttcagtgggaggattagagttgactgaacagactcctgctttattagggaatatggccatggcaactagtctcatggacataggggattcatttggtcatccagcttgtcctttagtcagtagatctaggaactcaccagtggaagatgatgatgatgatgatgatgttgtgtttattgaatctatacaacctccttcaatttctgctccagcaatagctgatcaaagaaacttcatatttgcatcatcaaaaaatgaaaagcctcaaggaaattattctgtaattcctccttcttcaagagatttggcatctcagaaaggaaatataagtgagacaattgttattgatgatgaagaggacatagaaacaaatggaggagcagagaaaaagtcttcctgttttatcgaatggggacttcctggaactaaaaacaaaaccaacgatttggatttctccacttccagtctttcaagaagtaaggtaaatgcaggaatgggtaatagtggtatcactacagaattgactctgaaatacattattactaatgttacaaccttagaaacaggtataagctctgtgaatgctgggcaagatgtgaacataattattacatataaaacatcactatagaataccaacttgggagatgtcgctaaaggacttcagtcaagtaattttggtgttaatatacaaacgtacaccccatctttaactccacagaccaagactggagtaagaccttttaaccctggtagaatgaatgtggcaggagacttatttcagaatggagaatttgcaactcatcatagtcctgattcttggatctcccagtcagcttcatttcccagtaatcagaaacagccaggggtggattctttatcaccagtggccttacttcgtaagcagaatttccagcctacagcccaacaacaacttactaaaccagctaaaatcacttgtgcaaattgcaaaaagcctttacagaagggacagacagcttatcaacgaaaaggatcagctcacctcttttgctctaccacctgcctttcttccttctctcataaacgtactcaaaacacacgaagcataatatgtaaaaaagatgcatctacaaagaaggctaatgtcattcttccagtagaatcaagcaaatccttccaagaattttatagtacatcttgtttgtctccctgtgaaaacaactggaatcttaaaaaaggagtttttaataagtcaagatgtacaatttgtagtaaattagcagaggtctggatttttatacctaagttgttgtttaggctaacagtgataattttaacttttaagtgctattatgtactctttcatctacataatgcacgtgttctggatgtataacatgaagctgaaaggaagaataaggatatgttagaactatcttatgggatattttataaataaaattccatttgcatagc

SEQ ID NO: 1282 - DNA, 4244 bp, Homo sapiens
tttaaactgtgctttctaagcacagtcaggtagcaaaagtaataaaaaggatggttgaacaagttttcttgtatgttccaggatatgtttgggacttttctttgtttattatatgagttgttccctttgaaattaaagctattttgtaggttttgtgggacataatttgataagtagagttaattaaatttcttctggaagagatctaaattcttattcttagtgagagactgtagttaaaggaaggcttttagaacttgggttcaaggaagatggagatgcgtcggaagctctttggcgggggtgaggaagttcagaaagtgtgcattttccttctggcatttaggtcttgtccgtgtgatttggtggtgcttgggtcataagcctgattaaaattcagggacatgtaccacggcggccaaagcggaattaatttttttatatggggactggagcgctgaaaagttgttcctgaccaggctctaatgagaaattcctctctccccaggttatgaagacagtatggagtttccagaccatagtagacatttgctacagtgtctgagcgagcagagacaccagggttttctttgtgactgcactgttctggtgggagatgcccagttccgagcgcaccgagctgtactggcttcatgcagcatgtatttccacctcttttacaaggaccagctggacaaaagagacattgttcatctgaacagcgacattgttacagcccccgctttcgctctcctgcttgaattcatgtatgaagggaaactccagttcaaagacttgcccattgaagacgtgctagcagctgccagttatctccacatgtatgacattgtcaaagtctgcaaaaagaagctgaaagagaaagccaccacggaggcagacagcaccaaaaaggaagaagatgcttcaagttgttcggacaaagtcgagagtctctccgatggcagcagccacatagcaggcgatttgcccagtgatgaagatgaaggagaagatgaaaaattgaacatcctgcccagcaaaagggacttggcggccgagcctgggaacatgtggatgcgattgccctcagactcagcaggcatcccccaggctggcggagaggcagagccacacgccacagcagctggaaaaacagtagccagcccctgcagctcaacagagtctttgtcccagaggtctgtcacctccgtgagggattcggcagatgttgactgtgtgctggacctgtctgtcaagtccagcctttcaggagttgaaaatctgaacagctcttatttctcttcacaggacgtgctgagaagcaacctggtgcaggtgaaggtggagaaagaggcttcctgtgatgagagtgatgttggcactaatgactatgacatggaacatagcactgtgaaagaaagtgtgagcactaataacagggtacagtatgagccggcccatctggctcccctgagggaggactcggtcttgagggagctggaccgggaggacaaagccagtgatgatgagatgatgaccccagagagcgagcgtgtccaggtggagggaggcatggagagcagtctgctcccctacgtctccaacatcctgagccccgcgggccagatcttcatgtgccccctgtgcaacaaggtcttccccagcccccacatcctgcagatccacctgagcacgcacttccgcgagcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatattaacttgtttttgcactttagaatagcatgagaatctcactaatttagcattctgataaaagaaactttagagcaagtcagaatagagaggtgtttttcctttgaggggataggggaagtaagccaataagaaccttttaaacaaatcgtcctgtcacaaaatgctttcatatggcttaattttgtcaacactgcattgtcttttgagctcttttttcccccccaacaaagtttttttgttttttgtttttttttttaagtagaaattccctccagttttattagcctctttatatgtctcaaattgcatgaattttttctggctgttggaaacctgaatgcttttagacccaaatggaaaatttctgaaatgctggattatctatttttaaacaagcagttgacttaaaactttctgtggcaacttctggttttctgacagttcccagtgagagaaatgctgaaagtacactgggatcactgggacactgtcttatgaaggtttgcttgggatgaaaaaggatattgcagcttcagcagtgttgaactgtgtgtttaaaaatgtgaattactgttattgtatactgtaattgattacatgggctgggggggtgtcaaagaacttgacaggttgtgttgatgctcttagttgagtcttgaaaagtaaatattaacgctacagaaatgcatgagtttcaatatattttttgtctttgtttgcattgtataactttaacgagtgagtttaaaattatttaatttccttagaaaaatagcaccatttggaaaaaaaaactggtgttatgaagaacgtaaatgcactgtttttatttttattttatataatttaaattgactttcccactgtctttaagttgaaactgttaagctgaataaaaacttaagctgcaaattgataacttcgctacataacaaggaaaatataaatgtttacaaacagcttaaagatttgcatgtgcagtgtgcatttataacaaacttctaattgcacaaaacccatgccagctcagagtttaggtgtacacatttacccagttgagcgttcttagaataactactgcacaagttgacaataggtcgttctctctttttttttgtttgctccctttttctttttctccccttcctccttaccctccctcccttactctccccccccaccaccaccctccacccccaactcatgaaaagattctatggactgaaaaagccccaggctgaaaggactggactgccttgattgacatggggaagggggttagtagactatgtggattgcggcagcagaggctgcagcctaacgtgtggttttaatgaccagcacgcaaggcaaaagcattttgcacagtgtttgttttcctgtcttgcacttacaaataaggtctatgggagtagcatggaaaacgtttgctgtttttcccttttttttttaattgcttttgtttaaaatttgatcgccttaactactgtaaacatagcctatttttgtgcttaagatactgaatggaaaactccattgtgtgttgctggactgttttggaaatatttggttaaatgtgtgttaatttggctgtaatggcatttaaagcaaacaaacaaacaaaaaaagctgtgaaaatggccttggagcattatctttagttacttgaagagtttctagtttttttaaaatacagtttatgttaaaataatttttattaatttagagaagacaatcaatgtctgtgagaaaacggactttcttttggattttctttttgtggtcattgtgagtgattgctttttccttttcttagtttcacattcttcctttgttctaaaacttagactgacatctagctttgacaatcatagtatgttttattttcctgagggggaataacttataatgctgtttagttttgtactattggtgtgttggtgaatttttaaactgtgtgctaactgcaataaattatatgaactgagaaaaaaaaaaaaaaaaaaaaaaaaaaaaaaaaaaaaaaaaaaaaaaaaa

SEQ ID NO: 1283 - DNA, 2406 bp, Homo sapiens
ctagtcccgattatggttattacagtttgatgaaatgtggctgagatcattggcactgtggagattaagaaatgtgaggtcagagtgttgggtaaattgttcctgcgagtgttaaggttgtcaggataatggtgggaatggggtgaagatgacaactcagcaatgacacaagaagagagtgacacagaaagattcagtagctgagaacttgagcgtagatatgttgtgggcaggagggaaatgatttggatggaagtagccaagtaagtgagaaaggaaagactttccaacaaaacttggcttagctcactcagatccctgagctgcaaacttcttctatacctttcttaccttttccagtgctgctgacttcaccccacttgcagggcatttgtgcagatggttgtttgttgaggaggaatgtgcttaatgttttaggaaccagttacattcaaggatgcctctgtggccttcaccgaggaggagtgaggtcacctggactctgctcccaggaagctgtgcggagctgtgatgctgggcaactacagaaacttggtcttggagacttgaatgaaaattctgtggagaatcttcagcagaaaacacttcaggatctgttacatgagctttcctcctggctagttttggaaggcatggccagtacaattactggaagtcaggattgtattgtgaatcatcgaggggaagtggatggggagcctgaactagatatttccccttgtcaacagtggggagaagcatcttctcctatttccagaaacagggacagtgtgatgactcttcaaagtggttgtttcgaaaacattgaaagtgaaacatatttgcctttgaaagtctcaagccaaatagacacacaagactcttcagtgaagttctgtaagaatgagcctcaggatcatcaggaaagcagacgtctctttgtaatggaagaaagcactgagagaaaagtgataaagggggaaagttgttcagagaaccttcaagttaaactggtgtctgatggacaagaactggcctcgccattgttaaatggtgaggcaacttgccagaatggccagttaaaagaatctttggatcccattgactgtaactgcaaagacattcatggatggaaatcacaggtggtcagttgtagtcagcagagagctcatacagaggagaaaccctgtgaccataataactgtgggaaaatacttaacaccagcccagatggtcatccatatgagaaaatccacactgcagagaaacaatacgaatgtagtcagtgtggtaagaacttcagtcaaagctcagagctactacttcatcagagagaccacacagaagaaaaaccctacaaatgtgagcaatgtgggaagggcttcacaaggagctcgagtctgcttatccatcaggcagtccacacagatgagaagccttataagtgtgacaagtgtgggaagggcttcaccaggagctcaagtctgctcatccatcatgccgtccatacaggcgaaaaaccttataaatgtgacaagtgtgggaagggctttagtcagagctccaaactgcacatccaccagcgagtccacactggagagaagccctatgagtgtgaggagtgtggtatgagcttcagtcagcgctcaaacctgcacatccaccagcgagtacacacaggagagaggccctacaagtgtggtgagtgtgggaagggcttcagtcagagctcgaaccttcacattcaccggtgcatccacacaggagagaagccttaccaatgctatgagtgtgggaagggtttcagccagagctcggatcttcgcatccatctcagagtccacactggagagaagccctatcactgtggcaagtgtgggaagggatttagccagagttccaaactcctcatccaccagagagtacatactggagagaagccctatgagtgcagcaagtgtgggaagggcttcagccagagctccaaccttcacatccaccagcgggttcacaagaaagatcctcgctaactgacattagcccattcaggtcttcacagcgctcatactgtaaaaactgttaaatatttagtatcactcttactttatattctacaaaggagagagatgtaagggttatttagatatgttccctcactgaaaaatcactcattcaaaatatttaagtatcaagcactttgttatgctgtacaatgaatggattgttcttgtttctcagatgggtagagtaaaagtgtctgtactttacaattcaactacatgttctacccagcattttaacggcaagaactttatatttattctcaagcagggcatgtttccctttgttcacattctctgagaaattgaaactctggtttctcttcaaaaaaaaaaaaaaaaaaaa

SEQ ID NO: 1284 - DNA, 6311 bp, Homo sapiens
cagcccgcgccgggggcttctgggaaaaggcttgtgaacggcgtttctgcgtctgccgtggacagcgaagctgctgcggttcctgagccggaggtttgcgccggagtgcctgtgaagaaaacggggtattgccctgaggcttatattctgcctcagttgtcttttcttgaaatattataaatcagaatgtctgcacagtcagtggaagaagattcaatacttatcatcccaactccagatgaagaggaaaaaattctgagagtgaagttggaggaggatcctgatggcgaagagggatcaagtatcccctggaaccatctcccagacccagagattttccgacagcgattcaggcagtttggataccaggattcacctgggccccgtgaggctgtgagccagctccgagaactttgccgtctgtggctcaggccagagacgcacacaaaagaacaaatcttggagctggtagtgctggagcagtttgttgccatcctacccaaagagctacagacttgggttcgagatcatcatccagagaatggagaggaggcagtgacagtgctggaggatttggagagtgaacttgatgaccctggacaaccggtttctctccgtcgacgaaaacgggaagtactagtagaagacatggtatctcaagaagaagctcagggattaccaagttctgagcttgatgctgtggagaaccagctcaagtgggcatcctgggagctccattccctaaggcactgtgatgatgatggtaggactgaaaatggagcactagctccaaagcaggagcttccttcagcattagaatcccatgaagttcctggcactctcaatatgggtgttcctcaaatttttaaatatggagaaacctgtttccccaagggcaggtttgaaagaaagagaaatccctctcgaaagaaacaacatatatgtgatgaatgtggaaaacacttcagtcagggctcagcccttattcttcatcaaagaattcacagtggggagaaaccttatggatgtgttgagtgtgggaaagcattcagccgaagttccattcttgtgcaacaccagagagtccacactggagaaaaaccttacaaatgtcttgaatgtgggaaagcctttagccagaattcggggcttattaatcatcagagaatccatactggggagaaaccttatgaatgcgttcagtgtgggaaatcgtatagtcaaagctcaaatctttttagacatcagagaagacacaatgcagaaaaacttctgaatgttgtgaaagtttaagaaattgaaaaaaaaaaaagaatcagcactcaggtctttttcttcagaaatgaagacaaaatttaaaatatgaaatgatgcagaatagttttttccctattgactgtcagaaaatccactgggaaatgtaaaaatcttcactcaccattatgatatttatcttgaaagaaatggtgtcatacctgcctagaaactgaaattttaaacttaattcaggtcttaatgcctaaattttccatgtgatgtttatagtctgtattacttctccaaataatgaactacctgattcattgtccctttcttgaaagtttcttttttaagacaaatacattatttctgcattgatcattgaaatgttctttatatggatacattcccttatatattaaaaggcaacaggaattacaaagtctgaaaaccattttaaaccatcttttaaaaatttacccttatttccttttacctaatttgaatatgcatttgagaaaataagaggataaaggatggctaagagcctcaaaatgaaccataagatctcagataagaagtgatggtgataaaacatcaaaaagtgaatggaacaccttgattggggaagatatgcaaatactttgatctaagaattgaaatgtatcaagaatttatattttgcctgcaggaaaattcaaaagctactcatcctctctataatttggagtcatcttactaatgaaaataatgttttcccatatattattaaaaagcatacagtctaaataataaacagttgtaaaataatgaaggtagaaattataacactagggaaaaatttgtagcggatggcagtgttgaaggcaaatgtaaacataagggtaatggtctgtcatggcttttagaaaaagatgatagagttcatcattattttgccttcatctttgttaaggacagaaaattccctgacaggtgggcaagtatcaggttacctattttttattcctttggtacaaaagggttgaacgtcaggctaaaaaagcagccatgcatttattattaaacattttctaccgacaaggcactgtgctaggtactgtaatcctaccataagtaggtaggtatttcttccactgtaaatcataggggtttgctgttttatgtgagttagcctcttccccttgtctgagcattcctcaggggaggtcacctgtgaggttcccagaactgtagttttttttaccagggtgttgtatttggagggggaggaggactcggctcaaaagagctagctggctctccagtgttcagaggtgagtccacgatactcttaccacaatttggaagtttgtgaatctttttaaagaactaatcaatctctaatagcattgaggttgtacctacatattaagttgaatggactgttctatttaaaaaataaacaactagacaattaactagtttattaacctatcacaattgaatttttttttaattttcagtcttaacacattttttaaaatgtattaaagtaatacattgtagtagtaggattatatactccttggctgagaattccaagtactgtggttctactgtttagtggaaaactctggaagttaaaatatagaatatgagaggaggcttttttataatgggcatcattgtgtggaaaatgacccatgtgaatacaaatatttcctagttcagagattttggttatatctggtgcttggatcaagtttaaaaatggaaggtgagattttgcatgagcctattaaaaagcatagtaataaatgcaaggccagctggtggaaaagtgaggcagaatggagcttgtttataggttttctgataacaattataaaaaatgtgctttatagattaagatttattgaagtataaatatgtagtaatgatataatgtattttaagttatacaagaaaatgtagggacttttgtttgggtctttttctctttgtggctgaggggaaacaagtcagtgtccaataaagctgtaaactcctctgctctaagataaatgatgtgatttatttatttataactggcttctttccaagtaggttttcaggtggcatatttggaagacggctggaatgacagaattcttgtatcagagtaggtaagaagggagcaacctctcaatggctattatgtcatgctttttaagatcgtatgcggttcctatatacaaggaagcttccctgtggtagatttgtcataaatgccaaagatatttggtaatgtgagtgtagaaaaagtagtatgagggttggcaaatactgtttttgtcttggcagctctaatatctgcattgttcagaaaggattctgaggctaaggcaaagctctgtgggaaaaagggactggaccaaaaaaaactggatggtggcacacaagaagaggaaatgatgagatgtgtactttctatctctggttaggcttagtccccactagacaaattgattttaaatactatgtagtgatttttaaattccatccacacattcattacccacacagataatcatagaaatttgggggagtgcctagcttctgatgaagtggtgatatggcagtgccaagcagtggcatcgccagagtatctgtttggttagcaaatgagcagtcattttaggtcatgcagattgctgatatctgcccagtagccactgagcatttgctggttttttcttctggctttcttggaggttaagctctctgtagtcatacccagttggtacttgatctttagcaatatgtctcatattcatgtaaattgaagggagggttacatgtactgaaataatctgcatgctaggcattggcttagacaccgtacctatctcacttagatttgtggactaggaaagcaagattcagagatcatgtgacttgcatgtggcctagagataaaattcaaatctggttctgtagactccagggacatattcaccatgccatgggtggtggctattaaaccttgataaatttgtgtttatggttaacaaatgtgaaagctattaaacattgctggtttgaattttttacagtgcagaaatgtaaaatgaaaaaggatatttcctttcacagtgttaccgagaagtcatgataatttcgtttgttcttccagatttaggcatatacttatttaatcaataatgtgttaacagctgacacctgtggttgctgtgacaggcactatttgaagtgctttatcatggattaactcttaatcctcagctaccgtataaagtaggacataaccccatttcacatgcactacactgagacttgcctcctctccccccacattgaagatgttcttttttcataactatatactattccattgcatgaatattctgtaatttatttaatcccctatggattgataattaggttcattatagatagaagtgtaattaacattcctgtacatgtattttgctacttgtgtgggtatttctgtaggatgaataactagaaatttattggatcaggtttcacatttgcagttttgaaaactactaccaaaaagatttcaccaatttacaactccatcattagtaagaatgcctgtttgcctatagtctgccaaccctgaatccttaaaaatttttgccaatctggtaggcaaaatttctttcttttctttgaatattaatgaggaggaacatcttttcatgtttcttggccatttgcatttcctattatgaattgcttttgcccattttcctttttttaattatgaaagtctaatgactaccttctcattgtataaaaaacacagttctttgaatagagagacccttttctccaatgctaccaatcacattccacttaccacagtttaacatacatcctctagtcacctttccgtacgaatatacatacacataaaaacactttttacataaataggatctcatattctgtagctttttaaaattttggtctcaaaaaaagataacaggtctttaaatttctttaatggttgaatatgattaaatactatgaaaatgccattatttattcccttaatttttttcctctcgctattacattgccaaagtaaacatcctattcagatgtctttgtgcatgtgtgtgaatatttctttagtctggagtccagtaaggtggatttttggatcaaagggtttgttctctgtccaccttcagtcttcccaaaggccttcataactgtattttcaccaagtgtatggagaatgttcatttccccatataaccatacctacacttgatagtttttatctgttgggcgaaaaagaaccttttcttattttgcatttccctgattataaaaaaaaatggtgagattggggttattttcatgtttattggccatttatagtttactgtggattgtttgtatcccttacctgctttctattgggttatgtgtggatatattgtttttatttgttcagcatctccttccccatcttctggtaacacaacctttatttatttgtggggaacctattccctgtggcttaggtgagcatgtgaccaggcctggcctcctgagtcccacagcttcctagccacagtgataaaagaatgggtatataacttaagccaggctaaggaaagcccttaacagaacttctgctggaactactggaaagaaggctttatggagatcccaggaaccaaggaccatgtaagcctgaatttgtgccatgtggagagagtctgtctgaggagaaactcggatgctagcagaaatggaaagagaactaagttctgatgtcatttttctggaggccctagatccagctgtgcctaaagcctgccctacctccggactttaaagttttgtgagccaataaagtccctttcttgtttaagataattgaattgagtttctgttctgattaatataggttatttgtattttcttattgatttgtagaaaacctttgtaattttaaattctagactttatgcactatataagttaataaaattagcatggccttccatgatttggcctgtgtc

SEQ ID NO: 1285 - DNA, 168 bp, Homo sapiens
tttgaatgtactgaatgtgggaagttcttctatgtgaaggcatacctcatggtacatcagaaaacacacacaggggagaaaccctatgagtgtaaggagtgtgggaaagccttttcccagaagtcacacctcacagtacatcagagaatgcacacaggggagaaaccc

SEQ ID NO: 1286 - DNA, 2351 bp, Homo sapiens
ctgtgcttatagaggcccgtcctctgtggccgtgtgacctgcaagtattgggagagccacagctaaaccccgggacccctggaagcctagaaatgggaccattgcaatttagagatgtggccatagaattctctctggaggagtggcattgcctggacactgcacagcggaatttatatagggatgtgatgttagagaactacagaaacttggtcttccttggtattgttgtctctaagccagacctggttacctgtctggagcaaggaaaaaaacctttaactatggaaagacatgagatgattgccaaacccccagttatgagttctcattttgcccaagacctttggccagagaacatacaaaattctttccaaatagggatgctgagaagatatgaagaatgcagacatgacaatttacagttaaaaaaaggctgtaaaagcgtgggtgagcataaggtgcacaaaggaggttataatggacttaaccaatgtttgacaactacccagaaagaaatatttcaatgtgataaatatggaaaagtctttcataagttttcaaattcaaacacatataagacaagacatactggaataaatcttttcaaatgtataatatgtggcaaagcttttaaacggtcctcaacccttactacacataagaaaattcatactggagagaaaccttacagatgtgaagaatgtggcaaagcttttaaccaatctgcaaaccttactacacataagagaattcataccggagagaaaccctacagatgtgaagaatgtggcaaagcctttaagcagtcctcaaaccttactacacataagaaaattcatactggagagaaaccctacaaatgtgaagaatgtggcaaagccttcaaccgatccacagaccttactacacataagatagttcatactggagagaaaccctacaaatgtgaagaatgtggcaaagcctttaagcacccctcacacgttaccacacataagaaaattcatactagagggaaaccctacaactgtgaagaatgtggcaaatcctttaagcactgctctaaccttactatacataagagaattcatacaggagagaaaccctacaaatgtgaagaatgtggcaaagcctttcacctatcctcacaccttactacacataagatacttcatactggagagaaaccctacagatgtagagaatgtggcaaagcttttaaccattccacaacccttttttcacatgagaaaattcatactggagagaaaccctacaaatgtgatgaatgtggcaaaacctttacctggccctcaatcctctccaaacataaaagaactcatactggagagaaaccctacaaatgtgaagaatgtggcaaatcctttactgcatcctcaactctaactacacataagagaattcatactggagagaaaccttacaaatgtgaagaatgtggcaaagcttttaactggtcctcagaccttaataaacataagaaaattcatattgaacgaaaaccctacatagtgaagaatgtgacagatcttttaaatgttcctccacttttaattagcataagataattcatactggagagaaaccctatgaatgtgatgaatgtgggaaagcctttaaccagccctcgactcttagtaaatttgagagtttatatggaacacaaaccctacaaatataaagaatgtgacaaagctttttaaggaagttctcaacccttattacacataattcataccaaacagaagccctacaagtgtgaagaatgtggcaaaacctataaacctataacaagttctcaattcctttttttttgagatggagtttcactcttgtcaccgaggctggagtgcaatgacatgatctccgttcactgcaatctctgcctcctgggtttaagccattcttctgcctcagcctcccaagtagctgggattacaggtgcccaacaccacgcctggctaatttttggatttttagtagagatggggtttcacaatgttggccaggctggtctcgaactcctgacctcaggtgatccacctgccttggccttccaaagtgctggggttacaggcgtgagccaccatgcctggctacaagttcttaattcttaagagacaccatgcctggctacaagttcttaattcttaagagacatggcgataattcatgctgaagaggaaatctggaaacctgaaagatgcgacattgcttttaccaacacctccacatttcctatacataaaaataaattatactagtgtaataccctagaaatgtataaaatgtgacaaagcctttaaaaaaaaaaaaaaaaaaaaaaa

SEQ ID NO: 1287 - DNA, 3062 bp, Homo sapiens
gggatatggcggggcctttgtctctcgctgtcgccggagtcccaggtctgtcttcactgctctgtgtcctctgctcctagaggcccagcctctgtggcgctgttaccagcaggtattggagatccacagctaagatgccaggaccccctagaagcctagaaatgggactgttgacatttagggatgtggccatagaattctctctggaggagtggcaacacctggacattgcacagcagaatttatatagaaatgtgatgttagagaactacagaaacctggccttcctgggtattgctgtctctaagccagacctgatcacctgtctggaacaagggaaagagccctggaatatgaagcgacatgagatggtggatgaacccccaggtatgtgtcctcattttgctcaagacctttggccagagcagggcatggaagattcttttcaaaaagcaatactgagaagatatggaaaatatggacatgagaatttacagttaagaaaaggctgtaaaagtgtggatgagtataaggtgaacaaagaaggttataatggacttaaccagtgtttcacaactgcccagagcaaagtatttcaatgtgataaatatttgaaagtcttctataaatttttaaattcaaacagacctaagataagacatactgaaaagaaatctttcaaatgtaaaaaacgtgtcaaattattttgcatgctttcacataaaacccaacacaaaagcatttatcatagagagaagtcctacaaatgtaaagaatgtggaaaaacctttaattggtcctcaacccttactaatcataggaaaatttatactgaagagaaaccttacaaatgtgaagaatataacaaatctcctaagcaactctcaacccttactacacatgaaataattcatgctggagagaaactctacaaatgtgaagaatgtggcaaatcttttaaccggtcttcaacttttactaaacataaggtaattcatactggagtaaaaccctacaaatgtgaagaatgtggcaaagcatttttctggtcctcaaccctaactaaacataagagaattcatactggagagcaaccctacaaatgggaaaaatttggcaaagcctttaatcggtcctcgcacctcaccacagataagataactcattggagagaaatcttacaagtatgaataatgtgccaaagcctaagaaaaccctcaattcttaatagatataagattattcctactggagagaaactacaaacctgagagaggcgctaatgcttttgacagtacctaaaactttaaagaaaatcattctgctgaaaaatcctagaaatgtgaagaatgtgaaaaagcctttaaatgattgtcacacttgattgtaggtaagataattcatactggagaaaactaccagtgtgaacaacgtggccaagcttcgacaatgctcacaccctattgcacaggaaagcatttatacttgagaagaaatgtacaaatattggcaaagtaaaaaatccattaacacctgctcacatcttactcaaaattgtagagttcatagtaaataaaagcattaaaattctaattactctcagaagatctgtcagaaagtatgtctttaaagtatagaagagcatttattttgaaaaaaacattacacatatgaagaggattgtaatatctttacttgtaccacagatcttattgtacacattttatactagagaaaaaccctcaggcagttgttaaaattttgttgaacatcagggagtttaagaaaaccctgcaagtataatgaatttggaaaaacattttttcaaaaactacaaattataaaacaccaaagtgttcatactaaaatatatttttgcagatacattaaatatgaaagatattcaatccaaaattaagtctatgtaaatatcagggaataattcacagtagaaatatctagggcattcaagctttagacattacactaaatcagagtgctgagtatagaaaataatacaaacagatttgtctaaacatttgtatataactttaaaaatagaatattttttggagggttataattacattcaaagtacttttttttgaaaatacagattttttttaaaagtgaataatgtgttcaactcttaaattcatgctgtttcatcattgctggtgtattcatatgtgaaagcatgtgactaattgttgctgcataaaagatatgagattcttttttattaggcattatttatgaccttttctatgaaaagataaggacattaaaatgtaagatgcgtgaggaaaatttaggtagagaggctctttgtggttaacttataatattgagtgatgcatgaggtaggtgttcagaataatattcctctgcattattatgaatgaaaagcattcttaattttagttaaaattaagttagtcatatgttattttattaattgtacttctatgaaataatatgcagtctatttttaaattataaattatgtgtgaacttagcttttcaattcaacatttttaacatattaaatactattgtgaattcaatgaagtgttcttatgccactaactttaacctattcccttactcaaggatgtaggtaaaagatggtaacaatacactatttggtaagataatgtactgacatctctagcaatcttttttgccagtggctttaaattgccaataagttaaagaatattgttcctatgggttaaatttttattcttattttcacatttaaatttatttttcttaatttttgtggatacataatatgtgtatatatgtatgccatatatggtatattttgatgcaggcatactctatataataatcacattagaggaaatgagatatccattacctctagcatttattctttttattacaagcaattcaattgtacacttttagttatttttaaatttacaatgttattgattacagggtcatttttatggtcataataaaaaattttatacaaacgtgtaaaatctatacatttctgagttctgaataaatatttttaaaaattttaa

SEQ ID NO: 1288 - DNA, 3006 bp, Homo sapiens
ttttttttttatattacttttgtttaaaattggttttgattcatattttattatatacacaatttattagcttcataatttaccatgcaagattttagactgattaggaaattcactaggaagagtagcaggtataatgtttgtatcatattaattttattattgtcttttatttttattaaaaattttatttcagtagtctttttttattttattaaagtatatactggtttttggttacatggatgaattgtctaatggtgaagtctgagattttagtgtacccatcacctgagtagtgtacattgtacccaacttgtagctttttatcccttaccctaccttccaccctccccatttggagtctgcatagtccattatatcactctgtatgcctttgcatacccatagcttaactcccacttataagtgaaaacacggtatttggttttccattcctgagttacttcacttagaataatagcctccagctccatccaagttgctgcaaaagacattatttcatttttttatggctgaatagtattccatggtgaatatataccatattttctttatccactcattggttgatgggcacttaggttggttccatgtctttgaaattgtgaattgtgctgtaataaatataggcatgcaggtgtccttttgatgtaaggacttcttttcctttgggtagatagtagtgggattgctggatcaaatggtagatccacttttagttctttagagaatctccatactgtatttcatagaggttgtactaatttaccttcacaccagcagtgtataggcgtttcttttcaccacacccatgtcaacatctattgtttttcgtcttttatttctatcaagtattttacatatgatacttggtttagttcgaaattggcctcatccaaaccaaagattatggtgcacttgaaaaatcaaactgaatgttgtctatactcatgagagtttcctgccatggcctaagtgaaatcttgataacactgaacaaaggcttcacttgtcctcatcctttaattctgtattctgataggagacaagatccaaactgagatggagactgtttcagaagcaggaacacatcaagagtggtccttccagcaaatctgggaaaaaattgcaagtgatttaaccaggtctcaagacttggtgataaatagctctcagttctccaaagaaggtgatttcccctgccagactgaggcaaggactatctgtaattcacacaagacagaaatcttcccaagggcaattggatataaaccatccttcagtgatgtctccctctttgattttcatcaacaattacactcaggagagaaatctcatacgtgtgatgagtgtggaaagaacttttgttacatctcagcccttcgtattcatcagagagtccacatgggagagaaatgctataagtgtgacgtgtgtggtaaggaattcagtcagagttcacatctgcaaactcatcagagagtccacactggagagaaaccgttcaaatgtgtggaatgtgggaaaggcttcagtcgtagatcagcacttaatgttcatcacaaattacacacaggagagaaaccttataattgtgaggaatgcgggaaggccttcattcacgactcccagcttcaagaacatcagagaatccatacgggggagaagccattcaaatgtgatatatgtggtaagagcttctgtggtagatcaagacttaataggcattccatggttcacacggcagagaaaccattccgatgtgatacgtgtgataagagctttcgtcagagatcagcacttaatagtcatcgcatgatccacacaggagagaaaccatacaaatgtgaggagtgtggaaaaggctttatttgtaggcgagatctttatacgcatcatatggtccacacgggagagaagccatataattgtaaagagtgtgggaagagcttcagatgggcctcgtgtcttttgaaacatcagcgagtccacagtggagaaaaaccaattcaatgtgaagaatgtgggaaaggattttacacaatttcacaatgctattcccaccagagatcccatagtggagaaaaaccatacaaatgtgtggagtgtgggaagggctacaaaaggaggttggatcttgactttcaccagcgcgtccatacaggagagaaactgtataattgtaaggaatgtgggaagagctttagtcgggccccatgtcttttgaaacatgagagactccacagtggagaaaaaccattccaatgtgaagagtgtgggaagagatttactcaaaattcacatcttcattcccatcagagagttcacactggagaaaagccatacaaatgtgagaagtgtggaaagggccacaatagtaagtttaatcttgatatgcaccagaaggtccacacaggagagagaccatacaattgtaaggaatgtgggaagagttttggctgggcctcgtgtcttttgaaacatcagagactgcacagtggggaaaaacctttcaaatgtgaagagtgtgggaaaagatttactcagaattcacagcttcattctcatcaaagagtgcacactggagaaaagccatacaaatgtgatgagtgtgggaagggcttcagctggtcctcaactcgtctgacccatcagagacgccacagcagagaaacacctctcaaatgtgagcagcatgggaagaacattgtacagaattcattctctgaagtgcaagaaaaagttcacagtgtagaaaagccatacaaatgtgaggactgtgggaagggctacaacaggcgcttgaatcttgatatgcatcagagggtccacatgggagagaaaacatggaagtgtagggagtgtgatatgtgctttagtcaggcctcaagccttcgacttcatcagaatgttcatgttggagaaaaaccttagtgatgtgatggtgcaataaagtcttcactcagtcttcatgaaaaaaaa

SEQ ID NO: 1289 - DNA, 2228 bp, Homo sapiens
ggcgggacttccgttgtcctccttgtggcggtcgttttggcatttgtctggactgattacttggtagaaagccccggagcgctgggtcagcatcatccgtgactgactgagaaggcgcgagaggagtcttccccgctgcacagaggcgtggctgaggctcggcggcgcccagggtacccaggcccggcccggaataaggacatcctctctggccccgctccgctcacagagtcagatggcggcggccgagctgacggccccggcccagggcattgtgacctttgaggacgtggctgtttacttctcctggaaggaatggggtcttcttgatgaggctcagaaatgcctgtaccacgatgtgatgctggagaacttgacacttacaacctccctgggtggttctggagcaggggatgaggaggcaccttatcagcagagcacttctccacagcgggtgtcacaggttaggattcctaaggcccttccttctccccagaagaccaacccctgtgagatatgtggcccagtcttgagacagattttgcacttggttgaacaccaaggaacacaccatggtcagaaactgtatacagacggggcatgtaggaaacaattacaatttactgcataccttcatcagcaccagaagcagcatgttggacagaaacacttcagaagcaatgggggcagagacatgtttttgagcagctgcacatttgaagtatctgggaagcccttcacttgcaaggaggttgggaaggatttcctggtgagatcaagatttcttcagcaacaggctgctcacaccagaaagaagtcaaacagaaccaagagtgcagtggcctttcacagtgtaaaaaatcattacaactggggagaatgtgtgaaagctttcagctacaaacatgtacgtgttcagcaccagggagacctcattagggaaagatcttacatgtgcagtgaatgtgggaaatcttttagcacaagctgtagcctcagtgatcatttgagagttcacacttcagaaaagccttatacatgtggagaatgtgggaaatcctataggcaaagctctagccttattacgcaccgaagaattcacactggagtaagacctcatcaatgtgatgaatgtggaaaattatttaacaggaagtatgaccttcttatacatcagagagttcatactggagaaaggccttacaagtgcagtgaatgtgggaaatcctttagccatagctctagcctcattacacaccagagaattcatactggaatgaggccttatgagtgcagtgaatgtgggaaatcttttatccatagttctagccttattacacaccagagagttcacactggtacaaggccttatatgtgcagtgaatgtgggaaatcctttagccagagctgtcacctcattaaacaccggagacttcacattggagaagggccttatgagtgtagtgaatgtgggaaattgtttacttatagatctcgtttcttccaacaccagagagttcatactggagtaagatctcatgaatgtcatgaatgtggaaaattatttagcaggaaatttgacctcattgtacatgagagagttcacacaggagaaaggccatatgagtgcagtgaatgtggaaaatcctttacctgtaaatcctacctcatctcacactggaaagttcatactggagcaaggccttatgaatgtggggagtgtgggaaatcatttactcatagctctacgctccttcaacaccagagagttcacactggagaaaggccttatgagtgcaatgaatgtgggaagttttttagccagagctccagcctcattagacataggagaagtcacaccggagaaaggccttatgagtgcagtgagtgttggaaatcctttagtaaccactctagcctcgttaaacaccgaagagttcataccggagaaaggccttatgaatgcagtgaatgtggaaaatcctttagccagagctctaacctcactaatcaccagcgaattcacagtggggaaaggccttatgagtgtagtgactgtggaaaattttttaccttcaactccaacctcctaaaacatcagaacgttcacaagggataaaggttaggtaacacacatagggctgttacggactgagaagtgtccctgcaaaattcacagacataaataaataaatacgtattttcaataaaaaaaaaaaaaaaaaaaa

SEQ ID NO: 1290 - DNA, 3534 bp, Homo sapiens
ggcttccgggtttggcgggtactttgtctctcgctctagcccgagctgcaggtctcgtcttccctggtctgtgtcctcttctcctaggggcccagcctctgtggccctgtgacctgcaggtattgggagatccccagctaagacgccaggtcctcctggaagcctagaaatgggaccactgacaattagggatgtgactgtagaattctctctggaggagtggcattgcctggacactgcacagcagaatttatatagggatgtgatgttagagaactacagaaacctggtcttcctgggtattgctgtctctaagccagacctgatcacctgtctggagcaaggaaaagagccctgtaatatgaagagacatgagatggtagccaaacccccagttatgtgttctcatattgctgaagacctttgcccagagcgagacataaaatattttttccaaaaagtcatactgaggagatatgataaatgtgaacatgagaatttacaattaagaaagggctgtaaaagtgtggatgagtgtaaggtgtgcaaaggaggttataatggacttaaccaatgtctgataactacccagagcaaaatgtatcaatgtgataaatatgtaaaagtcttctataagttttcaaattcagatagacataagataagacatactgaaaagaaaacttgcaaatgtaaagaatgtggcaaatcattttgcatgctttcacaactaactcgacataagagaattcatattagagagaattcccacaaatgtgaagaatgtggcaaagcctttaaccagtcctcagctcttactcgacataagatgactcatactggagagaaaccctacaaatgtgaagagtgtggaaaagcttttaaccggtcttcacaccttactcaacataaggtaattcatactagagagaaaccctacaaatgtgaagagtgtggcaaagcctttaaccggtcttcacacattactcaacataagagaattcataatagagagaagcccttcaaatatgatgaatgttgcaaagcctttaagtggtcctcagctcttactacccttactcaacataagagaattcatactggagagaaaccctacaaatgtgaagagtgtggcaaagcctttaaccagtcctcagcccttactcgacataagatgattcatactggagagaaacccttccaatgtgaagagtgtggcaaagcttttaaccggtcttcacaccttactcaacataagataattcatactaaagagaaaccctacaaatgtgaagagtgtggaaaagcctttaaccggtcttcacaccttactaaacataagagaattcatactagagagaaggcctacaaatgtgatgaatattgcaaagcttttaactggtcctcagctcttactacccttactcagcataagataattcatactggagagaaaccctacaaatgtgaagagtgtggcaaagcctttaaccggtcttcataccttattcgacataagataattcatactggagagaaaccctacaaatgtgaagagtgtggcaaagcctttaaccagtcttcacaccttactcaacataaaataattcatactggggagaagccctacaaatgtgaagaatgtggcaaagcctttaaccggtcttcacacctttctcaacataagataattcatactggagagaaaccctacaaatgtgaagaatgtggcaagccttttaatcgtttctcataccttaccgtacataagagaattcatgctggagagaaccccaacaaatatgaagaatgtggcaaagcttgtaaccattcctcaaaccttactaaacataattcataatggagaaaaaccctacaaatgtgaagaatgtgtcaaagcttttaactgttcctcaatccttactaaacataagggaattcataatagagaaaccctacaaatgtgaagaacgtggcctggcttttaacaaatcctcaacatttactaagcataaaataattcatgctggagagaaactcttgaaatgtgatgaatgtggcatagcctcttcccagttctcaactcttactaaacatgagaacacatgtggaagataaagcctacaaatatgaagaatgtgacaaggcctttaaaagttctcaacccttattacacataatttatactggacagaaatcctaaagtgtgaagaatgtcacaaagcccttaataagtcctcaattcttaacagatataagatgtttcatactggagcgaaactacaatcctgaatgatgtcacagtgcttttaacaatacctcaaacttttctaaacataaaaaaaaattatactagtgcgaaactctagaaatataaagaacatgaaaaacttttaaatggttttcacacttgattgcaggtaaaataatttataccggagaaaactccaagtgtgaagaatataacttttaaccagtgttcacaacttattgtacaggaaagcatttatagttgagaaatggtgtacaaatataaagaatgtggaaaagtcattaatatttgctcacatattacacatcagagagttcatacttaataaaagtattataaatacaattactgtcaaatgatctttcagaaatataaacctttaaagtgaagaagagttcattctaaagacaaacattacaaatataaaggggtttgtagtgcttttacttgtatcacagattttattgtacacattttgtactagagaataaccctgaagcagttgctaaaattttgttcagcattaggaaatttatgttggagaagaattcagcaagtgtgattaatttggaaaaacattttttccataactatagcttagaaaatgccagagagctcatactaaaatatacttttgcagatgcaataaatacaaagaaatatttaattcaaattgagtttatataattatcagagaattaacagtagaaatagctaaggcactgacacttcagacattacactaaatcagattgctgagtatagaaaatccaaaactacagttggtaagtaaattaattttatgtaactttaaaatgagtagacatttctttgagaagtcataattaaattcaagtatacttttttgataaaattataaagctttttaaaagtaaataatgatgtaagtcaactctcaaattacttcatgctgtttcttcatttctattgtattcacctgtgaaagcatgtgatcaactattgctgcatcagagatatgagagatactttattaggtgggaattatatacgacctcttctataaaatagtaaggacactgaaatataagatgcataagagtctaagtgaagaggttctttgtggttaacttagtgatgtatgaagtagttgctcatgttatgagagaaaaacatttttaattttagttaaatgtaagttaaaattaaaatagtaccatataatgttagtgattgtacttttatttaataaaatgcagtacattttaaaaaaaaaaaaaaaa

SEQ ID NO: 1291 - DNA, 5159 bp, Homo sapiens
gagggcggagaccaaggctgcgcaggcgtggttggccggtcgttgcgttgggatggatcaggcggaattccagaagagaaaataatccctgtctagatgcagaggacttggttcctattccagtgctcctccggtagcagggaggcgacagaaggtgtccaactatccattaccaagaagaaatctattcgtttgagcctgagacactctttgaggtaaaaaattagaatgaaagaacctttggatggtgaatgtggcaaagcagtggtaccacagcaggagcttctggacaaaattaaagaagaaccagacaatgctcaagagtatggatgtgtccaacagccaaaaactcaagaaagtaaattgaaaattggtggtgtgtcttcagttaatgagagacctattgcccagcagttgaacccaggctttcagctttcttttgcatcatctggcccaagtgtgttgcttccttcagttccagctgttgctattaaggttttttgttctggttgtaaaaaaatgctttataagggccaaactgcatatcataagacaggatctactcagctcttctgctccacacgatgcatcaccagacattcttcacctgcctgcctgccacctcctcccaagaaaacctgcacaaactgctcgaaagacattttaaatcctaaggatgtgatcacaactcgctttgagaattcctatcctagcaaagatttctgcagccaatcatgcttgtcatcttatgagctaaagaaaaaacctgttgttaccatatataccaaaagcatttcaactaagtgcagtatgtgtcagaagaatgctgatactcgatttgaagttaaatatcaaaatgtggtacatggtctttgtagtgatgcctgtttttcaaaatttcactctacaaacaacctcaccatgaactgttgtgagaactgtgggagctattgctatagtagctctggtccttgccaatcccagaaggtttttagttcaacaagtgtcacggcatacaagcagaattctgcccaaattcctccatatgccctggggaagtcattgaggccctcagctgaaatgattgagactacaaatgattcaggaaaaacagagcttttctgctctattaattgcttatctgcttacagagttaagactgttacttcttcaggtgtccaggtttcatgtcatagttgtaaaacctcagcaatccctcagtatcacctagccatgtcaaatggaactatatacagcttctgcagctccagttgtgtggttgctttccagaatgtatttagcaagccaaaaggaacaaactcttcggcggtgcccctgtctcagggccaagtggttgtaagcccgccctcctccaggtcagcagtgtcaataggaggaggtaacacctctgccgtttcccccagctccatccgtggctctgctgcagccagcctccaacctcttgctgaacaatcccagcaagttgctttaacccatacagttgttaaactcaagtgtcagcactgtaaccatctatttgccacaaaaccagaacttcttttttacaagggtaaaatgtttctgttttgtggcaagaattgctctgatgaatacaagaagaaaaataaagttgtggcaatgtgtgactactgtaaactgcagaaaattataaaggagactgtgcgattctcaggggttgataagccattctgtagtgaagtttgcaaattcctctctgcccgtgactttggagaacgatggggaaactactgtaagatgtgcagctactgttcacagacatccccaaatttggtagaaaatcgattggagggcaagttagaagagttttgttgtgaagattgtatgtccaaatttacagttctgttttatcagatggccaagtgtgatggttgtaaacgacagggtaaactaagcgagtccataaagtggcgaggcaacattaaacatttctgtaacctattttgtgtcttggagttttgtcatcagcaaattatgaatgactgtcttccacaaaataaagtaaatatttctaaagcaaaaactgctgtgacggagctcccttctgcaaggacagatacaacaccagttataaccagtgtgatgtcattggcaaaaatacctgctaccttatctacagggaacactaacagtgttttaaaaggtgcagttactaaagaggcagcaaagatcattcaagatgaaagtacacaggaagatgctatgaaatttccatcttcccaatcttcccagccttccaggcttttaaagaacaaaggcatatcatgcaaacccgtcacacagaccaaggccacttcttgcaaaccacatacacagcacaaagaatgtcagacagatttacctatgcctaatgaaaaaaatgatgcagaacttgattctccaccttcaaagaaaaaaagattaggttttttccagacttatgatacagaatatttaaaagttggttttattatctgtcctggatcaaaagaaagttcaccaaggccacagtgtgtcatttgtggagagatcttatccagtgaaaacatgaagccagcaaatctttctcatcatttgaagacaaaacattcagaattagaaaacaaaccagtagatttttttgaacaaaaatctttagaaatggaatgtcaaaatagttctttaaaaaagtgtttactagttgaaaagtcacttgtgaaagcttcttatttaattgctttccaaactgctgcaagcaagaagccattctccattgctgaagaattaattaaaccatatttagtagaaatgtgttcagaagttttgggttcaagtgctggagacaaaatgaaaactattccactttctaatgttacaattcaacacaggattgatgaactatctgcagacattgaagaccagctgattcaaaaggtcagagagtcaaagtggtttgcccttcagatagatgagtcatcagaaatctcaaatatcacacttcttttgtgctatattcgtttcattgattatgattgtcgtgatgtaaaagaagaattattattttgcattgaaatgcctactcaaataactggctttgaaatatttgaactaataaataaatatattgatagtaaatctctgaattggaaacattgtgttggtctctgtaccgatggggctgcaagcatgactggcaggtattctggtttaaaagcaaaaattcaagaagttgccatgaatacagcggcatttacacattgttttattcaccgtgaacgtttagtggcagaaaagttgtctccatgtttacataaaattcttttgcagtcagcacaaattttaagttttataaagagcaatgcattaaattcacgtatgttaacaattttgtgtgaagagatgggatctgagcatgtgagtttaccgcttcatgctgaagtacgttggatatcaagagggagaatgttaaaaagattatttgaattacgacatgagattgaaatatttttaagtcaaaagcattcagatttggccaagtattttcatgatgaggaatgggttggaaagctggcctacttatcagatatattttcacttataaatgaattaaatttaagtctccaaggaactttgactactttcttcaatttgtgtaataaaattgatgtatttaagagaaagttaaaaatgtggttgaagcgcacacaagagaatgattatgacatgttcccttcattttctgaattctcaaattcatcaggcttaaatatgacagacatcacaaggattatttttgagcacctggaaggactttctcaagtgttcagtgactgttttccaccagaacaagacttgcgttcaggaaatttgtggataattcacccttttatgaatcaccaaaataataatctcaccgacttcgaagaagaaaagctaacagagctatcttcagatttaggattacaagcactatttaaatcagtgtctgtaactcagttttggataaatgcaaagacaagttacccagaactccatgaaagggcaatgaaatttttattacccttttcaactgtttatttatgtgatgctgccttttcagctttgactgagtcaaaacaaaaaaatctgttgggttctggccctgccctaagacttgcagtcacatctttaattccaaggatagaaaaattagtgaaggagaaagagtagcaatatgcacattgcttaacagtgaagtcaataatcctgtgttaagttttgtataagtatcctaaaagataatttcctaatgtggatttgtgttttcagtgattaaatgttttaataatttttccctttttgttgaggaatttaataattatgattgttataaataattatgtataattataatctagggtagaaaatttagttatttcattaaatttggactagtgacaaagactgcaggtaatgagaagcccagtttataatgtaacagcacaacctggatgttgaaacagcttggcctttagaagcaagtggaacatttcagtcttctagccaaccagctacttacccctgcaaggttgtgagtaggtggaaaagatagatcttttttttgagatggagttttgctcttgttgcccaggctggagtgcaatggcgtgatcttggctcactggaacctctgcctcctaggttcaaacaattctcctgcctcagccttccaagtagctggggttacaggcatgtgccaccatgcccgtctattgtattttttttagtagagacggggtttcaccatattggtcaggctggtctctatctcctgacctcaagtgatccacctgcctcggcctcccaaagtgctgggattacaagtgtgagccaacgtgcccagctggaaaaagatagatctaagcagcttgggtaactataaatggaagcagcagggggatttgagacccctgcttggggcctttctggcccaatataccagggcttagcaaactttttaaataaagagccagatagtaaatattttcagctttgcaggccatactgtcacaactactcaattctgcagttgcagtgcaaaagcagccatagacaatatgcagataagtgtggctgtttttaaataaaacttattcatgaacactgaaaaaaaaaaaaaaaaa

SEQ ID NO: 1292 - DNA, 1810 bp, Homo sapiens
aggaagccgaggtctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtctgagtcagagatctgtgcacactttctaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctctatcctctaaggttggaactctgaagttggagaaggtggaataaagttacacctggaaaaaaaaaaaaaaaaaaaaaaaaaaaaaaaaa

SEQ ID NO: 1293 - DNA, 3083 bp, Homo sapiens
gcggaggcgcggagctaagcggctcggattatcctgggcagaccagagacttgaccagctaaacacttccgtcggtccggggcgtggacggggccagatcagcctcctgctctcccgagtcagggccacggaaaggcacaaatccatccgtgcgactcctggtacccagaccgggaggttgtctagtcacgcgcggtctgtgttgggcgagagctgaggagccggcgtccctgccaacgactcggccccgggacggtcaggagcctggggccctggtcccgcacctgtcttcgggcggacgcatccctcacggtctctccgcagcccgcgggtcctgcccccgcaggcagcgcgcgaacgtgggcgtggggatggccaccagtttccggacagcttcgtgctggggattattgtcattcaaggatatatctatggagttcacctgggatgaatggcagctactggattctacacagaagtacctgtacagagatgtgatattggaaaactatcataacctgatatcagtggggtatcatggtaccaagcctgacttaatcttcaagttggaacaaggagaagatccatggataataaatgccaaaatttccaggcagagctgtccagatggctgggaagaatggtaccagaacaatcaagatgagcttgagagtattgaaagaagctatgcttgtagtgtgttgggaagacttaatctgagcaaaacccatgattcttcaagacagagactctataacacacgtggaaaaagtttgacacaaaactcagctccaagcagaagttatttaagaaagaatcctgataagtttcatggttatgaagaaccatattttcttaagcatcaaagagctcatagcatagaaaaaaactgtgtgtgtagtgaatgtgggaaagcttttcgttgtaagtcacagctcattgtacatctcagaattcatacaggagagagaccttatgaatgcagtaaatgtgaaagagccttcagtgccaagtcaaaccttaatgctcatcagagagttcatacaggagaaaaaccctactcatgtagtgagtgcgagaaggtcttctctttcaggtcacagctcattgtccatcaggaaattcacacaggagggaaaccctatggctgcagtgaatgtgggaaagcctacagttggaaatcacagcttcttttacaccagagaagtcacacaggagtgaaaccgtatgaatgcagcgaatgtgggaaagcctttagtttgaagtctccattcgttgtacaccagagaactcatacaggagtgaaaccccataaatgcagtgaatgtgggaaagcctttaggagtaagtcctatctccttgttcacatccgaatgcatacaggagaaaaaccctatcaatgcagtgattgtgggaaagccttcaatatgaagacacaactcattgtacatcagggagttcacacaggaaataatccttatcaatgcggtgaatgtgggaaagcctttggtaggaaggaacagctcactgcacatctgagagctcatgcaggagagaagccctatggatgcagtgaatgtgggaaggctttcagcagcaagtcataccttgttatacataggagaacacacaccggagagagaccctatgaatgtagtttgtgtgagagagccttttgtggaaaatcacagctgattatacatcagagaactcattcaactgagaagccctatgaatgcaatgaatgtgaaaaagcctaccctaggaaggcatcacttcagatacaccagaaaactcattcgggagagaaaccttttaaatgcagtgaatgtggaaaagccttcactcagaagtcatctctcagtgaacatcagagagttcacaccggagagaaaccatggaaatgctctgaatgtgggaaatccttctgttggaattcagggcttcgtatacatcggaagactcataaatgagaaatcagaatgatgcaatgtgagaaactgatgttcaggagacttcggataatatagacaggatttacaagcaggaggccctaaaattacactcatgtcaaaaatcagagaggagagagaccaaccatatttgggatgagtgtaaaagctttcagaaataagttacaaatctttgtagatgaaaataatggaaggaatgtggagcaataaatgtatcaaatgttgtagtatcatcatgaagattcagagaatttacactaggaacaccttataagttgaataaattaaggaagcattttcccattgaaagtgtgttccatggaaagtcacattccagatttgaagctgtgtttttgtaaaataaaatcttggtatgaacagttgacttcatggtggagtataaagttgtttttttaaaaatatgtaaataatgttcaggaaaaacgcagggaacagagtcttaaagttaatggatatttaatgtgactttcctgagttaacactgaatagtatttctaaaattttttgtactttattttttaatgtaacttgttctatctatctatatatatatttgatagtttgtggaataatatcccccagtattttccatattaaatgctaattatcttttgatttctttttcataagcagatctggcatttattacagggctgccgcttaagagaactcattataatgaacgtttattatattttgcagttccatgcctgttgtccattgattgacatgagcacccctgttttctctggagaaatacctcccctctctggggtgcttcctgtggtagtgtctttcaggtatccgttccactagctacaggtgagcattttacccattgttggataatggtaatctctttttcagaattttgagtctgtaattcatttgtacatgaaccagaaaatgtgggaactcattcattcttgtcccagaattctgttgagaacatccattcattctggctaattgattacaagaataactgtggatacgatccctttagaacctgcttctctgatctgtgtgtttcctcacttctcaataaaaatgtcttttgcttttaaaaaaaaaaaaaaaaaaaaaaaa

SEQ ID NO: 1294 - DNA, 5611 bp, Homo sapiens
attgaggggggcggacgccgagggggtgaacacgagtgggaagctaagagagacacggggagggggaggggaccgggaaccatttgaatgagaggaggggatcacgggtagagtgggctccaggaggtagggcgagcagggtgtgacgggggccagactcttgagccagtacatatccagccatactcatggaccccagtgatttccccagtccatttgacccattgaccctgccagagaagcccctggctggagacctaccagtagacatggaatttggagaggatctactggaatcccagactgccccaactcgaggatgggccccccctggcccttctccatcctcgggagccctggacctgcttgatacccctgctggcctggaaaaagaccctggagtcctggatggagccactgagttgctggggctgggggggctgctctataaagccccctctcccccggaggtggaccacggtcctgagggaaccctggcatgggatgcaggagatcagaccctagagcctggaccagggggccagacccctgaggtggtaccacctgatccaggggctggggcaaattcctgttcacctgaggggctactagagcctttggctccagattctccaataacactgcagtccccacatattgaagaggaggagaccacctccatagctactgcaagaaggggctcccctgggcaggaggaggagcttccccaagggcagccacagagcccaaatgccccgcctagcccttcagtgggagagactctgggggatggaatcaacagttctcagaccaaacctgggggctctagcccccctgcacatccttccttgccaggagatggcctgactgcgaaggcgagtgagaagccgcctgaacggaagagaagcgagcgcgttaggagagcagaacctccaaaacctgaggttgtagattccactgagagcattccagtgtcagatgaggattctgatgccatggtagatgaccccaatgatgaggactttgtgccattccggccccggcgctctcctcgcatgtccctacgctcaagtgtgtcacaaagggccgggcgctctgcagtgggcaccaagatgacttgtgcacattgccggacaccactgcagaaggggcagactgcctatcagcgcaaggggctgcctcagctcttctgctcgtcatcctgcctcaccactttctccaagaagccctcgggcaaaaagacctgtaccttctgcaagaaggagatctggaacaccaaggactcggttgtggcgcagactggttctggaggctccttccatgagttctgcacatccgtctgtctctccctgtatgaggcccagcagcagcgcccgatcccccagtctggggatcccgccgacgctactcgctgcagcatatgccagaagactggagaggtcctgcacgaggtcagcaatggcagcgtggtacaccggctctgcagcgattcttgcttctccaaattccgggccaacaagggactgaaaaccaactgttgtgaccagtgtggggcttacatctacaccaagaccgggagtcctggccctgagctcctcttccacgagggccaacaaaagcggttctgcaacacaacctgcttgggggcgtacaagaagaaaaacacacgtgtgtacccatgtgtctggtgcaagaccctgtgtaagaactttgagatgctatcacatgtggatcgtaatggcaagaccagcttgttctgttccctgtgctgtaccacttcttacaaagtgaagcaggcagggctcactggccctccccgaccctgcagcttctgccgccgcagcctctctgacccctgttactacaacaaggttgaccgcacagtctaccagttctgcagccccagctgctggaccaagttccagcgcacaagccctgaggggggcattcacctgagctgtcactactgtcacagcctcttcagtggcaagcctgaggtcttggactggcaggaccaagtgttccagttctgctgccgtgattgctgtgaggacttcaagcggcttcggggtgtggtgtcccagtgtgagcactgtcggcaggagaaactcttgcatgagaaactccgattcagcggagtggagaaaagcttctgcagcgaaggctgtgtgctgctgtacaaacaggacttcactaagaagctgggcttgtgctgtatcacttgtacttactgctcccagacctgccagcgcggagtcaccgagcaactggatggcagcacctgggacttctgcagtgaggactgtaagagcaagtacctgctgtggtactgcaaggctgcccggtgccatgcgtgtaagcgccaggggaagctgctggagaccatccactggcgtgggcagatccgtcatttctgcaaccagcagtgtcttctgcgtttctatagccagcagaaccaacccaacctggatacccagagtgggcccgagagcctcctgaacagtcagtctcctgagtcaaaaccccagacaccctctcaaaccaaagtggagaacagcaacacagtgaggaccccagaggaaaatgggaatttgggcaagatccctgtgaagacccgatcagctcccactgctcccacccctccacccccaccacccccagcaacaccccgcaaaaacaaggctgccatgtgtaagccactgatgcagaatcggggcgtctcctgcaaggtggagatgaagtccaaaggaagtcaaacagaagagtggaagccacaggtgatcgtgctgcccatcccagtgcccatcttcgtgccagtgcctatgcatctgtactgccagaaagtcccggtgcctttctcgatgcctatcccggtgcctgtgcccatgttcttgcccactaccttggagagcacagacaagattgtagagaccattgaggagctgaaggtgaagatcccttccaaccccttggaggccgacatcctggctatggcagaaatgattgcagaggctgaggagttagacaaggcctcatctgacctttgtgatcttgtgagcaaccagagtgcagagggactcctggaagactgtgacctgtttgggcctgctcgagatgatgtcctggccatggcagtcaagatggccaatgtcttggatgagcctgggcaagacttggaggcagacttccctaagaatcctctggacattaatcccagtgtagacttcctctttgattgtggcctggtagggcctgaggatgtgtctactgaacaagaccttccccgaaccatgaggaagggtcaaaagcggctggtgctttccgaaagctgctcccgggactccatgagcagtcagcctagttgtaccgggctcaactattcatatggtgtcaatgcttggaagtgctgggtgcagtcaaaatatgccaatggagaaaccagcaagggtgatgagctgcgctttggccccaaacccatgcgtatcaaagaggatattctcgcctgctcagctgctgagctcaactacggtctggcccagtttgtgagagaaatcactcggcccaatggtgaacgatatgaacctgacagtatctactatttgtgtcttggcatccagcagtacttgctggaaaataaccggatggtgaacattttcacggacctttactacctgacttttgttcaagaactcaacaagtctctgagtacctggcagcccacactcctccccaacaatacggtgttctctcgagtggaggaggagcacctctgggagtgtaagcaactgggggtctactcgccctttgtcctcctcaacaccctcatgttcttcaacactaagttttttgggctgcagacagctgaggaacacatgcaactctccttcaccaatgtggtgcggcagtcccgcaagtgtaccacccctcggggcaccaccaaggtggtgagcatccgctactatgccccagtccgccagaggaaagggcgagacacgggtcctggaaaacggaagagagaagatgaagcccctatcttagagcagcgtgagaaccgcatgaatcccctccgctgccctgtcaagttctatgaattctatctctcaaaatgtcctgaaagcctccggactcgcaacgatgtgttctacctgcaacctgaacggtcctgcatcgccgagtcacctctctggtattctgtgatccccatggaccgcagcatgttggagagcatgctcaatcgcatcctggctgtgcgcgagatttatgaggaactgggtcgtcctggggaggaagacctggactgagctcgtgtgccatccatatccatctttcacatcaatgtctgtcctgtggccatgtccctcagggtgacaggcccaggaaccaatgctactcattctgaagggccctgactgctcctttccgctcacccattccctgccttctctaggaaccctggcttttatcttcttccgtaccacttgacaaccatggggccctggtcttctgtactcaggggctggtctcccagtgatgggcaaaagccagcttgcccgttttctttatgcttcagagtaaacccctccttctgggtccagactctgggtggagtgttaatagctctggtgatcctgttggctttgggtttcctgacccatcccgcataggtagagcctcttgttcctaggcatgacctagggaaaaacccagctgccttctctgccctgtgcccactcccttctctactcttccccagcaccatgccaaaaggtcttatctgaaaggtaagaaataaacaatgaaagcgatgaggggaccatttacataaaacacagagcttagacactcttcccctcctatgaaataattggttgttggcaccatctcaccaccgcatatccctcaccccctcggcaagcaccaatccttggtgctgccgtttttaaaatcttccaaatgcctttttttcctcagaggcagagaatgactaagtacggggagcagactcctgttgtgcagactcctgtccccttggtttctgtgtttgtctctctgccatcttaggttgccatgagccatggtgtcaacatgcttagccccctctgtaactgcctccctttagttcaatggacagacctcccaaggcaaaaactaccttctgacttgggttgaggctgggttcccctctattgttcccctatcataagagctaggccaagcctatgggaccttgagtcatgcaggatgggatctgtggtcaaaggacaggcgaggagctgtgggcgcagggcctgccgccactgcctacatcttctctcttccccatcttgcattggaggtcccagaaaacaattagcttctggcaaagggggtacccacttctttccctgttgactttgctgtttcccaggctcctttttgtgtttttataactgtcaccagttagccactgtttaaattgtatatattgttctgaggcgcctggcctgtcccttcagtgagccatgcccacccttgtgttgtagtgagaagctgttgtcacgactaaccttctgtctctgaaattgtttgtttcaaataaagagttaaaattgtcaaaaaaaaaaaaaaaaaa

SEQ ID NO: 1295 - DNA, 7011 bp, Homo sapiens
agtgtgggcgggggccggggggccgagaggtaccgccgccaccgcgcggggagccgcagcggttccgagcggggcccaacatggcggagagagaggtggagtccggcccccgaaagaggtttgaacaaaaaagtggtgcagtttttgatgaaattgtagagaactgtggtggtatcatggatacagaaatgtctgaagatatagaccacaacttaactcctacccttgacagcatgtcttatggaatgccgaatcaaacaggatctgaaaattcattgctggatgaagatgattattttttgaactctggggatcttgcaggaattccagtcgttggtagtgacaatgaggatgaacaggattttagttcaaaggacaatcttgtttcttcaattcatactgatgatagcttggaagtagagagaagagtcacacagcatgaatcagacaatgaaaatgaaatacaaattcaaaataagttaaaaaaagactttcctaaacaatttgatcaggtttctgtctttaaatcaatacggaaagattttagtctagtaagagaaaacagcaaagagacattttctggaaaggagaaaaatagagacctaacttatgaacgtgaaaaacggttggataaaccccataaagatttggattcaaggttgaaaagcagtttttttgataaagcagctaatcaagttgaagaaacattacatacccatttaccacaaaccccagaaacaaactttagggattccagctacccatttgccaataaagaatccattggttcggaactggggaattcctttgcatcaaatattagaattaaagaagaacctttggatgatgagtatgacaaagcaatggcaccacagcagggactactagacaaaataaaagatgaacctgacaatgctcaagagtatagtcatggccaacagcaaaaaactcaagagggggaactgaaaattagtgctgtgttttcagtcagtggcagccctcttgctccacagttgactactggctttcagccctcactggcgtcatctggcatgaataaaatgcttccttcagttccagccacagctgttcgagtttcctgttctggttgtaaaaaaatcctccagaaggggcaaactgcttatcagaggaaagggtctactcagctattctgctccacactgtgcctcactggatatacagttccacctgcccgcccaccgcctcctctcaccaagaaaacttgttcaagttgctcaaaagacattttaaatccaaaggatgtgatcagtgcccagtttgaaaacaccaccactagtaaagatttttgcagtcagtcatgtttgtcaacatatgaactgaaaaaaaaacctattgttaccataaatacaaatagtatttcaaccaaatgcagcatgtgtcagaagaatgctgttattcgacatgaagttaattaccagaatgtggtccataaactttgcagtgatgcctgcttctctaagtttcgttctgctaacaacctcaccatgaactgttgtgagaactgtgggggttactgttacagtgggtcgggacaatgccacatgcttcagatagagggacagtctaagaagttttgtagttcatcgtgtatcacggcatacaagcagaaatcagccaaaattacaccgtgtgcgctttgcaaatcattgagatcctcagcagaaatgattgaaaataccaatagcttggggaagacagagcttttctgttctgttaattgcttatctgcttacagagttaaaatggttacttctgcaggtgtacaagttcagtgtaacagttgtaaaacctcagcaattcctcagtatcacctagccatgtcagatggaagtatacgcaacttctgcagctacagctgtgtggtagctttccagaatttattcaacaaaccaactggaatgaattcttcagtagtgcccttgtctcagggccaagtaattgtaagcatccccacaggttccacagtgtcagccggaggaggtagcacatctgctgtttctcccacctccatcagtagctctgctgcagctggtctccagcgtctcgctgcccagtcccagcatgttgggtttgcacgaagtgttgtgaaactcaaatgtcaacactgtaaccgtctttttgccacaaaaccagaacttcttgactataagggcaaaatgtttcagttctgtggcaagaattgttctgatgaatataagaaaataaataatgtaatggcaatgtgtgaatattgtaaaattgagaaaattgtaaaggagactgttcggttctcaggtgctgacaagtcattctgtagtgaaggttgcaaattgctttataaacatgacttggcaaaacgctggggaaatcactgtaaaatgtgcagttattgtttacagacatctcccaaattggtacagaataatttaggagggaaagtggaagagttctgttgtgaagaatgcatgtccaaatatacagttttgttctatcagatggccaaatgtgatgcttgtaagcgacagggtaaactcagtgagtccttgaaatggcgaggggaaatgaaacatttctgtaacctgctttgtatcttgatgttctgtaatcagcaaagtgtatgtgacccgccttcacaaaataatgcagcaaatatttccatggttcaagctgcttcagcaggacccccatctctgagaaaagattcgactccagttatagccaatgtagtatcattggcaagtgcccctgctgctcagcctacagtgaattctaacagtgtcttacaaggtgcagttccaacagtaacagcgaaaatcatcggtgatgcaagtactcaaacagatgccctgaaactgccaccttcccaacctccaaggcttttgaagaacaaagctttattatgcaaacccatcacacagactaaagccacctcttgcaaaccacatacccaaaacaaagaatgccagacagaagacactccaagtcagccccagattattgtggtgccagttcccgtaccagtgtttgttcccatacctcttcacctttatactcaatatgctccagtcccatttggaattccagttccaatgcctgtccctatgcttattccatcttcaatggatagtgaagataaagtcacagagagtattgaagacattaaagaaaagcttcccacacatccatttgaagctgatctccttgagatggcagaaatgattgcagaagatgaagagaagaagactctatctcagggagagtcccaaacttctgaacacgaactctttctagacaccaagatatttgaaaaagaccaaggaagtacatacagtggtgatcttgaatcagaggcagtatctactccacatagctgggaggaagagctgaatcactatgccttaaagtcaaatgctgtgcaagaggctgattcagaattgaagcagttctcaaaaggggaaactgaacaggacctggaagcagattttccatcagactcctttgacccacttaataaaggacagggaatccaggcacgttcccgaacaagacgacgacacagagatggcttcccccaacccagacgaagaggacggaagaagtctatagtggctgtggagcccaggagtcttattcaaggagcctttcaaggctgctcagtgtccgggatgacactgaaatacatgtatggggtaaatgcttggaagaactgggttcagtggaaaaatgccaaggaagagcagggggatctaaaatgtggaggggttgaacaggcctcatctagcccacgttctgaccccttaggaagtactcaagaccatgcactctctcaagaatcctcagagccaggctgtagagtccgctctatcaagctgaaggaagacattctgtcctgcacttttgctgagttgagtttgggcttatgccagtttatccaagaggtgcggagaccaaatggtgaaaaatatgatccagacagtatcttatacttgtgccttggaattcaacagtacctgtttgaaaatggtagaatagataacatttttactgagccctattccagatttatgattgaacttaccaaactcttgaaaatatgggaacctacaatacttcctaatggttacatgttctctcgcattgaggaagagcatttgtgggagtgcaaacagctgggcgcttactcaccaatcgtccttttaaacaccctccttttcttcaataccaaatacttccaactaaagaatgttactgagcacttgaagctttcctttgcccatgtgatgagacggaccaggactctgaagtacagtaccaagatgacatatctgaggttcttcccacctttacagaagcaggagtcagaaccagataaactgactgttggcaagaggaaacgaaatgaagatgatgaggttccagtgggggtggagatggcagagaatactgacaatccactaagatgcccagtccgactttatgagttttacctgtcaaaatgttctgaaagtgtgaagcaaaggaatgatgtgttttaccttcaacctgagcgctcctgtgtcccgaatagccccatgtggtactccacattcccgatagaccctggaaccctggacaccatgttaacacgtattctcatggtgagggaggtacatgaagaacttgccaaagccaaatctgaagactctgatgttgaattatcagattaaaacggaagtgaggttcttattttcatacatattggtatgcaccaaactgtgaatgcatccagctgttggaaaatgatgtataagtctaagtcctcttgacttgaccataagatcatggaaaacagatgacttgtgaaccccacagtgtggatgtgcaaatgaaaattgaaggaaagaatatgaactgagaaatgttctttggcagtgatatagttcttagacatcttcagaatgactaatttctccgagtggtgcataatcttattttgtttgggagtaacaaatcgtggaatatttttaaggaaaactgttgtataaaactttaccatagtaaccttagaccttagagaggtagctttggagtgaaactttggctgcaataggctactttggcaagccctccgtaaaagtcagaggagagatcagtacagagctaagagtgacatcaaatgaggactgtgggacccagatttgaagacccaataaaaatactcaactttttaaaaaagatagtgaagtggtcttgattgattttgattttcactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttattttcattttttttccccaatggcagcttttctcccgttgttttaccttcctatttcccaaacagttcctcttattttgtcttttgcaccagtttctggaggcccttgtcatttcaaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatccataagcaggtcttagagcattattccaaactctagctgtttcagtagttctatgaggattgcaagtcataggtgtgtgtggcatatcagtccatctccctcatctccattctcagtttcttccccacaaaatttggaatcaaagcttttatgacgtttgccaattgcagaacttcttcagctaaggttaatttgacgctatgataaaactgagagatgtcaaaaagcctcttagaaattttaatcttgaaagacttttcagggtatctcattttttaggtgggggtggcaggtgtatttcttttttaacaaataaaaggcatttaagtaaaactaaaatgaaaaaagtaggccttctgacattgtgtacttggtggttctgtccctctgcctgtaacaaatctcatttttgttaccaagaactgtatgaaagaagtaaatccaccccgattctgtatgattaattccatctgtgtttgtcatttctgactggaaaacttcttactccataccttgttcgatatggaggacaaataattggattgtctgataagtctgccaataaactatccagaaatagcaagtgtaatagtccccactatacgaattttatggtttgtataaacactaacattttccccttctgtagttgtatgaaaaaacaaatattgttagcatagtagataaattgttatgaaataccagaaaaaaaaatctgtatcttttactgagaacacccaatacccagataaatgactgtatcaggatttcatttgcatgttagtccacagagttgcccagaaccctaaatttattcataagagaaaatattgattaattattggtcattcctcataagtgtagctgttgatgtgtgcgtctgattattgcttttttaattttatgaaaattgtgtaaaattacattttttttccaggggagaaaaaaacatcaaacaaaaacatctaaatcatcctttttgttctttttcagtttttaaccacttttaggttttccccttacagaaaccacagaaatattcccttagaataaaatagtatatttgtatttgaaaaaaaaaaaaaaaaaa

SEQ ID NO: 1296 - DNA, 3305 bp, Homo sapiens
gcctaacttgcgcgctgagatttccggcgtgggagcagaggtctgagtcttgcgtgggtcctctatatagggtgagaagcgtggcgctcggttcctgcctcggggaagtcctggcgcagatgggccacggggccggcgtggcggcgcctgggaccgactgaggcctaggcgccggagccggccgcgcctgggctggagcggggctcctcggcctggactgggagcccccggccccgggctcctgctggcgccgtccaaccttacatgggttcagggcgccttcgtaggcgggcacggctggtttcgggctaaggcgctctggagacctgacgatggcgtcgggcccgggctcccaggaacgggaagggctcctgatagtgaagctggaggaggactgcgcctggagccaggagctgcccccacctgacccaggaccgagccccgaggcctcccacttgcgcttcagacggttccgcttccaagaggcagctggtccccgggaagccctcagccggctccaagagctttgccatgggtggcttcggcctgagatgcgcacgaaggagcagatcttggagctgctggtgttagagcagttcctgaccatcctgccccaggagatccagagcagggtgcaggagctgcatccggagagcggcgaagaagcggtgacccttgtggaggatatgcagagagagcttgggagactgagacaacaggtcacaaaccatgggcggggaacagaagtgcttttggaggagcctttgcctctggaaacagcacgagagtcaccgagcttcaagctggagccaatggagactgagcgaagccctggccccaggctgcaggagctgctaggccccagcccccaaagggacccccaggctgtaaaggagagggcattatctgctccctggctttctctttttcctcctgaagggaacatggaagacaaggagatgactgggccccagttgcctgagagcttagaggacgtggcaatgtacatctcccaggaggagtgggggcatcaggatcctagtaagagggccctctccagggacacggtgcaggagagttatgagaatgtggactcactggagtctcacattcccagtcaggaggtcccaggcacccaggtgggacaaggaggaaagctatgggatcccagtgtccagagctgcaaggagggcctgagccccagaggcccagctccaggagaagagaaatttgagaacctggaaggtgttccgtctgtatgctctgagaacatccaccctcaggtgctgcttcctgaccaggcccgaggggaggtgccctggagtcctgagctgggaagacctcatgaccggtcgcaaggggattgggcgcctcccccagagggtggaatggagcaggccttggcaggagcctcaagtggcagagaactggggcgaccgaaggaactgcagccaaagaaactccatttatgtcccttgtgtggcaaaaatttctctaacaactcaaacctaattaggcaccagagaatacatgcagctgaaagactgtgtatgggtgtggactgcactgaaatctttggtgggaacccacgtttcctgtcactacacagagcacacctgggagaggaggcccacaagtgccttgaatgtgggaaatgcttcagtcagaacacccatctgactcgccaccaacgcacccacacgggtgagaagccctatcagtgcaacatttgcggaaaatgtttctcctgcaactccaacctccacaggcaccagagaacgcacactggggagaagccctacaagtgccctgagtgtggggagatctttgctcacagttccaacctccttcggcaccagagaattcacactggagagcgaccttataagtgtcccgagtgtgggaaaagtttctctcggagttcacacctcgtcattcacgaaagaactcatgagagagagagactttaccccttctctgagtgtggggaagctgtgagtgacagcaccccctttcttacaaaccatggagcccataaggcagagaagaagctctttgaatgtttgacttgtgggaaaagcttccggcagggcatgcacctcaccagacatcagagaacacacacaggagagaaaccgtataaatgtaccctttgtggggaaaacttctctcatagatccaatttaatcaggcaccagagaatccacacaggagaaaaaccctatacctgtcatgagtgcggagacagcttctctcacagctccaatcggattcgccacctgagaacgcatacgggagagagaccctataaatgttctgaatgtggagaaagcttctctcggagttcccgtcttatgagtcatcagagaactcacacaggttagtaacagtggggtttctctttgccccaggtgaggtggcatattcagaggagcctgttggcaagagctggtattccctgcccagccgaccaaatgacctctgcattcttcaggtaatgggggctcattgtgagggaggtgcagaggcagcagaggattggcataaaactgaaaaggagttctgtctgcatgagaaaggatggcaagtctctgaggtgacctcagggtggaattctctgttaagtccaccctgccccagggtgctcctaccctcttggtctttttaaagccaaggtgcgatttgggcacctgactgtccagtttaccttaacaagtttgggaatccatgtgatgtttttgatacttcttcctcatttgggacattcagtaggagcatttgggcttccggggcccctgagaccaaagaagaggggccaagtaccctgggaaatcagctgaaggtcaacaaaagactggttgtgagttgcagctgtcccgaaggccccagttgggaagccatgggcagtccagatcaagccaccacgtgccctacgatggcctaacaggagtgcccattggcagattacacatgtaaatatgacctcagacaaaaaggaaccagaggcccaagggcaataataaggtggaatttgcaggtcagcccaggaattggcagaggaagtaggtgtctgataaccctttgtggagaatgagattccccccacctgtgtgagaaaaataaacagctctggagtcttgttcctgactccagaggaacgagagcattccaggaaagagagattccctggaaaattgaaaatgtgaatcctagggggaaattggggattgtgtctttccctgttgaaaatgtttggatgggaataaatatcttcaggaaacataaaaaaaaaaaaaaaaaaaaaa

SEQ ID NO: 1297 - DNA, 12172 bp, Homo sapiens
attttcttctgcacttctgtctggagaggtctgtagccactgagggccccggtcggggccgctttgcaggtccctagtcaggaccgagcaggggagtaggataggaatccccgccgcacctttgtacgagcctgaccccttccgtgggtttgttcctgggtcgccgtcaagctgcggtctctcctcccccgcccttcagccccgcggtctccaggggcggcgccctgggtctggaacgcggttgccaccgaggaggcggcggccctgcgtctggaacgccgttgccaccgaggaggcggcggccccgagcgcgcctggaagccccgggcaaccggccagggtcgggcacaggtggggtccgtcaggccgcccggggctcctctgtcccagctctgcggcccagggggtgacgtgatggcggcagcggtgctgacggaccgggcccaggtgtctgtgacctttgatgatgtggctgtgactttcaccaaggaggagtgggggcagctggacctagctcagcggaccctgtaccaggaggtgatgctggaaaactgtgggctcctggtgtctctggggtgtcctgttcccaaagctgagctgatctgccacctagagcatgggcaggagccatggaccaggaaggaagacctctcccaagacacctgtccaggcgacaaaggaaaacctaagaccacagaacctaccacttgtgagccagccttgtcagagggaatctcacttcagggacaagtgacacaaggaaactcagtggactcacagttggggcaagccgaggatcaggatgggctatcagaaatgcaggaaggacacttcagaccaggaatagatccccaggagaagtctcctgggaagatgagccctgaatgtgatggtttagggacagctgatggtgtgtgttcaaggattggacaggagcaagtctctccaggagatagagtccgtagccataactcatgtgagtcaggtaaagatcccatgattcaggaagaggaaaataactttaaatgcagtgaatgtggaaaagtatttaacaagaaacacctccttgctggacatgagaaaattcactctggagttaagccctatgaatgcacagaatgtgggaaaacctttattaagagcacacatctcctgcaacatcacatgatccacactggggagaggccctatgagtgcatggagtgtggaaaggccttcaaccgcaagtcataccttacccagcaccagcggattcacagtggagagaagccttacaagtgcaatgaatgcggaaaggccttcacccaccgctccaattttgtcttgcataacaggagacacactggagaaaaatcctttgtgtgcacagaatgtggccaagtctttcgacataggccaggctttctccggcactatgttgtccacagtggtgagaatccctatgagtgcttggagtgtggcaaggtcttcaaacacaggtcatatctcatgtggcaccagcagactcataccggggagaagccctatgagtgcagtgaatgtgggaaggtcttcttggagagtgcagccctgattcaccactatgtcatccacactggagagaagccctttgagtgcctcgagtgtgggaaggctttcaaccaccgatcctacctcaagaggcaccagcggattcacactggggagaagcccttcgtgtgcagtgaatgtggaaaggccttcacccactgctctacttttatcttgcataaaagggcccacactggagaaaagcctttcgagtgcaaagagtgtgggaaagcctttagcaatcggaaggacctcattcgccacttcagcatccacactggagagaagccctatgagtgcgtggagtgtggaaaggccttcacccgcatgtcgggcctcacgaggcacaagcggattcatagtggagagaagccctatgaatgtgttgagtgtgggaaatcgttttgctggagcacaaacctcattcgacatgccattatccacactggagagaagccctataaatgtagtgaatgtggaaaggccttcagtcgcagctcgtccctcactcagcatcaaaggatgcatactgggaaaaatcccatcagtgtaacagatgtgggaagaccttttacaagtggacaaacctcagttacccttcgagaacttcttttagggaaggactttttgaatgtaaccactgaggcaaatattttgccagaggaaacatcttcctctgcatctgatcaaccataccaaagagaaaccccacaagtgtcttcactgtgagaaaaccttctgttgctgaatattacttgtcatctgaagagtcatattagaaattcgttcagtctagagccttattctccatctgataatttatcctggagagagacccagtggttattgtgcacataggagaaccttcagctgcatctttctccttagtttacagtgcaattttatctcaggaattatttttaaaaggaggaggggacatagaaaaaatgaaatgcaagcacacatcttttcaggcttctctgccaagcctatggcgctttgtcatggatttcttagtgtatttgggggaagggaaatgtttcaaggtaaagaaccttgaccctttatgtgcttgtatgtacatttattgctatccagtgtcagaacagttagtttaggaaaagtatgcaaactttaatcgcacatcttctgtattccacaatagtacttactcttgagaagcataactttatgacaacttagggggcttgagccatgaaatactcacgtttaagtcagtaaggatacacatgttaacattcaggcttttgtcttgatgcccgtcttttggtttacgtcatcattgtagccatatggtaaatttttatttgttaaatttttaaaaattacttagctcaaaatgtcagtggtaaatttttaaattgagtaaagtgattcttctttgctcttatttaaaatcgacagcatttctagttcctttgacattccatataatttttaggattagtttgtacttatttacaaaacagtcttgttcagatttttacagaaattgagttaagtctgtggattaatctgttaagaattggtatctttactatgttgggtcttgtagttcatgagtgcaggagtaggcctcttaatttataatagttaagcattccttaaagtatttcattaatgttaaaaattttcagcgtatagatccctatgcatttttgttagaatttgcatcctagggtgcttttttgtttgtgtgtgtgtgtaatttgagtgattgtaaatggcattgatgtttgaactttgaattgcacacaatttttggtagtatacagaaatataatatttttggacattgttttgctaccctgcaaccttattgagttcacttattatttttagctatttctttcgacagaatccttggaattttctatatagaaatgtcatctgcaaatacagaccattttttatctttcatcttacctgtaatataccttttatttcctttttgtttgtcttattgcattgcacaagctgggacttccattatagcgttgaataggaatagtgagaaaggccatccttacctggttcctgatagtaggggggacaatgttcagttttttgtttttttgttttttgtttgagacagggtctcgctctgtcacccaggctggagtgcagtggcacgatcttgtctcaccatagccttaagttcctgggctcaagtgatccccccacctcagccctcaccaccccccagtagctggtactacaagcatgcaccaccagtcccagctaatttttgtattttttggtagagacagggtttcaccatggtgcccaggctggtcttgaactcctgggctcaagcaacctgcttgcctgggtctcccaaagtgctgggattacaggcgtgagccacagtgcacagcatgttcagtttttcatcatgaagtataatgtaagttttataaaacatatgtcctctataagggtaaaaaatttcctctgttcccagttttctgagactctgtgttgctatgaataagtgtggaattttgttcagtactttttctccaccagttgatgtcattatgctattttccttctacatcctattgatggaatgtattgctttgatcaagttttgaatattgagccagccttgcatccttagaataaaccatacttgtttgtagagtataattgtttttatatatcatttgacatcattccctttgtttgtattttgttgaggaaatattcctctaatttattggctaataatgtgtagttcttttttcttttgtttcttatgttctaaatgtcttatgtgtggttttgatgtctaggtgatcttgacctttcaacatgaattggaaggagttctcttctaatttttggaagactgtgtagaattggtgttatttgttcttgtcatgtttgatgacctctagtcaaccattgggccagagatttttcttctggaggcttttaaattacatatttattttattggataggtagaactattcgaagtatctatttcttgtgtaataaattttgatagtctgtcctgttgaaggaatatttcatctgtatttgtagcactcccttattcttttgatagcaggatctgcacttctttttatttttaatatttaaaatgtgcatactcattttatgattgagtcttcttagacatttatcagttttattgcgcatcatgctgaaagatgtaatttttgcttcatctctcacttcagagaactagcactttatattaatgatttgtctctattcttgatttctttgatttctgctctgatcggtattatattccacttgctttggttgtatttggctctttctaacttttcaaggtggggttttagattattgatttgagatttttttgcttttttaatgtaagcattacattgtataaatttacctcatatcactattggtttgatcccacaagttttaatgttttcattacattttaattctaatagtttttattttttgagacattctctcttagccatgaattatttaatagtatgcttaattttctggtgtttggcatatttgttactgatttctaatttgttccatgtttgatctgactgtttaaatgtgttaacatttttttatgacccaggatagggtctatcttgtttcgtatagctgcttgaaaagaatgggtgttctgctgttactgggtggagtttctataaatgtctctatgatcctgctcattgttattcaagtcagctatgtccttgctgattttctgtccagcatttctgtcagttgctgagaggggtgttgaagtcctgaacataggccgggtgcagtggctcacgcctgtaatcctagcactttgagaccactaaggcaggtggatcacctgaggccaggagttcgagaccagcctggccaacatggcaaaaccctgtctactaaaaatacaaaaattagccaggcatggtggcgtgtgcctgtaatcccagctgctggggggctgaggcaggaggatcagttgaacgtgggaggcagaggttgcagtgagctgagatctcaccactgcactccagcctgggcaacagagcgagactctgtctcaacaacaacaacaaaaagtcctgaacatgattgtggaagtgtgttgctctttcaagttctatcactttttgtttgcaaagttcaaagctgtattgtttggtacatatacatgtaggtttgccaagtctttgtggtgaattgactcttctgtcattatgtgatgtcatttttttgccttttaatagtcttgtcaatactttacctgatgttctcatagtgactcctgcatattttgattaatgtttgcatggttaatatttcttcattttattttaaagcttacctgtatcattacttatgaagtcagtttctttgaacagcatatactcaggccatgctttttttattcattctgcatatgtctctcttaattggtatgttgaaatgatttacattaaaataattattgatattttagggcttaagtgtgcccttaaatgatttttgtgttcttttttattgttcctctgttatttggggttgtttactagtcttcctataggttacttcaccttttttttttttaataatttgatttgatacatatgtagtgttttttagtatagatcctccttgacttatgatggggttatgtcacaataaacccattgcaagttgaaaatactatgtcaaatatgcatttaatacacctaccctgctgaacatcatagccgatcttgccttcagaatgctcagaaaatttacattagcctgcagttgggcaaaatcatctaacacaaggcctactttataataaagttactgcaaagaattttaaataaaaattcaagtgtggtttctactgaatgcatgtcgcattcgcaccattgtaaagtcaagtagtaagtcgaaccatcctaagtcagggactgtctgtatatatctgcattttttagtgattgttctactattacagtgtaaatatataacttatgacagtttaataagttatcagcaatttagcactttacttccattaggttcctttagcttacctactaatgtaactatcttaagtaatagtaattcctcttcaaaaattgagcgctatgttgcaagatgtaatttttcttttccttttttttgagaccaagtctcactctgtcacccacgctggagtgctgtgatgcgatctcggctctctgcaacctctgcctcccgggttcaagcaattaactgcctcagcttccctagtaatggattacaggcgcccgccaccacgcctggctaatttttgtatttttagtagagacggggtttcaccatcttggccaggttggtcttgaactcttgacctcatgatccacccgcctcggccccccaaagtgctggggttacaggtgtgagccactgcacccggccacaagatgtaatttttactttatctctcacacgtattttacaaaacgtcatgagaaacattgtctcttgaccttttttttttttttttttttttaaagagacagagtctcactctgtcacccaggctggagtgcagtggcacgatcttggctcactgcaacctccgcctcctgggttcaagcgattctcctgcctcagcctcctgagtagctgggattacaggtgtgcgccgccacacccagctaattttgtatttttagtagagacggggtttcaccatgttgctcaggctggtctcaaactcctgaccttgtgatccgccaaccttggcctgtcgacctctttacccattccattgttcattcttctttcttgaaatcccaaaccttctattaacatttcttttcagttatacactgaactttactgtagcctttcttctagagtaacaaatgttctttgttttccttcctctaaagatgtctttatgtttccttcattcccaaagaatatttttgtggaatataagattcagagttggcagttgttttcttttagacttcagagatgtatctctctgttctgtacattattgtttaatataagaaacctactagcattcaaataatcattccctattttacaatgcatcagttctgtcaagcttcattcaaagtgtttttcattgtctctagtgttcagaagtttggctgtgatgtgcgtggcatggaagtttttgggtgtattctatttggcgctccctggtgcttgcccagctttttgatctgtaggattatgccttttgcaaaatttggggaactttcaactattatttcttcaaatattttttcaccccccagtcttgtcttttttagggacttcaataacatgagtggcagatcttgttttacactcccatgggtccttcaggctctcatcttttttctttttccagtctattttctgtcttgttaatattgattaatttttattgaccttccatggtcctcactgattgttttctttgtcatacctaatctgttgagtttgtgcagtgagttttcattttggttttgtattttccagttgtttaatttccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaatgtttgtaaaattccctagctctctgcactgagctgagatcgtgccactgcactccagcctgggcaacagagcgagactccatctcaaaaaaaaaaaaaattctctagctctctatgccttgttgtatcctcaggaaggagtcacctctcttccaggatcactcttgccttttgttattggacacattttcctacctcctgcccagtcttttttaggctctctgtcatacttcctcgcctagtctttaacttgtctctgataaccagatttttcccccataatctgtatctgtattcaagtctctatcctcatccccaaatggatttcaccccgcttgtccatcagtctctgcccatttcttctgtctcccacagacatggtctgtgtagttgttctgcacactacccgtcctcgccccttctcatttccctcactccacggacagctacaggagggcttccatcatttgtcctcttacttccttgttagaactttgtgctgctgaccaccactctgaaccaaaacttctttcttggttcttgaaagttgctgtctttctcctccagagggtctgtgtcttccttccaactcttaaacatttttgtttcccagaatccatcattggccattgctttttcacttgccatgagctctgtgaatgagatggttcctgctgaagacatttactttcaatgatctacagaatttcccaaatctatgtctccagactggatgtttctcacgtctgtggcccactgggcatcttctgcactttctctgcatttgtaaacactgagcctgtatgcgtgtctatgtggccatggccctggccgtggggatgcacccataattataatgagagcaggtgaatgtcatgtggctatgtatgagacattgttgtgaatgttttacatgcatcagctctttcaacatttacagcatctgtgtgtggtaggtaatgttgtttccttcattttgcagagcagaatatagataggctcaggttaagaatttgcccaaggttacacagttatgaagtttggatttaggaatgggaggccacgtagactggcttcagaattcatgtctttaaccactttattgcttctcatgttggggggtttgttttctggtcactatttttactaaagttgattcaacaatgctataatctgttactctcattcgacaatacatcttgactgtttcttcaacttgaggaaggtaaaccaaagccactctttaatgggtgcaaatatctgttgtaactatgtagaagatacagtgtctgggtttgaggacaggggagtgggaaaactgagtagggaagcggtaagacatgcatctggctttaggagtgtttgaagtgcctaaagatcagggtgaatttcccaaatttgaatcttgttgcccaagccacattgcaaccacctctttttctcttacctcgtccccacatccaggcactgccccattctgttcattccacctttttttttagtagaccctccatatatgtgtgtgttttggtgaatggccacacacagcaaagttatttttattgcaattttgttgttgttgtttgagacacagagtctcatactctgccacccagactgaagtgcagtggtgcgatctcagttcactgcaacctccatccccccatgttcaagcaattctcctgcctcagcctcccaagtagctgggattacaggcatgggccaccatgcccggctaatttttgtattttttgtagacacggggtttcaccatgttggccaggctggtctcacactcctgacctcaggtgatccacccgcctcggcctcccgaagtgctggcattacaggcatgagccaccacacccagcctttattgcaatttttggttccctcacagaatgtttaccatgaagctgtgcgtataggtggtaccatgtatgacataccttgacctcaaagataatctacctgggctttttttgtttgtttgttttgagatggagtctcactctgtcacccatgctggtgtgcagtggcgtgatcttggctcacagcagcctctgcctcccgggttcaagcgattctcctgcctcagcctcctgagtagctgggactacaggtgcctgcgaccacacccagctaatttttgtatttttagtagtagtgggatttcaccatgttggccaggatggcctccacctcctgacttcatgatccacccgcctcggcctcccaaagtgctgggattacaggcgtgagccaccgcacctggcctacctgggcttttttggacagatgtacatgattttagaaattgttatgaatgactgtcttgggatcctcaagaacacccccaggtttgacgatttgctgagaagactcaggtctcagcattctgtcatactcaacagctatgatttactgcagcaaaaaaatacaaagcaaatagtaaagggaaaaagccaaaattcagagaaaaccaggcacaatcttctgagtcttgtttcagtgaagtcacaggatgtgccttatttaagttccatctggtacttatgacaacacatgctatatgtccactgggaagcttattagagactcagtgccagggtttttattgggcatgttttctagcacatcccacaattctggacttccagaaggttagcaggggttcagcttttcagctgaaaacgttatccccctttcagctggggggaaaaaaaggcaccgaaaaacagggcagtgagctactcctgttttgggtgggtggagcagtagtaagcctcccaaaatctaaggtcccacactccagcaagggtgaaccttgcaaactcaaaaggatagcagtctccaacctgctgttttatacagtgacttaagtggtactaaaatgctatataagtcaaatttacgtaacattaagcaaataattttttttcagcaaaaaaataatggtcatgactttgtggtgaaggcttatgtaatgattgtaataaattcaggtggctcacgcctgtgataccagcacttttgggaggctgaggcgggtggatcacttgaggtcaggagtttgagaccagcctagccaacatggtgaaatcccatctctacaaaaatgaaaaattagccgggcgtagtggtacatgcatttagtcctagctacttgggaggctgaggcaggaaaatcgcttgaacctgggaggcagaggttgcagtgagccgagatcatgccactgcactccagcctgggtgacagagtgagactgtgtctcaaaaaaaaaaaaaaaaaaaaaatgcctcagttttgttaagaggaaaaagcaaatcctaagttacagtggaacttatgaacaccctagcctagagatttaatttagtgatgaaaaggtacagagagagtctttcaagaaaggacctagtctgctcgcgttctctctctctctctctctatatatatatatgtatatgtgtgtgtacatatggaccacttcaagctacacacacacacacacatatacacgtgtatgaatatatatatatggctataagtggtgcgacttgcaggtactccctttgttcacctttgtaaagatgttattgccagttcagtgtgtatttctatagtatatatgtaaacaatttgtcatccttttgttgctgcttttgaaactagttcatggcttcagtgggggagagatttaaataatatgggtttataatttctgcattattaaatgcagataacttgtgattaaagagtatgttattggaaaaaaaaaaa

SEQ ID NO: 1298 - DNA, 2934 bp, Homo sapiens
aaagtccccggcccgttttcctcctgtgaagacatagctgcgggtggctgtgctggtggcgttcaagatgtcgaccaagaatttccgagtcagtgacggggactggatttgccctgacaaaaaatgtggaaatgtaaactttgctagaagaaccagctgtaatcgatgtggtcgggagaaaacaactgaggccaagatgatgaaagctgggggcactgaaataggaaagacacttgcagaaaagagccgaggcctatttagtgctaatgactggcaatgtaaaacttgcagcaatgtgaattgggccagaagatcagagtgtaatatgtgtaatactccaaagtatgctaaattagaagaaagaacaggatatggtggtggttttaatgaaagagaaaatgttgaatatatagaaagagaagaatctgatggtgaatatgatgagtttggacgtaaaaagaaaaaatacagagggaaagcagttggtcctgcatctatattaaaggaagttgaagataaagaatcagagggagaagaagaggatgaggatgaagatctttctaaatataagttagatgaggatgaggatgaagatgacgctgatctctcaaaatataatcttgatgccagtgaagaagaagatagtaataaaaagaaatctaatagacgaagtcgctcaaagtctcgatcttcacattcacgatcttcatcacgctcatcctccccctcaagttcaaggtctaggtccaggtcccgttcaagaagttcttccagttcgcagtcaagatctcgttccagttccagagaacgttcgagatctcgtgggtcgaaatcaagatccagctccaggtcccacaggggctcttcttccccacgaaaaagatcttattcaagttcatcatcttctcctgagaggaacagaaagagaagtcgttctagatcttcttcatctggtgatcgcaaaaaaagacgaacaagatcacggtcacccgaaagccaggtgattggtgaaaacactaaacaaccctgagcccagggccaacccctacggaacaccactactttacccagacgccacaggtcatcatctggatcatcccattctggttcccgttcaagttcaaaaaagaaataatgtattaaaatttacatcttaaaaaaatccagtacagtgcatgaagcatatttttaaagaagttggtgtcttacttggtcagaagtgctaaatctgctagtagaggtgcatgcctttcattgcttttcaaaacaatacagctgtgtttatttgtgaagttaaaagtaaatagcattttaagccataatgtcccaaaatagatgttctgtcattcattatttacaaccatttgcttcatttaaaaccatttcagctataacaaagtactttgcttcctaatttaaacccatttttgtcatttccaaatacatcctgtccattggctaagacaggattacctaggcttgcctgaactttgggcatggaagaaagactggaaactagttggaaacaacatacttatggaaaagaaagtcagcctttttatgctgttaacagatgtcagagtgattctcaccaaaaaaagttaaactatgttgtaagcagccaactgtaaatgtctattttgaaattccctatgctaagggtgccttagaatcattgtgtctcttttatccagctttacttttttgctccacatttaatgcaaaagaatcttgtgatgtctacaaggagagaagtgggatatattttcctttctgacacataatttggggcaaaaaagaaagtcttaagagtttatcttttctctgctgatacggttgcttgataaagacatctcaaaatgtttaccaatgttttaagaagctttgtgtgatattcttccaaatgtagttaccaaatataatatggtagaaaaggctaaatcatacttaatgagcaaattgaagtaagcttttaaagtatatttctcttttggtgaaaggccaatggagacattgtgaatttaagtgaacatttgcctcaagatgttaactataaacacactgcatacaattttcttctgaataacaaatgaatgcttattgctgcatgatgtaagcaaaagtcattatttttcctattcatttgaaataagttatggcttaaaatgcttttggagtttatttctcaaaattaaaatctggtcacatgagctttagtttgttttctggtttaaaaaataaaaaggtttctcttaacagtatttccagtgacaatgcaaggtaagtatatcaaaggaaatcaacagttgtgcttgggggctttttgttatgggatattgatttcttgttttttttccgtaacattgtctgctgcaatttaaataaaaattacgacattttaagatatttcatagacaaaccaaacaaaaatatatgtttttactttaaagtgaatgtttttctcttcagctgatctaaaaatgaaagcaagatatcttatgtagaaatattttgataatatttttacagtgagctttcccatgtttttatgtcttaagtttctttgctgcgtttatgtaggttgcacaagaacttttactcacttgtaattgtgcctcagactttttgaaagtctaccttctaaattgccccgacgatctagattctacatgttaccattggtttattcttgtgctttctgtatttaaaactttggctgtactaagcaaatgcaaggttataatttagctaatagtagtttacagacaattctgatgattatgatttcatttggtttaactaagctgtactagttcatttcataaggaaatgatactgtagacaaatgtaaataaagcctgtgagtcaagcatcaagtggtgtttgttagaaataaactagagatttttaaactctgaaaaaaaaaaaaaaaaa

SEQ ID NO: 1299 - DNA, 656 bp, Homo sapiens
aaaaccctataaatgtaaggattgtgggaaagccttcactcagaactcagaccttactaagcatgcacgaactcacagtggagagaggccctatgaatgtaaggaatgtggaaaggcctttgccagatcctctcgccttagtgaacatacaagaactcacactggagagaagccttttgaatgtgtcaaatgtgggaaagcctttgctatttcttcaaatcttagtggacatttgagaattcacactggagagaagccctttgagtgcctggaatgtggtaaagcatttacgcattcctccagtcttaataatcacatgcggacccacagcgccaaaaaaccattcacgtgtatggaatgtggcaaagcctttaagtttcccacgtgtgttaaccttcacatgcggatccacactggagaaaaaccctacaaatgtaaacagtgtgggaaatccttcagttactccaattcgtttcagttacatgaacgaactcacactggagagaaaccctatgaatgtaaggagtgcgggaaagccttcagttcttccagttcctttcgaaatcatgaaagaaggcatgcggatgagagactgtcagcataaggaatgtgggaaaacctaaaggtgtccctgttctctctgaagacatgaaaac

SEQ ID NO: 1300 - DNA, 3281 bp, Homo sapiens
ggagagcaggggcggcttccgggatttggcgggggccttcgtcggctccagttagagctcgggtctcctcgccacagctccgagtctttcgttctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcacagaagcttcattccaaaaagtgatatcgaggagacatgggagctgtgatcttgagaatttacatttaagaaaaaggtggaaaagggaggagtgtgaagggcacaatggatgttatgatgaaaagacttttaaatatgatcaatttgatgaatcctctgttgaaagtttgtttcaccagcaaatactttcttcttgtgccaaaagctataactttgatcaatataggaaggtctttactcattcatcattgcttaatcaacaagaggaaatagatatttggggaaaacatcacatatatgataaaacttcagtgttatttaggcaggtctctactctaaatagttaccgaaatgtttttattggagagaaaaattatcattgcaataattctgaaaaaaccttgaaccaaagctcaagccctaaaaatcatcaggaaaattattttctagaaaaacaatacaaatgtaaagaatttgaggaagtctttcttcagagtatgcatgggcaagagaaacaagaacagtcttacaaatgtaataaatgtgtagaagtttgtacccagtcattaaaacatattcaacatcagaccatccatatcagagaaaactcatatagctataacaaatatgataaagatcttagtcagtcatcaaatcttagaaagcagataatccataatgaagagaaaccatacaaatgtgaaaaatgtggggatagcttaaaccatagtttgcaccttactcaacatcagatcattcctaccgaagagaaaccctataaatggaaagaatgtggcaaggtctttaaccttaactgtagtttataccttactaaacagcagcaaattgatactggagaaaacctttacaaatgtaaagcatgtagcaaatcttttactcgttcctccaatcttattgtgcatcagagaattcacactggagagaaaccatacaaatgtaaagaatgtggcaaagcctttcgctgtagttcataccttactaaacataagcgaattcatactggagagaaaccttataaatgtaaagaatgtggaaaagcttttaaccgtagttcatgccttactcaacatcagacaactcatacaggagaaaaactttacaaatgtaaagtatgtagcaaatcttatgctcgttcttcaaatcttattatgcatcagagagttcatactggagagaagccttataaatgtaaagaatgtggcaaagtctttagccgtagttcttgccttactcaacatcggaaaattcatactggagaaaatctttacaaatgcaaagtatgtgctaaaccttttacttgtttctcaaatcttattgtgcatgagagaattcatactggagagaaaccctataaatgtaaagaatgtggcaaagcctttccttatagttcacaccttattcgacatcatcgaattcatactggagaaaaaccatacaaatgtaaagcatgtagcaaatcttttagtgactcctcaggtcttactgtgcatcggcgaactcatactggagagaaaccctatacatgtaaagaatgtggcaaagcctttagttatagttcagatgttattcagcatcggagaattcatactggccagagaccctacaaatgtgaagaatgtggcaaagccttcaactataggtcatacctcactacacatcagagaagtcatactggagagagaccctacaaatgtgaagaatgtggcaaagccttcaactctaggtcatacctcactacacatcggagaagacatactggagagagaccctacaaatgtgatgaatgtggtaaagccttcagctataggtcatacctcactacacatcggagaagtcatagtggagagagaccctacaaatgtgaagaatgtggcaaagcctttaactctaggtcatacctcattgcacatcagagaagtcatactagagaaaaactttaaaaatgtaaaacatggagcagattttttacttgttacccatgtcttattgtgcatcagataatttatatgggagtgaaaccctacaaatgttaagaatgtggcataacctttaactattttcaagccttacacaatagcagagaatataaactgaaaaaatccatacaaatattaaaaatgtggcaaattattttaaactgtgctcaacccttactcaagataatccatactagagaaacactatagatgtaaaaatgtgaaaagttttattcaaaatatcaaacttatgagtcacctaggggttcatagaaaaaggaagtttgcagatgcaataaatgtgaggaagtatttaataaaaaatgaagtctaaatgtgtcagagaatttatgtgagaaaggactaaagcacagacactttcagcctttatactaaataagagtattttttgtacagaataatctaaaggcaaaataattagataatttatttgcttatatgttttaaagtagcaagaacattgatgttttgacaggtatatttcatagatacttcatttgtatttacagtatttgaggtttttggaaagcaaatattatttatataattcagctttcaaatctgttgctgcttttccttaatccgtggtgttcatgtgaaaatatgtgttctgtttttttttctgcatcagaacaatgtgaggtcattctacgttaatatcattaatatcagcatttttcatggaagtttaatgccaaatgtaaaacacatgaaaatttttaaaaatatgctctttgtgtttgaataaagtagtaatgcacgtaaacaaaaaaaaaaaaaaaa

SEQ ID NO: 1301 - DNA, 3826 bp, Homo sapiens
ccggcgcgggagtaactcctcgcagaggcctctgggagttgtagtttttttgcctttgcctctccatgacgcaattcctgtgcgacatacgtagcggccgccattgttccgcgccgatggcgagatccttgttcctcagatagcgttcatcgcccgtcgtggtcaacgggccagccgagtctggagtggttgcgaacccttctggctgcagatctggaggtggaggcagtaccctggactctattctgctgccccttcagggtttggaggagccggagcatccctcgcgtcctgtcacttccagcgaggcacacaaaactgaccgtagggatggccaccagggtccggacagcttctatttgggtcccacctctccaagaacgaaacagttcatgggataggatcagaaagctccaaggtcaggaatccatcttgggccaagggactcctggtctgcaacctctccctggaacacccaggcagaagcagaagagtcgcagaatagagaaagtcctagagtggctgtttatttcccaagagcagccaaaaatcaccaagtcctggggacctttgtcattcatggatgtgtttgtggattttacctgggaggagtggcagctgctagacccagcacagaagtgcctgtacaggagtgtgatgttggagaactatagcaacctggtgtccctagggtaccaacacaccaaacctgatatcatcttcaagttggaacaaggagaagagctgtgtatggtgcaggcccaagttccaaatcagacctgtccaaacacagtctggaaaattgatgatcttatggattggcatcaggaaaataaagacaagctgggaagtacggcaaaaagctttgaatgcactacatttggaaaactatgtcttcttagtacaaagtatctttcaagacaaaaacctcataaatgtggcacgcatggaaagagtttgaaatatatagatttcactagtgattatgctagaaataatcctaatgggtttcaggtacatggaaaatcattcttccattctaaacatgagcaaactgttattggaataaaatactgtgaaagtattgaatctggaaaaaccgtcaataagaaatcgcaacttatgtgccaacaaatgtatatgggcgaaaaaccctttggatgcagctgttgtgagaaagccttcagcagcaagtcataccttctagtgcatcagcaaactcatgccgaagagaaaccctatggttgtaatgaatgtgggaaagacttcagtagtaaatcatacctcattgtacatcagagaattcatacaggagagaaactacatgaatgcagtgaatgcaggaaaacattcagtttccattcacagcttgttatacatcagagaattcacacaggtgagaatccctatgagtgctgtgaatgtgggaaagtcttcagtaggaaagaccagcttgtttcacaccagaaaactcattcaggacagaaaccatatgtgtgtaatgaatgtgggaaagcttttggtttaaaatcacagctcattatacatgaaagaattcatacaggagagaaaccatatgaatgcaatgaatgtcagaaagcctttaatacaaagtcaaaccttatggtacatcagagaacccatacaggggagaaaccttatgtttgtagtgattgtggaaaagcctttacattcaagtcacagctcattgtacatcaggggattcacacaggagtaaagccctatgggtgtattcagtgtggtaaaggattcagtttgaaatcacagctcattgtacatcagagaagtcacacaggaatgaaaccttatgtatgcaatgaatgtggcaaagccttcaggagcaagtcataccttattatacatacaaggactcatacaggagaaaaactccatgaatgcaacaattgtgggaaagccttcagttttaaatcacagctcattatacatcagaggattcatacaggagagaacccctatgaatgccatgaatgtgggaaagccttcagtcggaaataccagcttatttcacaccagagaactcatgcaggagagaagccttatgaatgcaccgactgtggaaaggcttttggtttaaagtcacagcttattatacaccagagaactcatacaggggagaaaccatttgaatgtagtgagtgtcagaaagcctttaatacaaagtcaaacctgattgtacatcagagaactcatacaggagagaaaccctatagttgtaatgaatgtggaaaagcctttacgttcaaatcacagctcattgtacataaaggagtgcacactggagtaaaaccctatggatgcagtcaatgtgcaaaaacctttagtttgaagtcccagctcattgtacatcagagaagtcacacaggagtaaaaccatatggatgcagtgagtgtgggaaagccttcaggagcaagtcataccttattatacatatgagaactcatacaggagagaaaccacatgagtgcagggaatgcgggaaatcctttagtttcaattcacaactcattgtgcatcagagaattcacacaggagaaaatccctatgaatgcagtgaatgtgggaaagcctttaataggaaagaccagctcatttcacatcagcgaactcatgcaggggaaaagccttatgggtgcagtgaatgtgggaaagcttttagcagcaagtcatacctaattatacacatgagaactcattcaggtgaaaaaccatatgaatgtaatgaatgtgggaaagccttcatttggaaatcactactcattgtacatgagcgaactcatgcaggggtcaacccttataaatgcagtcaatgtgagaaatccttcagtgggaaattacgccttcttgtacaccagagaatgcacacaagagagaaaccatatgaatgcagtgagtgtggaaaagccttcattaggaattctcaactcattgtacatcaaagaactcattcaggagagaaaccctatgggtgcaatgaatgtgggaaaaccttctctcaaaaatcaattctcagtgcacatcagagaacacatacaggagagaagccttgtaagtgcactgaatgtgggaaagccttttgttggaagtcacagctcattatgcatcagagaactcatgtagatgacaaacattgataattttacgaaactctgaaaagtggattcacaagagatagaaacaatcatatataaagagaaactctgtaagtggaatcatcttgtcatcttccagaaaactcatactgaatagaactttatgaatgcacagcatatggaaaggcatccacagaaagctgttctttacatgcaaaaagatagtagacaatacacaggaaaactgaatttagtaaccactctgaaaatttttagcagcaagtcatacctttttttaaaaagttcatacaggtgaggaaccatgttaaacgttgtaaagtcattttactaacataagattcacaaagaggaaacttcatgaaccagatgaatatagaatagacttctttgaaattcatagtttacagaattttaatgagagaaattattgagctaatgaatggcagaattaacaaaattacaaacattttatgtatcggaagcatataccttggagggaccatgctatgagggaaagtgtaaatctagaaatgagaaacccctagggaaaaaatatatataggagtgaacatcttatgaatgtaccaaataaaccacagctggactgttaacctcaccttagaagcttctttctaaaaaaaaaaaaaaaaaaaaaaaaaaaaaaaaaaaaaaa

SEQ ID NO: 1302 - DNA, 4897 bp, Homo sapiens
gagcactcctcccagattcctagagcggacagggcgatggcaggttcgccgggtgtgaggcttcacagcggtccggtgaccaagtcgagatggtgagaacaagaccaagattggaaagccagcttcagaggagggaattacagcaaaaattgaaccattgacagaagagtctagcagtctcagaatgttctccaggattctgaaggcaaagaattctgtgaatttggggataaattaaatgaaaaagatcagaacgtctttaaaaggagacctcataactgtgacgaatatgggcaaagctttgtttggagtacaagcctttttaggcatcgaaaaacgcactgtgagaaaccttatgaatgggataagtgtggaaaggccactggggagaaaccttattcctgtaattggtgtattaaaagtttcagttggagctcagaccttattaaacaccaaagagtccacactggtgaaaaaccttataaatgtgatgagtgtgggaaagccttcagtcagagctcagatcttattatacatcagagaatccatataggagaaaaaccctatcaatgccgtcattgtagtaaaagttttagccagcgctcagatctggttaaacatcagagaatccatactggagagaagccttatacttgtaaccagtgtaacaaacattttagagttctgatgtgataaaacatcaaagaatccacactggggagaaaccatataaatgtgatgtgtgtgggaaagccttcagtcagagctcagatcttattctgcatcagagaatccatactggggagaaaccatatccatgtaatcagtgtagcaaaagtttcagtcagaattcagaccttattaaacatcgaaggatccacactggagagaaaccctataaatgtaatgagtgtgggaaagcttttaatcagagctcagtccttattttacatcagaggattcatactggagagaaaccctatccctgtgatcaatgtagcaaaaccttcagtaggctttcagatcttattaatcatcaacgaattcacactggagagaagccttacccatgtaatcagtgcaataaaatgtttagtcgaagatgagatcttgttaaacatcacagaattcatacaggtgagaaaccctatgaatgtgatgaatgtgggaaaacctttagtcagagctccaaccttattcttcatcagagaatccacactggagagaaaccttatgcatgtagtgattgtactaaaagctttagtcgccgttcagatcttgttaagcatcaaagaatacacactggagagaaaccatatgcatgtaatcagtgtgataaaagttttagtcaaagctcagacctcactaaacatcagagagtacactctggtgaaaagccttatcattgcaatagttgtgagaaagccttcagtcagagttctgaccttattcttcatcagagaattcacactggagaaaaactattatctgtgcacacagtgcagcaaaagtttcagtcagatctcagacctcattaaacaccagagaatccacactggggaaaaaccatataaatgcagtgagtgcaggaaggctttcagtcagtgctcagctcttaccctacaccagagaatccacactgggaagaaaccaaatccatgtgatgagtgtggcaaaagctttagtcggcgttctgatctcattaaccatcaaaaaatacacactggtgaaaagccgtataagtgtgatgcatgtgggaaagccttcagcacatgtactgatcttattgaacaccagaaaacccatgctgaggagaaaccctaccagtgtgttcagtgcagcagaagttgtagccaactctctgaacttactattcatgaggaagtccattgtggagaagacagtcaaaatgtgatgaatgtgagaaaacctttagtgtgtacaccaactctattcagtaccagagacactgtaccagaaaaaaatctaatgaatgctgttgattattgatgagtatgaaaaaggttttaatcagtgttcaactcttatgctacattaaaaccacactggatccggatacgtatggtggctcacgcctgtaatcccaacactttgggaggcagatgtggaagcatcatttgagcccaggagtttgaggctgcagtgagctatgattccaccattgcactccagtctgggcaacagagcaagaccctgtctatttaaaaaaaaaaaaaaaccaccaataccacatgggagaaaacattaattcagtttttgtaatgaaaggttaactcagagctcagacattactaaaattaagaaaaattctccagcctgaccaacatggtgaaaccctgtctctaccaaaaaataaaaaataattagctgggcatggtggcaggcgcctgtagtcccagctattcgggaggctgaggcatgagaatcacttgaacctgggaggtgggggttgcagggagccgagatctgccactgcattccagcctgggcaacagagtgagactctctcaaaaaaaaaaaaaaaagaaaaaaaaactctgaggaagagtcctgcgagttgtgggaaaaccttcaaagtgaaaaacatttttactgaatgtcagtataccacaatagaaacaaatttctatcttttctataaggttggaaaagctctagtcttattcagacataacctacaggaagagagttgtattattgtaagagatctaatgcagaacttatcagatattgtaaaaatcagtgtgggaggtattcagtcaaaagtcagaaggaaatgtattatcgttataatttcaaaccttaagaaagcctaaattaccaattgcatatcaaatttttttgataatgtaaggaaaacttaaatcccctccatatcctaattggcatttataataatatgacacttaaccctgacagctagagtcttactttatgctaatgctagatatctatttttaaattccacgtgtgtaaacatgctatactcttctgatattaaacttactaagtacataattccagtgcccccttttctcagaatttttttttgtttttaattttggggggtatagttttggttttcctagtgcacattagtttgtgcaagttcttgcaatgttcacagcaaatatagatttattttgctttgaataatgcagcccataaactttattggtttgaaagttcttcactaccatttaatcacagcttctaaacatgtgaaacaggatctttaaaaaaattttccatatgtcaaagtgtagagatgtttctagcagcatttatcttgtcatctatagattgaacaaaaagtggtagctgtgaaattgtgatttataataaatacatatttggtcttcatcccctggtacagagcttctaagacccttgaaatttcctgagtggtaagagtaattaggatgacaagcccctttaaccacacctgagtttatgttaatgggattacttttggaaagacagaaccacaggatgggggctagttgcctcgagaaccaaccatgtgattagagggttggaactttcagatcaaccccaccctaccttgacctctgagaggagagaggctggagactgaattcagtcaccagtggccagtgatttaatcattcatgcctacgtgatgtagccttcataaaaaactgaaggacaggattcagagagcttccaggttgaacttgttgaggtactaggagggtggtgtacctagggagggcatggaagctcagtgttcttcccacacaccttgccttatgcatctctttcatctggctgatccttagttgtgttcttttacaagaatctagtaaataaacttttcctacattctatgagtcattctagctaatgctgaaactcaaagaggggattgtaggaaccttggatttatagccagttggtcagaagcaccagtgaaaacatggacatgagattggtgtccaaaactgacacaattggtgtcagttgtagaactgagcccttaacctgaagcatctatgttgatctgattccaggtagatagcttcaaaatttaattacaggcacttagtgggtgtccacagaaaattggagaattgtttggtttggggaaacctcatacacatctggtgtcagaaatgttgtgagtatagagaagacaataagtttttcctatacagtagctaaagtacctacatcattaatttgtatagtatattctgtgtaaaaataagactttctgatatttttttcaagtggcaacatttatcagacttttttgatttctgacatacatactgaaaacaggcaacatacatgcaaagttttccactgaaaaatagaaatagtttgaaaaaataaaaaattcaaattgtctttctggtattaacaatttgataagttctgctactaaaagtactacaaagttgtttcctttgattatcccctataattgtctaattaatattttaatttagcagacattgttaaattctattccttaggagtgtaatgctaaggcaaggccttttgggaggttttgtagtacattaaaagaatatactatctcttccaatgaagtgtatattgtatagtgatagagactaatatgtacagaaaacacatggctcaatgtaatcataaaggtaggacatgcttgtaagaactcagaggagtcaaggttcaattctgattagaaagaaaagggagagctttgtggaactcctgaagtttgagccttgaaggatgggaatagaggcataaaggcagggagggaataatcaacaaaggcacaaaaggaagtgcaagaaatgtggagcatggtggttatcatttattcaataaatattcagtgtcaggcaaaaaaaaaaaaaaaaaa

SEQ ID NO: 1303 - DNA, 746 bp, Homo sapiens
gaaaagccttttgagtgcaaagaatgtgggaaagcctttagcattcgaaaagacctcattcgacacttcaacatccacactggagagaagccctatgagtgtttacagtgtggaaaggcttttacccgcatgtcagggctcacaaggcaccagtggattcatactggagagaagccgtatgtatgcatccaatgtgggaaagccttttgtcggaccacaaacctgattcgacactttagcatccacactggagagaagccctatgaatgcgtggagtgcgggaaggccttcaaccgcaggtcacccctcacaaggcaccagcggattcacactgcagagaagtcccacgaacccatccagagtgggaacgtttcttgtgagagcacagatctcattcaacactccatcatccacactgagagtagcccagtgagtgcagtgaatatggaaacgccttcaattgccgctcattcctcctcactcgacatcaacggattcatagtggaagaaaccctaccattgtaacagatgtggaaagactttttacgtacacttcagtcaacatccaagaattcctattagcgaaatagttttttaatataaccactgaagaaaatctgtggtgagaggaaacatcttaccatctggtcattcatactgaagagaaactccataagtatcatctctgtgggaaaacctgttttagatcatcatttgtcatctaaacaattatgttagaaattgac

SEQ ID NO: 1304 - DNA, 981 bp, Homo sapiens
aagaatgtggcaaaggctttagtatattctcaacccttactaaacataagataattcatactggagagaaaccctacaaatgcaatgaatgtggtaaagcctttaactggtcctcaactcttactaaacataagagaattcatactggagagaaaccctacaaatgtgaagaatgtggcaaagcttttaaccagtcctcaacccttactagacataagatagttcatactggagagaaaccctacaaatgtgaagaatgtggtaaagcctttaaacggtccacaactctaaaacataagagaatttatactaaagagaaaccatacaaatgtgaagaatgtggaaaagcctttagtgtattctcaacccttactaaacataagataattcatactggagcaaaaccttacaaatgtgacgaatgtggcagtgcctttagggcattctcaacccttactgaacataagagagttcatactggagagaaaccttacaaatgcaatgaatgtggtaaagcctttaactggtcctcaactcttactaaacataagagaattcatactggagagaagccctacaaatgtgaagaatgtggcaaagcttttaaccggtcctcaaaccttactcgacataagaaaattcatactggagagaaaccatacaaacctaaaagatgtgacagtgcttttgacaacaccccaaacttttctagacataaaagaaatcatatgggtgagaaatcctagaaatgtgaagaatgtgacaaagcctttaagcggttgtcacacttgattgtatataagataattcatactggagaaaactcccagaagtgtgacaaatgtgacaaaacatttaattaattctcataccttattgcacaggaaagcatttatacttgagaaaaattgtataaagaatggaaaagtcattaatatctgctcatatcttaacatcagcgagttggtatttaataaaagc

SEQ ID NO: 1305 - DNA, 2538 bp, Homo sapiens
cgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctggaccgccgagggacatcgacgagtatcctcctcctgctgtccccggcttcgcctgccgcccctaaccggccagtcaagatggccgccgctgggtgaggcaagctggcgcgccgcgggggcgtctgggagttgtagttcgggacggcgggctgacgcacttcgccgccggccgacgggcgccattgtgcggcgcgcgccggagtatcctgagctccagctggaccctaaattggatcctcttcctgctgagagtcccctaatgaacattgaggttgttgaggtcctcacactgaaccaggaggtggctggtccccggaatgcccagatccaggccctatatgctgaagatggaagcctgagtgcagatgcccccagtgagcaggtccaacagcagggcaagcatccaggtgaccctgaggccgcgcgccagaggttccggcagttccgttataaggacatgacaggtccccgggaggccctggaccagctccgagagctgtgtcaccagtggctacagcctaaggcacgctccaaggagcagatcctggagctgctggtgctggagcagttcctaggtgcactgcctgtgaagctccggacatgggtggaatcgcagcacccagagaactgccaagaggtggtggccctggtagagggtgtgacctggatgtctgaggaggaagtacttcctgcaggacaacctgccgagggcaccacctgctgcctcgaggtcactgcccagcaggaggagaagcaggaggatgcagccatctgcccagtgacagtgctccctgaggagccagtgaccttccaggatgtggctgtggacttcagccgggaggagtgggggctgctgggcccgacacagaggaccgagtaccgcgatgtgatgctggagacctttgggcacctggtctctgtggggtgggagactacactggaaaataaagagttagctccaaattctgacattcctgaggaagaaccagcccccagcctgaaagtacaagaatcctcaagggattgtgccttgtcctctacattagaagataccttgcagggtggggtccaggaagtccaagacacagtgttgaagcagatggagtctgctcaggaaaaagaccttcctcagaagaagcactttgacaaccgtgagtcccaggcaaacagtggtgctcttgacacaaaccaagtttcgctccagaaaattgacaaccctgagtcccaggcaaacagtggcgctcttgacacaaaccaagttttgctccacaaaattcctcctagaaaacgattgcgcaaacgtgactcacaagttaaaagtatgaaacataattcacgtgtaaaaattcatcagaagagctgtgaaaggcaaaaggccaaggaaggcaatggttgtaggaaaaccttcagtcggagtactaaacagattacgtttataagaattcacaaggggagccaagtttgccgatgcagtgaatgtggtaaaatattccggaacccaagatacttttctgtgcataagaaaatccataccggagagaggccctatgtgtgtcaagactgtgggaaaggatttgttcagagctcttccctcacacagcatcagagagttcattctggagagagaccatttgaatgtcaggagtgtgggaggaccttcaatgatcgctcagccatctcccagcacctgaggactcacactggcgctaagccctacaagtgtcaggactgtggaaaagccttccgccagagctcccacctcatcagacatcagaggactcacaccggggagcgcccatatgcatgcaacaaatgtggaaaggccttcacccagagctcacaccttattgggcaccagagaacccacaataggacaaagcgaaagaagaaacagcctacctcatagctctcaagccagttgaagaaaccttgccttttcagcttgaccctgcaatataacatgcacaggcctgcttgtgaatcaggactgaatgtgaaagggaagtattgagtgaggacattcccaaaaccaaaggacaactgaggagactgcccagcacataatgaataaataagaaaatgagtgaggagttattaacatcatttggaaaaaagatttcccattcacttgatattgtttgttcactcatttagtcattaaaagtgagattaataaaatctgaaaatgttatataataactttaaaaagccaggtaattaataatctgcactgatattacatccacagtaccacagtatttatgtgtatgaattaaggattaaaagataatgtggataaataaactattgatctatgtctgtgt

SEQ ID NO: 1306 - DNA, 6599 bp, Homo sapiens
gggctgttagctcggctgggcacgggcggctccgtggcgcttcctgccacgccaggcctgcctgggccgcgccagcgccgctccaccgagggccgcgcgtcggccgccgccgggcctggatggggccttacctgccaggctgatcccttggagtagttctgaggcatgatgagtcatccgtgtgtgtctcttttggttccacctactccccaaggtcttaccctccccaggatggagccccaggaaaccaggtcctggcagtccctcttgagatgccagaggatttggtgacatttgatgatgtggcatggtacctcaccacaagggagtggtttaagctggaccctgaacagagggcactggaatattatgggaacgtgacctctgtgggcgttcctgttttaaatcctgccttggtccctcacctggcacaaggacaagtgctactggtgtcagacccatcgcccaacactgatcctgctaagtactctgaaagcacctccgcgacccgacaccagatgaagggggaagatgcccagccacaggagatggcgtccacaagcttcccaagggccagtggtcccagtcctgaattcagacagcacggggactctgacgggaagagagggagcccacagaatctgcccatagaacatcattttgcttgtaaagagtgtggggacacctttcggcttaaagtcctgcttgtccagcaccagagagtccacagtgaggagaagggctgggaatgtggcgactgcgggaaggtctttaggggggtggcggagtttaatgagcacaggaaaagccacgtagctgcggagccccagcccggccccagtagggccctggagaatgccgcggagaagagggagcagatggagagggaggcaaagcccttcgagtgcgaggagtgcggaaaacggtttaagaagaatgcaggcctgagtcagcatctgagggtccacagcagagagaagccctttgattgcgaggaatgcgggcggtcgttcaaagtcaacacccacctcttccgacatcagaaacttcacacttcggaaaagcctttcgcctgcaaggcgtgcagcagggatttcctggatcgccaggagcttctcaagcaccagcgcatgcacactggccacctgcccttcgactgcgacgactgcggcaagtccttccgaggggtcaacgggctggccgagcaccagcgcatccacagtggggccaagccatacgggtgtccccactgcggcaagctcttccgaaggagctcggagctcaccaagcaccggcggatccacacgggcgagaagccctacgcctgcggccagtgcggcaaggccttccgccagagctccagcctcctggagcacgcacgcatccacagtggcgagcggccctacgcatgcggcgagtgtggcaaggccttccgtgggccctctgacctcatcaagcaccggcgcatccacagcggactgaaaccctatgagtgcgacaaatgcggcaaggccttccgccggagctccggcctcagtcgccaccggcggatccacagtggggcgcggcgctgcgaatgcagccagtgtggccgcgtgttcaagaggcgctcggcactgcagaagcatcagccaacccaccacgagtagaaacgccctgtggtcccgcgggacagggacggagtccccagaggggatggcagagtcaaaggagatgaacagttttgtagcgcttatatattttgtcttccaaaaggttgagaccgatttatactgccaccagcaatttataagtgttacgttatgcccatcaagagtagcttgtaccatttaacttagtttggctagtttaactggtaggaagtaccatcaaggtatttcagtccacatgccttgaatccaagaatgagagaggacaaatctggatgtggggtagggaggggcttagaggtcatcaactccaagctccccccgccccagagaaacacacagagctgttccacgatggcgtcctcataatgtgatcccagctttcctgaagagaacgttgccctcatgatttttggcctacttgaatttataaatttttagggatgtaaatagaacactcaaatgtcttaaaatatttaatttattaatttagttatacatacatactgtaaatcacatattatataaaataatatattaatttagaaaataccccatttttgccaccctccctttcacgaaatcattttactctgactcctcaccgtcttcaccaacatgggaaccctgtttgagtcatcagacagtttcaagacacacccagtcacttccatccgagctctgcacggtcgctcagtgacgatcccttcatgaggctctcattagaaattttctcccaagccataagaccatatttgcagaacattaggacgatttctcttgtcgttttttaatctgtcctgtgactgtacaatataaccacttaaggtcatactttttcaaacaacctttaaacgtcttttcttttaaagcacccaaaatgtcattgtgaggccaaacgcctagtaacagttactgaatctgggttaaatgtcggtatctttttttcttaaaccatttcaatttggtgtcccctatacatatccaaaactagcatcgattggggttgttttgaactaatgggtcttgtcctcaagcagcactattttgttcaaaataaaatagttgagagcatgcccctaagaagagatacatctcaaggactcaagtgcagggtgacgcctccttttggaaatgagcctctcctggtatcaggcctagatggtacttctccagccttccgtttcttgttctataaaacaggggtgatcacagcacctacctccgaaggttatcacgaggactgccatcgtggctgcagagtgccaggaccaccggcctggtatggaggtacacactcagtgaaggccatctgctgtcattgtcattgtcatagttattgccgtcattctgtggcttgtcaattccagaactggggatagaccccaggcctcctgaccaccagtctcatctttctcttatgcgatgacttaaatggtgtttctgttttttgcatgcaaatggtccgttcatctcctttgactagttatcaacttaccttcggatatattaactttatgtagcagttctttctatattgatggtgatgttctcttttccaattttattgctttgctttttgtagcagttttattacgtttttgttgtgaaagcttttaatttttacatatccaagcattcattttttgtccactcagtcataactttcattgcttctgtagctagatatgatgacattttctctagaattttaattacaaacaaaaagctgcaaccccagcccatcagaaggtgagtacaccaggtgggcaggctggatggaaatgggccagagaagcaggctctttcctcatccgagatgcggactccctgtctatctgtgggcaccacttgactatccaacctgaccactgcggcacactggagatgctcccatcatagattagccagaactctgtgactgctcatcattatagaccccgccagcagcagtggggcttggcctcacctagatcaatggagtggtccaaacttggtctgggagcaagcagcccagccatcctttgagctcctgggagccttggcaatgctccgagtggattcagtgactgagcagcagattcacccaagaaacatctccttggacacaagaagacttgcctagaccacatcctcctttcagccggtgactctagaactagaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagatcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacatgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgatttgccaccccgcttctaggccatattaattcagccagaactgaacacctgacccaagggcagcaagcaatcatcagagcatagagctgacagaacatgatggaccacggacaccaccaggccttccagatctgaaatgcaaacaaggaaacagaagcttctaggcatcagaaggtgtggggagcagcacagtactcagaggagtgaggagcgtggcgcctgctgggaggaaggcctggccatggtatgttcttggatttctggcagcagccctcattggtccacgtgcgtccccactacagactccttgacttgagccagcttgagtgggtctctactcttttctattgtgttttgccacttggctgcttcctggccaagtcgcacctgactgcatgaacacctgttcaaacgtgtgttctctgttctctaagatgggtgaaagtcgatgccttctagtctcagtgaatttaacctgtgattttatgtctacgtatattgttcctttactgaacccaccacatgcgggccataaaatgagtgaaatcacagtgcaccctgttctcttatttttgaagtgtttcacgatttccagcatgtccatcagatggggggattgctaacttctctcttactcatgtacttacattctgtagttctcattgcatcactttggatgtttactttgaaaagcagaaactgtctctttaaacttggccctcaatgtcatttgcgtatctctgagaacaatagctatgtcccaccccagtttgtatttccgttggttgttggcacttttttctcattcccccatctcattaccttgtctgttttctggcactcactataatcagccttgcactagagctgtttgtggacttggcttcaccccctcctcctcagccctcccccacccattaaattgtgagctcttagaagacaggggtggcctttcatgtctgatcccctaccaaatctagcacagtgccttgcatcaagtagatttcaataaatatatgttaaatggc

SEQ ID NO: 1307 - DNA, 2687 bp, Homo sapiens
gtccagagcgcggcgtaggtgtggagaaaacattacgtcgacggggagttcgcctccagtagcgtttctactggtgccaccccgcctccgacccgccctgcggccctcccttttcttttctgccgggtaatggctgcttccaagacccagggggctgtcgcccgaatgcaggaagaccgtgatgggagctgcagcacagtcgggggtgtaggttatggggacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtacattttatattggaggaaaaggttcactgaacagcccatcacagatttttgtagtgtaataagaattaattccactgctccatttgaagaacaagagaattattttttgttatgtgacgttttaccagaagatagaattcttagagaagagcttcagaaacagagactgagagaaattctggaacaacagcagcaagaacgaaatgataccaattttcatggcgtttgtatgttttgcaatgaagaattccttggaaacagatctgttattttgaaccacatggccagagaacatgctttcaacattggattgccagacaacattgtaaactgcaatgaatttttgtgtacattacagaaaaagcttgacaatttgcagtgcttgtactgtgagaagaccttcagggacaaaaatacacttaaagatcacatgaggaaaaaacagcatcgtaagattaatcctaagaacagagaatatgacagattttatgtcatcaattatttggaacttggaaaatcgtgggaagaagttcagttggaagatgatcgggagttgctggaccatcaggaagatgactggtctgattgggaagaacaccctgcctctgcagtctgcttattttgtgaaaagcaagcagaaacaattgagaagttgtatgtccacatggaggatgcacacgaatttgatcttctcaaaataaagtcagaacttggattaaatttctatcagcaagtgaaactggtcaattttattcggaggcaagttcaccaatgcagatgttatggctgccatgtgaagttcaaatccaaagcagacttaagaactcacatggaagaaactaaacacacttcgctgctccccgatagaaagacgtgggatcaactggagtattattttccaacctatgaaaatgacactctcctgtgtacactatctgacagtgaaagtgacctgacagctcaggaacaaaatgaaaatgttcccatcatcagtgaagatacatctaaactgtatgctttgaaacaaagcagtattttgaaccagttgctactataagagtacttgaaaacctagaagaaactaccacagaagcaatttttcatgtttttctcctatgagacagatatgaaagaacaatttaaatttgaacatcaacaaaagattggtccttggtgaaataaacttttcaaaaatgaatgttcttttcaaaaaataaagtagaaaaatgcacttactaagaacatgaaaaaaaatgaagtaggaaaataagatgaagactttgtattttggctgtaaagttttattgtgtgatcatcttaaattatctcacttcattaaactcataattatatatagaagtatatgtcaattacaaagaaatgaaatgttcaaattatttataaacctgatttttcaatcagtagtttcagtctcctccccaaggaccttcttcatccaacaagttgcaaaatttgaatatcccttctgtactatattgggtgagctgtaaatgtaatgactaaaagaaaagccacagaagaaagaagaaatggtcaaagacgtggataatatgcaaattggccattatattagaacaatcaagagctgactgtgttattaccactttctgcctagggtggccaaattccctagaaatagacatcaagccagttaacttcacttttccctgcaatttgtatgtcactaacatttaaatgccattttttaaaaacataaccacaataccattatgacacctaaaaaacattaacattaacttaatatcatctgttttcagtttttcccacttgtctcaaaatgtatgtttacaatattatcagtttcattactgatgaatattatatgcctcctgataagatgtactgaggaggacagaatatcacttttgtagatttataccaaaaatgcataatttggatataatgaagaaacagtcaaatccaagtttgaggctgggcacagtagctcatatctgtaatcccagcactttgggaggccaaggcagaggatcacatgaggtcaggagttcaagatcagcctggccaacgtggcaaaaccccatctctacgaaaaatacacagattagccaggcatggtggaatgcacctatagtcccagctacttgggaggctgaagcacaagaatcgcttgaatccaggaggcaaaagttgcagtgagccgagatcacaccactgcagttcagcctgggcaacagaccaagactctgtctcaaaaaaagg

SEQ ID NO: 1308 - DNA, 3812 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaggcgggcgggcggagaggagagagtggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcagcgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgagatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccctcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagagaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcagacctgcaatgcttcttttgccacccgagaccgtctgcgctcccacctggcctgtcatgaagacaaggtgccctgccaggtgtgtgggaagtacttgcgggcagcatacatggcagaccacctgaagaagcacagcgaggggcccagcaacttctgcagtatctgtaaccgaggtttctcctctgcctcctacttaaaggtccatgttaaaacccaccacggtgttccccttccccaggtctccaggcaccaggagcccatcctgaatgggggagcagcgttccactgcgccaggacctatggcaacaaagaaggccagaaatgctcacatcaggatccgattgagagctctgactcctatggtgacctctcagatgccagcgacctgaagacgccagagaagcagagtgccaatggctctttctcctgcgacatggcagtccccaaaaacaaaatggagtctgatggggagaagaagtacccatgccctgaatgtgggagcttcttccgctctaagtcctacttgaacaaacacatccagaaggtgcatgtccgggctctcgggggccccctgggggacctgggccctgcccttggctcacctttctctcctcagcagaacatgtctctcctcgagtcctttgggtttcagattgttcagtcggcatttgcgtcatctttagtagatcctgaggttgaccagcagcccatggggcctgaagggaaatgaggcagctgctgtgtccccacggaaacaaccatctggggactgctgggaaatgctgtgaatgcggagggaagtgatgtttgggttctgtagctgagagatttttattcatttttaactgccccccaaccccactccaactccttctccaccacccattctcccaatggtctttagaaatagattttcatctgatattctgcagaaatatcaatgagacttggtatgggacaggggcagaaaacactacataggcctccaaggcaaaaccagtcccagtttctttaatgggaagaagctggaattcctggtgctcaattcttagtgaccccaatcctatacccaaatctatgatattctgggacctcagtgattttggtcccctcccacttctctagttcgtcatcctcccttcccatatccttcaaaagaaccacactagggtctccacctacttatacaatgcggatgcccaactgtttttaaggaagccagaagcatcccatggaccatggggtgagtgtcctccaagagccccctgagctcagccctctgcctggagggctccagacctttctgagccctgcttggaggcgagcattttcactgctaggacaagctcagctgttgaggacacccccaccccaaatttcagttcttacgtgattttaaccattcaacatgctgttgggttttaattctctaattattattattattgttattattttttaggaccagttgtagtgaattgctactgaaagctatcccaggtgatacagagctctttgtaaaccgcagtcacacattagggttagtattaaactttgtttagatgtaccataattaacttggctagttgattgtttgaagtctatggaagaaatagttttatgcaaaattttaaaaaatgccagtctggtcagggaagtagggggtttcaatgctgttgggaaccaggaaggtgggacagccggcaggtagggacattgtgtacctcagttgtgtcacatgtgagcaagcccaggttgaccttgtgatgtgaattgatctgatcagactgtattaaaaatgttagtacattactcta

SEQ ID NO: 1309 - DNA, 3535 bp, Homo sapiens
gcagtacacgggaggcttttaattccattgtggagaggacggcgttatttttattaactggaggcgacggcggctgcggcggcggcgggacccgcctcctccggggtatgaaaatcggcagtgggttcctgagtggcggcggaggtaccggcagtagcggtggtagcggctccggcggcggtggtagtggcggcggcggcggcggcggcagcagcggcaggagggcagagatggaacccacctttccccagggtatggttatgttcaaccaccgtcttcccccggtcaccagcttcacccggccggcggggtcggccgcccctcccccgcaatgcgtgttatcctcctctacctccgcagccccggccgctgagcccccccctccgccagccccggacatgactttcaagaaggagccggcggcgtcagccgcggccttcccctcgcagaggacctcctgggggttcttgcagtctttggttagcatcaaacaggagaaacccgcggatcctgaggagcagcagtcccaccaccaccatcaccaccaccactatggggggctgttcgctggagctgaagagaggtctccaggcctaggaggcggtgaaggggggagtcacggcgtcatccaggacctcagtattctccaccagcatgtccagcagcaaccagcccagcaccaccgtgacgtattactcagcagcagtagcaggactgatgaccaccatggcactgaggagccaaagcaggacactaatgtcaaaaaggcaaaaaggccaaagccagaatctcagggaatcaaagccaagaggaagccaagtgcatcttccaaaccttctttggttggagatggagaaggtgccatcctctccccaagtcagaaacctcatatctgtgatcactgtagtgctgctttccgaagctcctatcacctgcggagacatgtcctcattcatacaggagaaagacctttccagtgcagccagtgtagtatgggtttcattcagaaatacctactacagagacatgagaaaattcatagtagagagaagccatttggatgtgatcagtgcagcatgaagtttattcagaagtaccatatggagagacacaagaggacacatagtggagaaaagccatataagtgtgacacttgccaacagtatttttcaaggactgatagattgttgaagcacaggcgcacatgtggtgaagtcatagttaaaggagccactagtgcagaacctgggtcatcaaaccataccaatatgggtaatctggctgtgttgtctcagggaaatacaagttcttcaaggagaaaaacaaagtcaaaaagcatagctattgaaaataaggaacagaagaccggtaaaacaaatgaatcacaaatttcaaataatataaacatgcagagttactcagtagaaatgcctaccgtgtcttccagtggaggcataattggcactggaatagatgaactgcagaagagggtgccaaaattgatctttaagaaaggaagcagaaagaatacagataaaaactaccttaactttgtgtcaccattaccagacatagtaggacagaaatccttgtctggaaaaccaagtggctcacttggcatagtatcaaataatagtgtggagaccattggtcttctccaaagtacaagtggcaaacaaggtcagataagtagtaattatgatgatgccatgcagttttcaaagaaaagaagatatttaccaactgccagcagcaacagtgccttttctataaacgtaggacacatggtctcccaacagtctgtcattcagtctgcaggtgtcagtgttttggacaatgaggcaccattgtcacttattgactcctcagctctaaatgctgaaattaaatcttgtcatgacaagtctggaattcctgatgaggttttacaaagtattttggatcaatactccaacaaatcagaaagccagaaagaggatcctttcaatattgcagaaccacgagtggatttacacacctcaggagaacactcagaattggttcaagaagaaaatttgagcccaggcacccaaacaccttcaaatgataaagcaagtatgttgcaagaatactccaaatacctccaacaggcttttgaaaaatccactaatgcaagttttactcttggacacggtttccaatttgtcagtttgtcttcacctctccacaaccacactttgtttccagaaaaacaaatatacactacgtctcctttggagtgtggtttcggccaatctgttacctcagtgttgccatcttcattgccaaagcctccttttgggatgttgtttggatctcagccaggtctttatttgtctgctttggatgctacacatcagcagttgacaccttcccaggagctggatgatctgatagattctcagaagaacttagagacttcatcagccttccagtcctcatctcagaaattgactagccagaaggaacagaaaaacttagagtcttcaacaggctttcagattccatctcaggagttagctagccagatagatcctcagaaagacatagagcctagaacaacgtatcagattgagaactttgcacaagcgtttggttctcagtttaagtcgggcagcagggtgccaatgacctttatcactaactctaatggagaagtggaccatagagtaaggacttcagtgtcagatttctcagggtatacaaatatgatgtctgatgtaagtgagccatgtagtacaagagtaaagacacccaccagccagagttacaggtaaggtcccaaaagtggccaggctggaggtcttctaatgtaattttgttttattttgagaacactgccattggaatgtttctacacgatcctattaagaataatgtgatgccctttcaatgcaacttttcatatttagtttattttgttagcgtgattttagctctgtttgtattatgatttttaatcaaaatcaatagattaaaaatagtttgacattcaaagtgacaatgtttagcaatcaaatttacatgtatagatcgtcagggaatagcccaaatgttttaaacgcaaaaaaaaagacaaaaaaaaaccaaaaaaaaaaaacctacaaaaaaaactttgttgctaggattaaggttattctaattgctttactctcaggaaagtgtaataacgcatgggaattctgtacgttatcactgtaatggaatatccaatttacagatagtatgatatacatttcatcatttaagtaagggatcgaaaacatttcaaattgctctatctgggctgatagacatttcgtcatttaagtaagggatcgaagacatttcaaattgctatctccatctgggctgatccaaaattctgagattgttggctacctatattttgttgcagcttttaaatgtactctgaacttccaaaccacattcattccagcctggtagaacaaatattcttggatctttgatcaaagcctggaatgatagctttaataaaagaaaaaaaaaaaaaaaa

SEQ ID NO: 1310 - DNA, 3737 bp, Homo sapiens
acccacgcgtccggccgccgaaggggactgtttgctcctacgggctgtagatggagctgtccggccccggagagggggaaggcgcctggaaaacgttcttcttctccctggccgacccgagcggggaacagcactcccaggatgcagtttgtgtcaacacggccgcagcctcagcagctgggcatccagggcctggggctggacagcgggagctggagctgggcccaggctctgcccccggagcaggtctgccaccaggagccggcgctgcgcggggaaatggccgagggaatgccgcccatgcaggctcaagaatgggacatggacgcccggcggccaatgccttttcagttcccaccctttccagatagggcacctgtcttccccgaccgcatgatgcgagagccccagttgcccacagcagagatctcactctggactgtggtggctgccattcaggctgtggagaggaaggtggatgcccaggccagccagctgctgaacctggaggggcgcacggggacagccgagaagaagctggccgactgtgaaaagacggccgtggaatttgggaaccacatggagagcaagtgggccgtgctggggaccctgctgcaggagtacgggctgctgcagaggcggctggagaacttggagaacttgctgcgcaacaggaacttctgggtcctgcggctgcccccgggcagcaagggggaggcccccaaggttccagtgacttttgtcgacattgctgtgtacttctccgaagacgagtggaagaacttggacgaatggcagaaggagctttataacaaccttgttaaggagaactacaaaaccctcatgtccctggacgcggagggctcagtccccaagccagatgctccagtccaggctgagcccagggaagaaccttgtgtgtgggagcagcgccaccccgaagagagagaaatcccaatggatcccgaagcaggagcagagcccctggtgcctgcgcaggatgcgtcctcccaggtgaagcgtgaggacaccctgtgtgtccggggtcagcggggcctggaggaaagagccatccctacggaatccattaccgactccccaatttctgcccaggacctcttgtcccggattaaacaggaggagcatcagtgcgtgtgggatcagcaggatttggcagacagagatattcccacggatcccaattcagagtctctcatctcagcacatgacattttgtcatggatcaagcaggaggagcagccatacccatggggaccacgcgactcaatggacggagagcttggattagactctggccctagtgacagcctgctgatggtgaagaacccacccccggccccgccacagccccagccccagcgccagccaccgcagccgcagctgcagtcgcagccccagccccagagcctgccccccatcgcggtggccgagaacccgggcggccccccgagccgagggctgctggacgacggtttccaggtgctgcccggggagcgtggctccggcgaggcgccgccgggtggggaccgcagcaccgggggcggcgggggcgatgggggcggtgggggcggcggcgcggaggcggggacgggggcaggcggcggctgtggcagctgctgccctggcgggctgcggcggagcctcctcctgcacggcgcccgcagcaagccctactcgtgccccgagtgcggcaagagcttcggcgtgcgcaagagcctcatcatccaccaccgcagccacaccaaggagcggccctacgagtgcgctgagtgcgagaagagcttcaactgccactcgggcctcatccgccaccagatgacgcaccgcggcgagcggccctacaagtgctcggagtgcgagaagacctacagccgtaaggagcacctgcagaaccaccagcggctgcacacgggcgagcggcctttccaatgtgcactgtgcggcaagagcttcatccgcaagcagaacctgctcaagcaccagcgcatccacacgggcgagcgcccctacacgtgcggcgagtgcggcaagagcttccgctacaaggagtcgctcaaggaccacctgcgcgtgcacagcggcggcccgggccccggcgccccacggcagctcccgccgcctcctgagcgagactagggctgggctgggggagggcagggccggacggagtggatcgggggcggcctgagcaccaaccaccttgccgggtgtcctcagccaccgtctggaaatcggcaacaggcattgcactccggttgggggtcccccagggtggggcagggatcccccagatctgtctggtctgaatggacgcccagctcatctagggtggacccagctgctggggaagagccagggggaccgcgaggagccgagcgtcctcgggcaccgccctcacacctcctcgagtgccctgggaccactgggccacagatggtcatcaggggaagccaccagggagtcccgaagcccttctgagatcaggaaatcaggtcccaaggttaggagacgccctgaaaaaaagtgaaggccgagggatgtgctaagggtaacaccttcatgatgacaacactgcctcgcgtttcaatagcgctttatacttttttaagtgttttctatccgttatccatttcacccttggcctatccctctcagataggtggggtaggattttcctggtgaccgagtaaagtgagaggcaggtgagacggttcacccaatcacacgggaaggggcgcgcgctgcccaaccgcgctctccgcctacctcgctgctcgggaagctgctggcctggccctcctggtctctcttcctttctggtctctcttcctttccttgctctcacccacggataaaaccagaagcgacaggaggccagctcctggggttcctgggaccgggaacagattggctacggaacgccccaggttgtacattcagagggctctttctccatgggagctcctggtgccgccttcggccccagcctgtccccagcccctcaatctggtgcagcagcatcttgtcactgcacaacagtggcctggtcccccacaggcagttagggccccaggtcagacctcaccatgatgatttgttccagttctcccagggcagaggggcgagggagaggcttttgctgtgagagtagccgtcacgtgtctcttcccagcagcgccgggcaagtgggtgctagagtctgagcctcaggctctcctgccctgggcctcccaattggtgctatctgttactgcccgtgctcacggacatggatacagaccctgctgtgctccacaccctgcaggcgcctcgggaagcgcccaaaggattccccttcacgttggtgcacctgctccatagctccgggcgctgcgtcccgaggggccacagtctccatttcagcgtcttgcatggcctggcaccgggtggggtggtatgcccccttgtttgtgtcaaaaatgactttccctgcccttgccgtgggtccggcgttcctcccagccgggatcacagtgggcagccggcacccggcaccactttggcgagcgtcctgcttccgccctcgccctcatctacgctgctccgctttcctcagacccctttttgccgtgcaaaggaattcttgacattaaataaaaggtatccagattgcagactgcatgttcacagagctgggggttctccagcttgcctacagtaaagcctcaatgaactgg

SEQ ID NO: 1311 - DNA, 5559 bp, Homo sapiens
cttcgatcgtccgattctcccagccgcaccacgggtgctcccacctgcggagaaccggagtctggcgatgccaaggcgcttctgggaattgtagttccgggcgggatgagggcagcacgcctggctccgctccttcttacgcatgcgcgactccgagctggccaaagaagttcgtcccctttgtgaggcccgggatgggaggtgcccggttcccccagggacagcttcaagcggtagggacagacatctgaggacccagcctcagggatgctgtccccgggcttccaggctccagcgccgtaggactgaggcagactccacggtgagaaagagacccgatctaacccaggcctttcatcagagcccaggagggaaggcaggaagtgggaccacgaggcccggggggcttctaactcgtctggccagggagatctgaattggggtgaagagcagaatctccagaacaaggaggaggtggtgatcatggagacagatttggctgaaatgcctgagaaaggagctctgtcttcccaggattctccccatttccaagagaagagcacagaagagggagaagtggctgctctgcgcctcacggccagatcccaggaaacagtgacattcaaggatgtggccatggactttacaccagaggagtgggggaagctggatcctgcacaaagggatgtgatgctggagaactataggaacctagtctcactttggcttccagtttccaaacctgagagctacaacttggagaatggaaaagaaccattgaagcttgagagaaaagcccccaaaagcagctattcagacatggagactagaccacagagcaaggattcaacttcagtgcaagatttttccaaagcagaatcatgcaaagttgcaataatagacagactgacacggaatagtgtctatgactctaacttggaagcagcccttgaatgtgaaaattggttagagaatcagcaaggaaatcaggagagacatttgagagaaatgttcactcacatgaattcactctctgaggaaacagaccataagcatgatgtatactggaaaagcttcaatcagaaatctgtccttatcactgaagacagagttcccaaaggatcttatgccttccatacacttgaaaaaagcttgaaacaaaaatcaaacttaatgaaaaagcagagaacttataaagagaaaaaacctcataaatgtaatgattgtggtgaactcttcacctaccattcagtgcttattcgacaccagagagtccatactggagagaaaccctatacctgcaatgaatgtgggaaatcttttagccacagagctaatttaactaaacaccagagaactcatactagaattctctttgaatgcagtgaatgcaagaaaaccttcacagaaagctcatcccttgcaacacatcagagaattcacgttggagagagaccttatgaatgcaatgaatgtgggaaaggttttaatcgaagtacacatcttgtgcagcatcagttgattcatactggagtgaagccttatgaatgtaatgaatgtgataaagcttttattcattcatcagcactcattaaacatcaaagaactcatactggagagaaaccttataaatgtcaagaatgtgggaaagcctttagccattgctcatccctaactaagcatcagagagttcatactggagaaaagccatatgaatgcagtgaatgtggaaaaacttttagtcagagcacacatcttgttcaacatcagagaattcacactggagagaaaccctatgagtgtaatgaatgtgggaaaaccttcagccggagctccaattttgctaaacatcaaagaattcatattggaaagaaaccgtacaaatgtagcgagtgtggaaaagccttcattcattcatcagctctcattcaacatcagagaactcataccggagagaaaccctttagatgtaatgagtgtgggaaaagctttaagtgcagttcatctctcatcagacatcaaagagttcacactgaagagcaaccctgaaaaattactgaatgtgaagaaatgtaagttggttttatcactgtattaaatacttgagtgtttaggtggaaggcgcatccataatatgcatgtgaggaccaattctgtatgcatctaatttcatttgcgtaatacatagttttgagccataagcaggttctttatgtccgttaatttgataattatgaaatctagccagcgatttcaaaattttaatctccaacgtcccaaatagctatctgtggaaattcaagaagtccctgagagtaggtagcagtacgaacattgtgaaatccagttttcccctctcttgtttatgtcagagctttgttgtaagcctctcactttgtaaggaaattcttattgggtaggttaggctgagggcttacatccttatcatcaggaagacacaatgttgttatttattactccttgagatctagatacacatatggtataattcatctagagtgtaatttcttttatattagccttaaaaaccaaaaatgctgggttcaaagtccttagaattcccttcctccctcaacaagctgctgtctatgttgatgaccataactgggatgtataatatttacagacaactctaagttacgttcacatggattatgtacatcattgatttttttttttttttttttttgagacagagtcttgctctgttgcccgggctggagtgcagtggcgcgatctcggctcactgcaacctccacctcccaggttcatgccattctcttgtctcagcctcccaagtagctgggactacaggcacctgccagtacgcctggctaattttttttgtatttttagtagagatggggtttcaccatgttagccaggatggtcttgatctcctgacctcgtgatctgcctgcctcggcctcccaaagtgctgggattacaggcatgagccaccatgcctggcatcatcattgatttatgtcattgttatccctctaccgcggagaccttctttcattttccatttccctgggagttcacgtgaagtagtgaatgggtcaaaatcttaacagtggttgttgatcaagtccttcctttcttatccttggcactgaataaatctttggttttccataatcaaagggtgagggagacttcttttgtctacattattcagctttctgaaagctatgctgtgtccatttgagaaaaagccccagggatattgaaggtctgagaagttgagtggttcagtgtgttattatatttagggtcccagtaaagaagaactgaagcaactgtgagacaccagggcatacttccctgtatgagtggaaaacaaggcacggaaaatagctcacaggatagtcctcaactgacttgcttgaggataagcagcttcccttcgtgaagaagttgccatttctctggccttcatatttatctactttttgttattgttgtctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaaagaaagaaaagaaaacacaggaaaaggaactcacctcttttatcatcttagtatttagtactaatggtttagagcaggaattgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcagccccttataagggcactaatcccattcatgagagctccaccctcacgacctaatcacctccaaaaggccccatttcgtaataccgtcagttaagtttcattatatgactttgatggggatatagcccatagtaggttgtatgtccctgaaagcctaaaatatttactgtttggctctttacagaaaatattttcttggcccctgttccagagcattcatcaagtcagataaagggtttaaaccagtcagagaaactaggtggaatggaaaagtactgagagataattggggacagaaaaataaaagagatgggaaatgctgcatcaaaatactcctacctctaggatgttactatatattgttaggagaattcaagttattgaaacttgccaaattcttgagtgaagaggaattcatttgagagccaaaatttgactaaggaaagaagaccaacatgggctttccaaagttgagtttgaattctgccatccccactaagcagtcatgtgaccttggaaaaactccctactctgagtctcagtttctttatctgtattaggtttcaacaaagggaataaatcattggcttctcatgaggttgtcataaggattaaataagacaatgcatataaaagaactggcagacaataaatatagagtcccccactcctgcttggtgctctctttctctctccttctctacatagagaagtgccagagcatccgtcagtagaagttacttaaggttggctgtgtcttccacatcttttgtttacccatgaagaactgtgaccatcttgttctgtgtcttgtcataaagatgggacgtgacttctttctgctcttgcttccatctggtgctgttttctgcacagcctccttgagaccttccagaaccttcttttttcctacttcatatcacttaaccagtagctatctgggatggttccagaggctgaagtttgcagttgaataacattttaaatagtgttaagcgacttgggatctctggccctttgcgtttcagtatttgtcctttttatgcctgatgtttaacctgccacatgtttgtactgcaacatgaatcttggaaattttaatgttatgcatttcaaatgtttttggttatctgtaaactaaatgtgcccttattggctcacttgtcaataaagatgtttgtatatgtattgtcagaaaaaaaaaaaaaaaa

SEQ ID NO: 1312 - DNA, 4278 bp, Homo sapiens
gcagtgacgccgaggcgaggtcgcggctaagcagaggcgccggggtttctgggccgggcttctcaggaccgggctggaacgtgcagctcctggccgggacactctgtgctttgcggggaagggaagtggcggagcccgaggatccgctgccgctcgggactgagcccgccacgcaggcgcctgtgccagcgtcgccattgttgcctgtggccttagggccgctccggctgcccgtcggccgggtcccagcgacagggtctcttatccatccctgcaagttctgggctcagaatttgtcactaaggctgctaactctaccttgattctgttctgccctcggctgcagcagcctttgatatagtgtccttgtgactctagcatgagacttcaagcagttggctcactactggagaaataaaggatattgccagattgactctcctgtctgtagcaatgttagcctcaagcaagaggatgaacagttcttcacgttctcaaatccttctaaggtggaagtcagacaaggctcagagtggaccctacaatgttgagaaggaaatccttacttcaagattcttgcgtgacactgagacctgtcgacagaattttaggaattttccatacccagacctggctggtcctcgaaaggcattgagtcaactccgagagctctgccttaagtggctgagacctgagattcactcaaaggaacaaattttggagctgctggtgctggagcaattcctgaccatcctgcctggtgaggttaggacttgggtaaagtcccagtatccagagagcagcgaggaagcagtgactctggtggaggatttgactcagattctagaagaggaagctcctcaaaactctaccctttcccaagataccccagaggaagaccccagaggaaaacatgctttccagacaggatggctaaatgacttggtgaccaaagaatcgatgacattcaaagatgtggctgtagacatcacccaggaggactgggagttaatgcgtcctgtgcagaaggaattatacaagactgtgacgttacagaactattggaacatggtttctctgggacttacagtgtacagaccaactgtgattcccatattggaagaaccatggatggtgataaaagaaattttagaaggccctagtccagaatgggaaactaaagcccaagcatgtactccagtggaggatatgtctaaactcacaaaggaagaaacccataccatcaaattagaagactcatatgactacgatgatagactagagaggcgaggaaaaggtggcttctggaaaattcacactgatgaaagaggtttcagtttgaagtcagtcctttcacaagaatatgatcctacagaagaatgtcttagtaaatatgatatatatagaaataattttgaaaagcattcaaacctaattgtacagtttgatacccaattagataataaaacttctgtgtataatgaaggcagggcaaccttcaatcatgtctcatatggtattgtacataggaaaatacttcctggagagaagccttacaagtgtaatgtgtgtgggaaaaaatttaggaaatacccatccctcctgaaacaccaaagtacccatgccaaagagaaatcgtatgaatgtgaagaatgtgggaaagagtttaggcatatctcatcccttattgcacatcagagaatgcacactggagaaaaaccatatgaatgccaccagtgtggtaaagccttcagccagcgtgcacaccttactatacatcagagaattcatactggagagaaaccctataagtgtgatgactgtgggaaagacttcagtcagcgtgcacaccttaccatccatcaaaggacacatactggagagaaaccatataaatgcttggaatgtggtaaaaccttcagtcatagttcatcactgattaatcatcagagagttcatactggagaaaaaccttatatatgcaatgaatgtgggaagactttcagtcagagtacacaccttcttcagcatcaaaaaatacatactgggaagaaaccatataaatgcaatgaatgttggaaagtgtttagtcagagtacttaccttattcgacatcagagaattcattctggagagaagtgttataaatgtaatgaatgtggaaaagcctttgctcattcctcaacccttattcaacatcaaaccactcacactggagagaaatcctatatatgtaatatatgtgggaaagccttcagccagagtgcaaatcttactcaacatcatagaacacatactggagagaaaccatataaatgcagtgtgtgtgggaaagcattcagccagagtgtgcaccttactcaacatcagaggattcataatggagaaaaaccctttaaatgcaatatatgtgggaaagcatatagacaaggcgcaaatcttactcagcatcaaaggattcatactggagaaaaaccctataaatgtaatgaatgtgggaaagctttcatttattcctcatcacttaatcaacatcagagaactcatactggagagagaccctataaatgtaatgaatgtgataaggattttagccagagaacatgccttattcaacaccagagaattcacacaggagagaaaccctatgcatgtcgtatatgtggtaaaaccttcacccagagtacaaaccttattcagcatcaacgtgttcatacaggtgccaaacatcgtaattaatggataagggaaacttcaattcggttttacaactttgtttcaattttgttttgtgcattctatgtgtcagaacattcagaagaagtctgaagaagtgcaatatgttagatactcagcagaagtatcagaagtagtggtatggatataacctatttagatttaatgtgaaatttaagaaggaaacttgacttcttaaccttaatttgatatgattttaattcattacagaaagaaaccctgtgaagggtattcaaaaacataactcatcaactctctatttcaagtacacttatcctttggtatactcgggggattggttccaggaccacccatgtatacgaaaatctacccatactcaagttgcacggtcagcctggtggaacctgtgtatatgaaaagccctacatctatgcaggtttcccatccctgaataatgtgctttcaaactctgttcagttgaaaaaaaaaattccagtataaatggatctgtacagttcaaatgtgttgttcaagggtcaactgtacatcctaatgaggccttatgagtgtaacttaggaaggtgtccatcaaatagagatttcacactagagagtgatcttaaaattacagaaaagagtaagctgctttcaggccttttattcccagctttgaagccttaaaatatgtaaaggactcccttccctgttttacttccccttctcctgttatgccataactgccatatggagccagtaggtttgaaaaaaaaacagttggaagtatcttaaagatttctatgtgaccactggttacaccttccctcagatatggaaatattaaagagaagcttaatgaaagatatgttatgatagaaactaatgtgtatataacattagatgtgtagagatttagttaaacaggcaaaaattaaatgcctcaagcttaaatgaattttcaatacacattagccttgatttcactaggttttgacattcaaggtcatcctgaaggaaaaaagtaggtataaagtatacagttcccatttttttcacctgactcctaaatttatactttaggtttctctgtgactgttttactatggaaagttcatttcttccactgaaacacgtttcttgagtgtctactatgctcaggtcccaaacttcctaattggatcctctcaagcttgttacagtgctgaaaatcacaggtggtttacacaacagaaagatttctagagtgatgagaaagtgaggatgtgatattttgtcatgggttgagcataagcaacctgctaaaatgggttgccaaatgctacctatatcccaagagaaggaagtggaagtgatagtgtagctatataaataatgtgagaaaaaaatggaaaatagatctgaattcactgcagaatgtgggtcggggaaaaggtgaaattttagtggagtgaggaaaacatacatagataattgctataacatgaaatgtaattggacttgctttgcctatgaaatgagagtggctaaataaaaaagaattcagcctggttattagaagaaact

SEQ ID NO: 1313 - DNA, 3541 bp, Homo sapiens
gaagaagtaggggcggggggaagtttaggagttgaggaaagaagattaaagagcgcgaggagacaaataaaaagaagtgttaagaattgcctttgggactctgaaggctgaagaattgatgaattgcaagtttgtgccccatagctgcacagactgcctgaagttacatttagagactgaaatcactgcaccttaaaaacaaaagattgagctgcactgtattcctaatgtttcatcattactaacaggatattcctcatgacattgctgtctgatctttgaccatcagtctgtgacctgccccttctctttacatgcagccgctctctgctccctgccccaatgaacatctgcactaggcccaagccttggagtaatttacctgaagagtgacaccattgattttgaaactactgaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatcttttaaaaaaaagtaaaaaaaaaaaaaaaatttccacttgtgaagagcactacaaaaaatatataacaaaatctaaaaggcctactgtctttaagtacaccgcttgcagtgtttcagtggacattttcacaattctggccgcttggacttcacagtaaccagttaaaactgtggaatatcacttctggttgaaaacccagaggaaaggccctgctgttttccacctaccacgttgtctgatttcataaaagggctgtgggggtgggaagggcagtgggttcggtggtgtgggaaagaaagacgaatggcaggcttcttccccagattctgcccgggtccacacaccctggcccaccttctccatatccccctcttgcagcagaagccaggaagacttggacaagcaacaagcaacagtggctatcgtatttattcagtgtcttcgctgagccacagcctcagcacaatcaagagggactttcatgaaaggcaggaatgcagataaaacaaagatatcagaaatttgcacctatgtttctaggtacaagagaaggattatttccaacaatctttgcaaaaaaaaaaaaa

SEQ ID NO: 1314 - DNA, 168 bp, Homo sapiens
tacaagtgtaaagaatgtggtgaagccttcagtcagagctcaactcttacaaaacatataaaagtctacactggagagaaaccctacacctgtaaagactgtaggaaagccttcagccagagttcatctcttacccagcatcagagggttcatactggaaagaaacca

SEQ ID NO: 1315 - DNA, 7650 bp, Homo sapiens
aaccggggtctgagtgctcagagtacagctgcaaccgcgaccatgggcgggaagaacaagcagcgaactaaagggaacctgaggccttcaaacagtggccgagctgcagaactccttgccaaagaacagggaacagtgcctggatttattggttttggaacatctcagagtgacctaggctatgttcctgctattcaaggagctgaagaaattgacagtcttgtagattctgatttccgaatggtgctgcggaaactttcaaagaaagatgtcaccacaaaattaaaagctatgcaggaatttggaaccatgtgtacagagagagacacagaaactgtgaaaggagttcttccatattggccaagaattttttgcaaaatttcacttgatcatgaccgtcgcgtccgagaagccacacaacaagcttttgaaaaacttatccttaaagtaaagaaacagttggctccctacttaaaaagtttaatgggatattggctaatggctcagtgtgatacttacacaccagctgcgtttgcagcaaaagatgcatttgaagcggcttttcctccaagcaagcaacctgaagccatagcattttgtaaggatgaaattacaagtgtgctgcaggatcatcttataaaagaaacacctgatacactcagtgacccgcaaactgttccagaggaagaaagagaagctaaattctaccgggttgtaacttgttccttattggcattaaagagattactttgccttttacctgataatgagcttgattctctggaggagaaatttaagtctcttttatcacagaataagttttggaagtatggaaaacacagtgtacctcagattcgctcagcttattttgagttagtctctgcattgtgccagcgcattccacagttgatgaaagaggaagcatccaaagtgagcccatcagttctacttagcattgatgacagtgacccaattgtctgcccagctctctgggaagctgtactctatacacttacaactattgaggactgttggcttcatgtaaatgcaaaaaagagtgtgtttcccaagctatcaactgtgattcgtgaaggtggtcggggtctagctactgtcatatatccttaccttctgccattcatcagcaagctccctcagtccatcacaaatccaaagttggatttcttcaaaaatttcctcacgtctctagttgctgggctgtcaacagagagaactaaaaccagctcttcagagtcctcggcagtaatatctgctttttttgaatgcttacgttttataatgcagcaaaacttaggtgaggaagagattgaacagatgctcgtcaatgatcagttgatcccttttattgatgcagttctcaaagacccaggattgcaacatgggcagctatttaaccatttagcagaaactctaagttcctgggaagccaaagcagacacggaaaaagatgaaaaaacagctcacaacttggagaacgtactgatacatttctgggaaagactgtcagagatctgtgttgcgaaaatcagtgagccagaagctgatgttgagtccgttttgggtgtatctaacctattacaggtgcttcagaagccgaagagctcattgaagtcaagtaaaaaaaaaaatggtaaggttagatttgctgatgagatacttgaaagcaataaagagaatgaaaaatgtgtatcttcagaaggagagaagattgaaggctgggaattaacaactgaaccttctctcactcataattcttcaggccttttgtctcctctaaggaaaaaacctttggaagacttagtctgtaaactcgcagatataagtattaattatgtcaatgaacgaaagtcagagcaacatctaaggtttctttctactctgcttgactccttttcttcaagccgagtatttaaaatgctacttggtgatgaaaaacagagtattgtccaagccaaacctcttgaaatagccaagcttgtacaaaaaaatcctgcggtgcagtttttataccagaaactgataggttggctaaatgaagatcaaaggaaggattttggtttcctggtggacattttgtacagtgctctccggtgctgtgacaatgatatggaaagaaaaaaagtcttggatgatctaaccaaggtggacttgaaatggaattctcttcttaagattattgaaaaggcatgtcctagttcagataaacatgctttagtaactccttggctcaaaggcgatatccttggtgagaaattggtcaacttggcagattgtctttgtaatgaggacttggaatccagggtatcttcagaatctcacttctcagaaagatggactcttctaagcttggtattatcccaacatgttaaaaatgattacttgattggagacgtatatgttgaaagaatcattgttagacttcatgaaactttattcaaaacaaagaaattatcagaagctgaaagcagtgactcatcagtgtcttttatctgtgatgtggcctataactatttcagctcagcgaaaggatgcttgctaatgccatcatctgaagatttattattaactctctttcagttatgtgctcagagcaaagaaaaaacacatttgccagattttcttatctgtaaactgaaaaatacttggctctctggtgtaaatttattggttcatcaaactgacagttcatataaagagagtaccttcctacatttgtctgctctgtggctgaagaaccaagttcaggcttcatctttggatatcaacagtctccaagtcctcttgtctgctgttgatgatttgctaaatacacttctagagagtgaagattcttatcttatgggagtttatattggaagtgtaatgccgaacgacagtgaatgggaaaagatgaggcagtctcttcctatgcagtggttacatagacctcttttagagggaagattgagtttgaattatgaatgtttcaaaacagattttaaggaacaggacataaagacacttcccagccatttgtgtacttcagcattattgagcaaaatggtcttaattgcactgagaaaggaaacagtcttagaaaataatgagcttgagaaaataattgcagaactgctttattcactgcagtggtgtgaagaattagataacccacctatttttctaattggattttgtgaaatacttcaaaaaatgaatattacgtatgataacttacgtgtacttggtaatacgtcgggccttttgcagctgttatttaacaggtccagagaacatggcacactgtggtctcttattattgctaagttgatcctttcccgaagcatttcatctgatgaagtaaaaccacattataagagaaaagaaagtttttttccactaactgaaggcaatttgcataccattcaaagtctatgtccatttttgtcaaaagaagaaaagaaagaatttagtgctcaatgtatacctgctcttttgggctggactaagaaagatctttgcagcactaatggaggttttggacatcttgccattttcaattcttgtctgcaaaccaaaagtatagatgatggagagctattacatggaatattaaaaatcataatatcctggaagaaagagcatgaagatatttttcttttcagttgtaatctatcagaagcaagtccagaggtactgggtgtaaatatagaaataatccggtttctttccctatttctgaaatactgctcatcccctttggcagagagtgagtgggacttcatcatgtgctccatgttggcttggttggagacaacaagtgagaatcaggcattgtattctattccacttgtgcaactgtttgcctgtgtcagctgtgatttggcctgtgacctcagtgctttctttgattccacaactctggataccattggcaatcttcctgtaaatctaatcagtgaatggaaagaatttttttcccaaggcatccacagtttgcttttacctattttggtgactgttacaggagaaaacaaagatgtgtctgaaacatcctttcagaatgcaatgctgaaacccatgtgtgaaacattaacgtatatctcaaaggaacagctattgagtcacaaacttcctgcaagattagttgctgaccaaaaaacaaacttaccagaatatctccagactttgttaaatacattggccccattactcctcttcagagctaggcctgtgcaaattgctgtttatcatatgctatacaaattgatgcctgaattaccacagtatgatcaggataatctaaagtcatacggagatgaagaagaagagccagccttgtcaccaccagcagcactgatgtctcttcttagcattcaagaggacttactagaaaatgttttggggtgtattcctgttggacagatagttactattaaaccactgagtgaagacttctgttatgttctgggataccttctcacttggaaattaatactaactttcttcaaagctgcatcatcacagcttcgggctttgtattccatgtatcttcggaaaacaaagagtttgaataaattgctctatcacctgttcaggcttatgccagaaaatccaacctatgcagagacagcagttgaggtcccaaataaggaccctaaaacattctttactgaggagctccagctgagtattagagaaacaacaatgcttccataccacattccacacttggcttgttcagtctatcatatgacattaaaagacttgcctgccatggttaggttgtggtggaatagcagtgagaagcgtgttttcaatattgtggatagatttacaagcaagtatgtcagcagtgttctttcttttcaagaaatatcttctgtacaaacaagtacacaactatttaatggcatgacggttaaagctcgagctactactcgagaggtaatggctacttatactattgaggacatagttattgaacttataatacaactgccttcaaattatccactgggttcaataatagtagaaagtgggaaaagagtaggagtagctgttcagcagtggcggaactggatgctgcagttaagcacttacctcacccatcagaatggaagtattatggaaggcttagctttatggaaaaataacgtagacaaacgttttgagggtgttgaagattgcatgatctgtttctcagtcattcacggtttcaactattcccttcccaaaaaagcctgtagaacatgcaagaaaaaattccattcagcctgcttgtacaaatggtttacatctagcaacaaatccacttgtccactgtgtcgtgagacgtttttctgagatttttttcactggaagggatccctgaagtacatcaaacaaaggcattggatttggatccgtctgaaagtgtggatgtggggaagccagtgagcattacttttaaataggaccttctctggaaaattattttggttaatgtaataatcctaaaatcaggtttacttaactttagattgctttgtaaatgtttggaaactttcttttacaaaagaatattacatatttgagagaaaatatttctattaatggtttaatttctttgtatatttaaaaataaatatgaaaaacccctaaattacagaattggaatttgtgaaaagattgcacaactatattattgataaacccattccgtttgttgatctgtgttttagaatagtccaagtgaagcaaaacgaactgagagagctgatttacatctatagatattttaagccttatttattagttatgacaataaattagtattctgatatttgtagattattttaatgataaaaatgacactaagctattaatacggcttgtcttaagatatctggaggcatgctctgaaatcctatataaaagagtttaaactgaactttaaggtgcctccatttatcaagggttatgaaactcagaaaattaaattcttgatgctgacctttttgcttgtgggagaattatttctatatattagtgaaatttgaattgtaaacttgtcagtgaatttatcactctgagcgagtctctagagggtgagaatttgagagaaatagtaatttgattatttcattcatgaagcggagtggtagttatccttctattgagagggaagaaataaatgagtattactgaaacttaaagatcagtggaaaaaaaaaacatttaaaaatgttgtaggagactttcaattttggaagcaaactgagctattcttaccagccaaagttatactaaataagagacttgggggagcaaatgtttttcagccttcagaaatgaaagttaaggattttagcactaggtaaaattcagtataataggctgaagtggagtaagtgaaaacctgccttttgccactcttaaaaattgtgcccaaaatataaaagtgtggaactttagaacttggaataattttattgcagtcttccattacatggaaatagcatatctaatatctaggttacttgagagaccagctaatcatctctgttgcacatgtttaattggcaaaaagcaattcatgataaataaaattactgctttccatctactgggtaaaatgactattgaaatagtatgaatgtggtcagaggattatagttgagagtgaagtactatgtgtgagttatagatctctcgaattatatttatagatgcagtgtcctgcccagttttgtttgcctcctacattttactgtaaaatatttattgtcttctagccttgagcctctgagggtcagtaagtgaagtacagatagcaaaattttactacctcgttaacccttttcttaaaatattctctatctttctatgtctctttctgacatagtaatcccaaaggattgtgttactccccgtgaaagttattacttttcctttaaaaatggttttataataagactgtttaaaacctttccagtattggtacatcttggcttctggcccaaaccccaagcagaaaagaaaatggaataatggagcattgtttttccacattagtattagggcatcagattcttggtgaaacactataattaagtagttataattaaataactgttcttcatacttaggactcttaatacatttctttaagacttgtaagtataattgtaaagcttgttaactgtttatatactaaagaaaaagctttacaagataagactgaaattcagaataccacattaaagttttatctgtacagcgttgacaactctaactaaaaggattacagcccttaaaattttagcttaaggacattttaaaattgcatgagattagcaaaattattaatttaaaaccccaaagtaaattgcaaattttaaaatttatttttgactcttttatcacatgctccaatgtatgtacataagtgtctgtggcttaaataatatgttgttatttgatacatttttgtggtgcaagtaattaatgttattatttgattgttataccatatgtgcccattaaaattctttttaattaaaaatatttcaaatatgcagaaaaataataatataaatgcccttgtacccttcacatactattttgccatatttgcttctgatttttaaataaataaaatgttactctttt

SEQ ID NO: 1316 - DNA, 7414 bp, Homo sapiens
gcgatgacctcatccctggtgtgggatgacgtcaaattcaagatggatggaatcacagcggcagcggcggctgcggcgcgcgcgagccgagtgtgagcggaaaggggcccggcgtctgcctcgagactgaagaccgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcgcaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaacatttataatgccgttctggtttttctattactttttatactgtactttaaaagcattaggctgaaagagtttattttggtggtcaaaaaaaatatgcttccactcatgtaactattttaaatgttaagaagtaaaataatgaaagatatgttaattactttattcagtaaagttttttaagaatgtttatctcagccagtaggcaaatacttggtgtaaaacaagttggtcttaaattgttgcaactcattagctagtgaagatattcatgtaaatatattttaggattgtaattaattttgaaaatgtagaaagctctttattccatgtaagtatgcaggatgcctgcttttttatgcagttgtggaaagaatgtaaaatgttttaatatattctttgttaatctgagaacttgatactgaatcgtttatgtgggagaaggaaggagtaacataaaacatgtttttatcactcaaagtaagcaatggaggtaacaaatattgtgcattttaacagtaatatttgaagatttgtagaatattcacctttaaaactagttagtatgcatttataattttaccagaatatacaactaacaattcaacagtgatgttctttgcatttgtggggagatgtgtgatgttcttggttttctggtttggaatggaacgtttatagccttgcctgtaaaaatgtgccccagcacttaatgagtgaccgtttgaatccatatgtagtcccattggtgctaatgagagtagctgctgtgaaacaggaataaaatgtgtctgttcacggaggtgcggtgtggatgcacctacaaggccaactctctgatcagggtgagggagagatggaagaattaacagatctaaagttggcctttgttgtctcaaattgggtttgtacacacatgcatgcatgtgtgtatacaactgtaatctggaacttcaggaagtaaaattatttgaagtttcttagtaaaaagtaattaggtataattccaaatagatttctgtataaattgtatctaactggattacaagtcagtttgacaatttacgatgtctcagtgatgtttctgcaataattgtgaaatgcattattgatttaaataatgctgacacgtactctttaaaagtgttctttaacactgactactaaactttaagttttaaaaaataggttttcatttatggctttttgtggttttagcactttaagaagtttaattttttgtaatttttaatatgctctttcagtgtatctcagcgggtactccagcttgtggcattcccatgtgactggggagaagacaaaattggtgtttagattctggaggagaaaaaatgagttacaatgtcaggtgtttttaaaaattccttttagagacagtcttttgggaaccaaagtattttactgtaaatctttaaaataacagaattcagtgctctttcatttgttaatgctgtccagatttttcacacagttatactcagttaatactagttttcagaacattagtccaaggctatttcaagttttccattgaatatatgcttatggttaaaagaaaaacgaatggttttataattctgtgtattttgtcatatgccttagcagagtaagtcatttttccattttacttaggaataagctttttcgaactgaaaattcatggtaaaataggatttctatctaatgttaatccattgcttatttgtattcaattccattgtctacagtttgcttaaatgttgactaagaatgattggagtcaataaatttgtactgtattttgcttcga

SEQ ID NO: 1317 - DNA, 2681 bp, Homo sapiens
cgcaagatggcggcgggaggggcccaggttgctgctctggccgccgagtgaggggcggggggggcccgggggcgcgcggcccgagacccccccggccgccctcctcctttctttgttcctgtggctgggggggtatcccctccctccacaacatggagccatctcctctgtctcccagtggggcagcacttcccctgccgctgtcgctggctccgcccccactacccctgccagcagctgcagtggtacatgtgtccttccctgaggtgaccagtgccctcttggagtccctcaatcagcagcgtctgcagggccagctctgcgatgtatctatcagagtgcagggccgggagttccgggctcatcgggctgtcctggctgcctcctccccttacttccatgatcaggtcctactcaaaggcatgacctccatctcgctgcccagtgtcatggacccaggcgcctttgagactgtcctagcctccgcttacactggccgcctcagcatggctgctgctgacattgtcaacttccttacagtggggtctgtgctccaaatgtggcacattgtggacaagtgcactgaactactccgagaaggccgggcctcagctaccaccaccatcactactgctgcagccacctctgtcactgtccctggtgctggggtgccatccgggagtgggggcactgtggcccctgctaccatgggctctgcgcgctcccatgcctccagccgggccagtgagaatcaatctcccagcagcagcaactacttcagccccagggagtccactgatttctcatcttcctcccaagaggcatttgcagcttctgcagtgggcagtggggagcgtcgaggaggtggccctgtattcccagcccctgtcgttggcagtggaggggccacatctggaaagctgctgctggaggcagatgagctgtgcgatgatggtggggatgggaggggggcagtggttcctggggctgggctccggagacccacctacacaccccctagcatcatgccacagaaacactgggtatacgtgaagcgaggtggtaattgcccagcgccaacacccctggttccccaagacccagatctggaggaggaagaggaggaggaagatctggtgttgacctgtgaggatgatgaagatgaagaactagggggtagctccagggttccagtggggggagggcctgaggctaccctcagcataagtgatgtccgtaccctgagtgagcccccagacaagggggaggagcaggtcaacttctgtgagtcctccaatgactttggcccatatgagggtgggggtcctgtggcaggtcttgatgactcaggggggccaactccctcttcctatgccccctcccaccctcctcgaccgctccttcccttggacatgcagggcaaccagatcctggtcttcccgtcgtcgtcttcatcctcatcctcacaggctcctggccaaccaccagggaaccaagcagaacacggggcagtgaccgtggggggcacgtcggtggggagcctgggtgtgccgggtagcgttggtggggtccctggagggactggcagtggggacgggaataagatctttctgtgccattgtgggaaggccttctcccacaagagcatgcgggaccggcacgtgaacatgcacctcaatctgcggccgtttgactgccccgtgtgcaacaaaaagttcaagatgaagcaccatctgactgagcacatgaagacgcacacaggtctcaagccctacgagtgcggagtctgcgccaagaagttcatgtggcgagacagcttcatgcgccaccgaggacactgtgagcgccggcaccgcctgggcggggtcggggccgtacctgggcctgggactcccacggggccatccttgccgtccaagagagagtctcccggagtgggcgggggcagcggcgacgaagcgagtgcggccacgcccccgtccagcagacgtgtctggtccccacccagagtccacaaggtggagatgggcttcggtggaggtggaggagcaaactgaaggggcaggctactggggtggggtagctttcgggaaagggaataaggagcacgatgcaagggcgctgtggcccccgggtgatctcccaccacacttactgtcttcctttatctctgtggacttgtatatattctggaaggggaaccacagtttcaccatcgcccgcccattctactactcaacccctcccccccaaggtatttccagaactaaacccttcctttccctctgatgggtacactgaagcccctgctccacagagtagattgcacatggagggagggagagggggcgtgttgaacatcctgcagtcacagggtcaggggtcaggtggttgtagtctgtgcctgaagtctgtgtttgtgttgtcgtggagacaaggcctttgagccccacccttgtcctagaacctaccccctctcaaggatgcgctctttatttctaccctgtctctccccgccacccccgacttcccgtggaaattcccaactcggttctcatggaggagtgggtggagacaaggagggagtaagtcgtaggagtacaaggtttttattttttttaacagtgattaaaatatttattggtcatttacttggcttcccgaaaaaaaaaaaaaaaaaa

SEQ ID NO: 1318 - DNA, 5974 bp, Homo sapiens
cgggaagcgtttccgggggctgaaggcacaggctgaatctgttgcggcagctgaggctacaacaggcctgcgccggcggcagagaggatatcttgggcgggggatgtgagcgctgagcccttggcagaagtcaatgtgattttaatttgaagcaaaactgaaatgggttcttcttcctcattctattcatgttgctttttgatggccatggcataaggaactctatcccaggaatacagctttgcattagcaccgaacaagatttgtgatgaaatggagcctggaacaaactcttttcgggtagaatttcctgatttttccagcaccattctacagaaactgaaccagcagcgccagcaaggacaattatgtgacgtctccattgttgtccaaggccacattttccgggcacacaaagccgttcttgctgccagttcaccctacttttgtgaccaggtactcctgaaaaacagcaggagaattgttttgcctgatgtgatgaacccaagagtgtttgagaacattctcctatctagttatacaggacgtctagtaatgcccgctccagaaattgttagttacttgacagcggcaagcttcctccagatgtggcatgtggtagacaaatgcactgaagttttagagggaaaccctacagtcctttgtcagaagctaaatcatggcagtgaccaccagtcaccaagcagcagtagttataatggcctggtagagagctttgagctgggctctgggggtcatactgattttcccaaagcccaagaactgagagatggtgaaaatgaagaggagagcaccaaagacgagctgtcatcccagctcaccgagcacgaatacctgcccagcaactcgtccacagagcatgaccgcctgagcacggaaatggcaagccaggatggggaggagggcgccagcgacagcgccgagttccactacacccggcccatgtacagcaagcccagcatcatggctcacaaacgctggatccacgtgaagcccgagcgcttagaacaggcttgcgagggcatggatgtgcacgcgacctacgacgagcaccaggtcacagagtccatcaacaccgtgcagacagagcacacggtgcagccttcgggagtggaggaggacttccacatcggggagaagaaagtggaagctgagtttgatgaacaggctgatgaaagcaattatgatgagcaggtggatttctatggctcttccatggaagagttttccggagagaggtcagatgggaatctaattgggcacagacaggaggctgccctcgcagcaggttacagtgagaatattgaaatggtaacagggattaaagaagaagcttcccacttaggattctcagccactgacaagctgtatccttgtcagtgtgggaaaagtttcactcacaagagtcagagagatcggcacatgagcatgcacctcggtcttcggccttacggctgtggggtctgcggtaagaaattcaaaatgaagcaccatctcgtgggccacatgaaaattcacacaggcataaagccgtatgagtgtaatatctgtgcaaagaggtttatgtggagggacagtttccaccggcatgtgacttcttgtactaagtcctacgaagctgcaaaggctgagcagaatacaactgaggctaactaaaaataggatctggcccttgagtggcatgcacaaaaataaactatggtaattaatgcaaatctgggcacagatgatgcgtgctacttgctattatgagagaagcttaaaaaaaaaaaggaagatatttctgaaagaccagctctaagtaggccaattaaaaaaatctaattcctcaaatttgtgtgttccagtcctggcctggaatgggtaatggggtgagttaacccaccgcccagctggcaagggaaaccttctgactggttgtgatcgaaacaggtggacagagacacctgcacttggaactggactccacccaccagttccattttgggtggcagcagctttggatcactcattattacaaggtcatgctgaaattttattttgctcttgctatagatacttaggtaatgtggatttgttttggtagctatttcactgaaggaagtgctacttatataaaagctagaaataatgtgattcctaggatgagaaattggttaacagagctctgttgtctggttttagtctttctaaaggatattttaactaaaactatggagatgctaagagagtgactttctaaatatgaaacagataatttacggtacaaggctgacatagtgcccttgtcagtttctgtaagatgccactactgtcacaaggtgtttcagactcttgataaggcagtgttttgtattttagttctaacattgagtttggacaattttatctaattgtaattctctagggtgccagagataggtatttctcattggtttgctttcccaaatcctgtttggttaattgtagcctccatacagtggggtcttctctgtggctggtagacaccaagctgctgtgactgaccacggtaccacgggctgccacagcccctgctctgtcttagattatggtgctttacaaagagagtggtccatgaccacacttagtgagaaggagccacaagttgtggctgagagttccctgtgaacttgagtagttcatagagtgctaaggtgacactccaccaaccagagtgagagggcagataggcaggattctatgagtggttatacttaagggggacaaaactgcccaagaagaatcttgagaatacactctttcaaggtgggggagatactctttagagggtacactgagctaatactaccagttctttatgagcactggaatgtgtttgtaaaaggagtcctaagtttagcaaggtagtctacagaaccatgctcccacattatagataaagctgcttaaacttaaaagtccacaaagctacgccgaccagaaaaaaaaaattaaaaaaacaaacaagaaaagcaactattctgagaccttttctgcccatcagttagatgatttaggttaaaaagaaaggtaatattgcacatgcttttaagctgtgtaacatacctgaggttatcaccagggtaggacagggtgctactaccatgtcatcttttccacaatcgtactgggttatttacttctaaatagaaacttttttttcttaaaataaaaataatttttcttggatttggggtgaaattttatttgaaaagtttggctttgctgtaatgtaatagacattgctggcaatggcctctgattctcaagctcctaacaccagggtgtttacttgttgaacattgtctggaaagaggaaagaaaatacttatttaccagttaactcttgtaagcaagattacaaacagggatttattcacaacactgtatcattctcgatatataaaaagcactttgtatttaaaactttattataaatatatatatatattgtttttttttaaacctagaaactagatattacctcttggttgtttgccacattaatagcttctcttagtattgaaacgttactggttagcagtcttttctctgtgtacctgacacacgtatactgaggggattgtacaatcaagcctattgtctccttttctttcactcatggtagaggccagtgggttttaggtatgatcctagccattatatttgaggagaaattgttctattactcctactaatttcagtactaaggtggtgatgccattttgttctgccaaaaactgatcaccctctcccatggtattagcagagcattttctgcctgtttggaaggtttgatgtcctgtttctcattgaagactatttacatgatcattaggacattgcaggagaagtctgagaggtaaaaatacagatattctgggagagtcgtggtccttcagttctgctgaaatcagcatagtgcccttgtcatgaggaagagtttctgttcagccaagagtggtggcacgcttgggtggtagttttggaagcagtcagttgtgctaggacttatttaatatgttgtgaagagaagagtgtcttcttgaaagccttatgtgtccatcagctactaaatgtagaacttaaataagttgctcacatctgttcttttagtgttttgtggtatttgaggttttggcaaaaattgggatttttttatcaggcagccagagcctgggaggtggtagggtgtctgaaatgctggccatgttcagagaggcaggagaagggggttgctttcatttgaatattaaaagtgaatttttgtaaactctggtttttacctttttttcatccccacgttgagttggaggaatagtctcttctcttcacctcaatatagctttagaaaatctttatccttcctaataagtttggatggttgtgggtaacattgttcaaacaatctttcagggatcacgtcaatggcctacaaccaagctatttgtcccctactttgagtcttaactgtggtttttcttcaatccccatgggaaagggcttcaaggcaccaccagtggtatttaatattcatacttggggccaggcatggtggctcacgcctgtaatcccagcactttgggaggccgagatgggtggatcacctgaggtcaggagtttgtgaccagcctgaccaacatagtgaaaccccatctctactaaaaatacaaaaattagccaggcgtggtggcgcacacctgtaatcccagctactcgggaggcggaggcaggagaatcacttgaacctgggaggcggaggttgcagtgagccgcgattgcaccaccacactccagcctgcgcgacagatcgagactctgtctcaaaaaaaaaaaaaaaattcatacttatgccatgcttttacctttagatacacacgttacagtaatccacgtggtgaagtgcatgtcaccgttaactaaggaaggactgcggtaacttaccctgcagggctgtaggttgcctgcaggcgctccaggcccccagcctgttgattccgatttctaggtctcatcttcctctggtcccttttggccactactttaaaagcttgcccaaagggatcccctccattctagtgggcatttgctgaactaacctgcccctaaggctggcttctaaccaccggggaaagctgcttagcctccagggctccctccttgagaggctcacacacccccaagctgctgtggagtgaatttgagacggagcagaagctgcaaagctgtgctttccctggggaaggggatgtgctgcggcctcctgggtgggcgtggagagggcgccatcacaacgagtccaggtttttgcttttggaaggtctctgataatttaggggtgctggaaaccagcactgtgttatccccaatccctcctgtgccaccagttttgtgatttaggttgctttagtgggtgactaacttttgttcagtgaaaccagggtttgtttggggtttttttctttgctacttacatatttaaaggtacaagtttcttatttcaaatctctactgatagtgccctatggggagatgctggaacacattttgcaaatgtgacttttttttttttttttaatttttgcttgaagcctgtgtcatgttagttgctgctgccttctttccttttgtgaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttgaatagttttgtctttatatattgctgtcttcagtgtacagcatggttttacttaattgaatgttaatgtttaatattttcttcttatagaagagatcatgcccttttgtatgacatgttttaataaatgttatctgtcaactttgtaaaa

SEQ ID NO: 1319 - DNA, 1485 bp, Homo sapiens
aaacgagggggaacttccgttctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcaggcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggactggatacacgtctgtttaactacgcaaaaggtaatgctggcatggcttactgggaccctaagtgtggcgaagggactctgctccagtgaactggcgagtgtggaacctcctgacaccttctgaggacctcctgcctgccatgttgctgtggagctcgcactcctcaggcatcccctgatgttgagtgatacaaactctatcaccggaatcgatgctgctgcaatgacaagacttctttctggttttcagattctaaagtttaaaacaacgacaacaacaggagcgcttgaaagttacggtgcttctccctctccagtgtggactcgctgatgtttggaaagattggacttgctacagaaggtctttccacagtgatgacaccagtagggcttttccccggtgtggattctgtggtgtttattgaagttggagctgtggttgaaggctttcccacactccttacacttatatggcttctctccggtgtggagtctctggtgggagctgaggcccgcatgctgactgaagctcttcccacattcgttacactgataaggcttctccccagtgtggatccgatagtgacgaatgaggctgcctttcccgctgaaagccttgccacaatctttgcactgatatggcgcctcttctgtgtgcattctctgatgtttaagaaggtctgagctctgcccaaaagcttttccacacttacagtcatagggccggtccaccaagtgtgttctgtagtggagggtgaggtttgagctgtggctgaaagctttcccacacttggtgcacacgtaaggtttctccccagtgtgtgttctcctgtgtttggtgagatttgagctattactaaaggctttgccacattcagcacaaaaaaaaaaaaaaaaaaaaa

SEQ ID NO: 1320 - DNA, 150 bp, Homo sapiens
tatgaatgtaaggaatgtggaaagacttttagtcgagcctcgtaccttgtacaacatagcagaatccatactggtaagaagccctatgagtgtaaggagtgtggcaaggccttcagttctggctcataccttgttcagcatcaaagaatt

SEQ ID NO: 1321 - DNA, 3282 bp, Homo sapiens
agtacgaagacgaccgggctctcaagatggcggccccatgcggaaacagctccagggagcagccatgttgcttcctgaacaaagcctctgaagatgcggaacgggcaaaaccgcccagtacggaacggcgcagcctcgggagcccggtgtggtgctcgcggacaggaagcaggagagtttgccaatagggatgtgacagcggttcccattaagcggtgatggtggttttgggacctgataatcgagctgggagtcagaggcgggatgtgtgcggtgaaggatgttttgatacccccatataaaataatctgtctgtcatgggagcccccacgtcctctgaaatagttcagctctgtctgcatgacttgtcctgggactgaggaaaatttaccagtcatctggccttttggaagagcaaaaaatgatgaagtcccaggggttagtatcattcaaggatgtggctgtggatttcacccaggaggagtggcagcaacttgacccttctcagaggaccctgtacagggatgtgatgctggagaactacagccacctggtctcaatggggtatccagtttccaaaccagatgtcatctccaagttggaacaaggagaagagccatggatcataaagggagacatatcaaattggatctatccagatgaatatcaggcagatgggagacaagacaggaagagtaaccttcacaactcccagtcatgtattttggggacagtttccttccatcataagatactgaaaggagtcacaagggatggttcattgtgctccattttaaaagtctgtcaaggtgatggtcagctgcagagatttctagagaatcaagacaaactcttcaggcaggtcacatttgttaacagcaaaacagtgactgaggcatcagggcataaatataatccactggggaaaatatttcaagagtgcatagaaacagatatatcaatacagagattccataaatatgatgcttttaaaaagaacttaaaaccaaatattgacctaccgagttgttataagagcaattcaagaaaaaaacctgatcagagttttggaggtggaaaatcatctagccagagtgagcccaattctaatcttgagaagattcacaatggagtaataccttttgatgataatcagtgtggaaacgtttttagaaatacacaatcccttattcaatatcagaatgtggaaactaaagagaaaagctgtgtatgtgttacatgtggaaaagcctttgctaagaagtcacaactcattgtacatcaaagaattcatactggaaagaaaccatatgattgtggtgcatgcggaaaagccttcagtgagaagtttcatcttgttgtacatcagagaactcatactggggagaaaccttatgattgttctgaatgtggaaaagccttctctcagaaatcgtcccttattatacatcagagagttcacactggggaaaaaccctatgaatgtagtgaatgcgggaaagccttctcccagaaatcacccctcattatacatcagagaatacatactggggaaaaaccctatgaatgtagagagtgtgggaaggccttttcccagaagtcacagctgattatacaccacagagctcatactggagagaagccgtatgagtgtaccgaatgtgggaaagccttctgtgagaagtcccacctcattatacataaaagaattcacactggtgagaaaccctacaaatgtgctcaatgtgaggaagccttcagcaggaagacagaactcattacacatcagttagttcatactggggaaaaaccttatgaatgtactgaatgtggaaagacattctcccgcaagtcacagctcatcatacatcagagaacacatactggagaaaaaccctataaatgtagtgaatgtggcaaagccttctgccagaagtcacatctcattggacatcagagaattcacacaggagaaaaaccttatatatgtactgaatgtgggaaagccttctctcagaagtcccaccttccgggacaccagcgaattcatacaggagagaaaccttacatatgtgctgaatgtggaaaggccttttctcagaagtcagaccttgttttacatcagaggattcatactggggaaagaccctatcaatgtgctatatgtgggaaggccttcatccagaagtcacaactaactgtacaccagagaattcacacagtggtaaaatcataatgaactggccacagaaaagccttagtattagctcaagccttaataattactagaaacccaattaatttgataagcttggggacaacatcccaatagataaaaatttttaagggaatttgtttctagtttggtgatgcctaacttttccagcaaagatgatggaaaatagttatataaatgaagaacatttttaatatggcatgtaaagcttttaaagttatgaactcagtgatcagcacagcaagttaagcatacagaatattgtcaagttgcatattccttatactacaaaatgataatcagccattgtgaaactgctaatattagcttgtcataattatggccataaactaatttttctataaaagacgtggaagaaagcttaagtaaacaataaaataaaacctatacactattttaagaaggggcttgagcatgacccctaaagctacatgtaaagttcttgtacaaaaaatggaatgataggttgatcagattcagtaaagttgatctgtatgcattttcccatctcaagcatataagttgacctgcatctctggaaggaccttgagattgatgcattttgagcaggtctcccttttactcttcccaactgggaacttggagctgaaaaacattggcactgaggccagatggccttgggtttaatcctggctcagtgcctcacagattgtgtgactttaggcaaacatacttctcctagctgagtattttttatcagtaagtacaaatacaatgcagagctcattttcagttaatattagtactttttaaatctttactctctatcttgaagcattagatgttaagactaatgtgtaaaaaccacgtctgagcttgcttttccctctggacactctgcttttgattgcctatccctataagtggctcattttactgtcttctgatcctggtggccttatttttgctatgttaaggttgtgttttttaatacttggatttattttcatatacttacataaaccgtggtgattgcacataaagaccctgaaaaaaaaaaaaaa

SEQ ID NO: 1322 - DNA, 2665 bp, Homo sapiens
gtgggcggtgcactgggtcagtcccgcgatagcttcaggcctggcggcggcttccaagctaaggaacggtttggggcagtgtcgttcccggaggtcggccgccgttacccgctcaccagctacgcggcgcgtcaggtccgcggaggcgcgggctcggggcgcctgcgggacggtgaggccctgctgaggactccggacactgcccatctctaagataagaacctggaaaggggactctgttggccattggaaattgcagaataatgtctcaggtgacatttagtgatgtggctatagacttctctcatgaagagtgggcatgcctagattctgctcagagggacttatacaaggatgtgatggtccagaattatgagaacctggtctctgtaggtctttccgtaactaagccatatgtgatcatgttattggaggatggaaaagagccctggatgatggagaaaaaactgtcaaaagattgggaatcaagatgggaaaacaaggaattatcaacaaagaaggatatttatgatgaagattcaccccaaccagtaacaatggaaaaagttgtaaaacaaagttatgaattttcaaattctaataagaatttggaatatacagaatgcgacacatttagaagcacctttcattcaaagtctactctttctgaaccacaaaacaattctgctgaagggaattcacacaaatatgatatattaaagaagaatttatcaaaaaagtcagttataaaaagtgagagaataaatggtggaaagaaacttttaaattctaataaaagtggggcagccttcaaccagagcaaatctcttacccttccccagacttgtaatagagagaaaatctatacatgcagtgaatgtgggaaagcctttggcaaacagtcaatcctcagtcgccactggagaattcatacaggagagaagccctatgaatgtcgtgaatgtgggaagacttttagccatggttcatcccttacacgacatcagataagccatagtggagagaaaccttacaaatgcattgaatgtgggaaggcctttagccatggctcatcacttactaaccatcagagcactcacacgggagagaaaccgtatgaatgtatgaactgtggaaagtcttttagtcgtgtgtcccttctcattcagcatctaagaattcatacgcaagaaaaacgctatgagtgtcgtatatgtggaaaggccttcattcatagttcgtctctcattcaccatcagaaaagccatactggagagaagccttatgaatgtagagaatgtgggaaagctttctgctgtagctcacaccttactcaacatcaaagaattcacagtatgaagaaaaaatatgaatgcaacaaatgtctcaaggtctttagtagcttctcatttcttgttcaacatcagagtattcatactgaagaaaaaccgtttgaagtttagaaatgcaggaaatccttcaaccagcttgaatcactgaatatgcatttgagaaatcacattagattgaaaccctacgaatgcagtatatgtgggaaagcctttagtcataggtcgtccctgcttcaacatcacagtattcatactggagagaaaccttacgaatgtattaaatgtgggaagaccttcagctgtagttcaaaccttactgtacatcagagaattcatactggagaaaagccatataaatgtagtgagtgtgggaaagcttttagcaaaggctcgaatcttactgcccatcaaagagtacataatggagagaaacccaatagtgtggtaagtgtggaaaagcctttagatcatatgaatccctatacatgtgagaaatcttacagaagagaagcagtgtttatcacggtaaacttcattcatagatcctcccttatttaacatcagaaaaatgtatactggggaaaagttgtatgaaggtggtgaacatgggagacttttagcaatgatgcagatttttttattagagtttatactgtagagaaatcatatgaagtcaataaatgtgggaaagcctttgtcagtattaatcccttaattgacctaagtatactcacactaggaaaaatctgtgtacatgtagcaaatgtgggaaagactataggcaataggaatctcctgcaaactcctacaggagaaaagttgtatgaatgtggaaactttagaaattgaaggaatttttcagttccaagtgcatcccttattctataggaaataaactggagacaaatctcatttaagagatgcagcaaagtgttcactaagagtgtttatcttgccagacataagaagatgaatggtagagcaacctgaaggatttagaaattacatataaatctttgcagttatgctatttgtaaacaggattatataggagagcaaataaacataagtatgcatttcttagagcagtagcttgcagtttcagttgagttctacttagaaattctttttagctagtgggcatgtgaagatatttagtcacccagaggagccagtaaatgttataatgttaaaaattaaagctgcaaaagaaataaaatggtgttaataaaaatttggcatctaataaaatcattttgtatatcatgaacaaaaaaaaaaaaaaaaaaaaaaaaaaaaaaaaaaaaaaaaaa

SEQ ID NO: 1323 - DNA, 4417 bp, Homo sapiens
ttcctatgcccggtccgtgcattctggttgtgaaggctgagttctagagatcgggtcggctttctacgcggctctcgtggaacctagcaaagaaagacagtgaagactgcaggaccttccttcgcgcttttgttacaatccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcccgagggcgtccagcgcggtggaggcgtggggtttcggctgagcccacagggcacagactgttcatccgcttctcatggcagcggcggtgctgatggaccgggttcagagttgtgtgaccttcgaggatgtgttcgtgtacttctctcgggaggagtgggaactccttgaggaggcacagagattcctgtaccgtgatgtgatgctggagaactttgcacttgtggctacactaggtttttggtgtgaagcagaacatgaggcaccttctgagcagagcgtttctgtagaaggagtgtcacaggtcaggactgctgagtcaggtcttttccagaaagcacacccatgtgagatgtgtgacccactcttgaaagacattttgcacctggctgaacaccagggatcacaccttacacagaaactgtgcacacgtgggctgtgtaggagaagattctcgttcagtgcaaacttttaccagcaccagaagcaacataatggagagaattgcttcagaggggatgatggaggggcctcatttgtgaagagctgtacagtccacatgttagggagatcctttacgtgcagggaggaagggatggacttaccagatagctctggccttttccagcaccagaccacttacaatagggtgagtccatgcagaaggactgaatgcatggagtctttcccacacagctccagtctcaggcaacaccaaggagactatgatggacagatgcttttcagttgcggtgatgaagggaaagccttcctggacacctttactcttcttgacagccagatgactcatgctgaggtgagacccttcagatgcctaccatgtggaaatgtgttcaaggagaaatcagctcttattaatcacagaaaaatccacagtggagaaatatctcatgtgtgtaaggagtgtggaaaagccttcattcacttgcaccacctaaaaatgcaccagaaatttcacactggaaaaagacactatacatgcagtgaatgtgggaaggccttcagccgcaaggacacacttgttcagcatcagagagttcacactggagaaagatcttatgactgcagtgaatgtggaaaagcctacagcagaagctcccaccttgttcagcaccagagaattcacacaggagaaaggccttataagtgcaacaaatgtgggaaagcctttagccgtaaagacacacttgttcagcaccagagatttcatactggagaaaggccttatgagtgcagtgaatgtggaaaattctttagccaaagctcccaccttattgagcactggagaattcataccggggcaaggccctatgaatgcatagaatgtggaaaattctttagccataactctagcctcattaaacatcggagagtccacacaggagcaagatcctacgtgtgcagcaaatgtgggaaggcctttggctgcaaagacacacttgttcagcaccagataattcacactggagcaaggccttatgagtgcagtgaatgtgggaaggccttcagccgtaaagacacacttgtgcaacaccaaaaaatccacactggagaaaggccttatgagtgtggtgaatgtggtaaattcttcagccatagctccaaccttattgtacaccagagaattcacactggagcaaagccttatgagtgcaatgaatgtgggaaatgctttagccacaactccagcctcattttgcaccagagagttcacacaggagcaaggccttatgtgtgcagtgaatgtgggaaggcttacattagtagctcccaccttgttcaacacaagaaagttcacactggagcaagaccttatgagtgcagtgaatgtgggaaattctttagccgcaactctggcctcattctgcaccagagggttcacactggagaaaagccttacgtatgcagcgaatgtgggaaagcctatagcagaagctcccatcttgttcgtcaccagaaagctcacactggagaaagagctcacgagtgcaacagttttggtggccctttagctgcatctcttaaacttgtttaacaccagaaaattcacacaagagaaaggccttatgaatgcagaaaatatgtcatcttgttcatcctcataggactcacaccagagcaatgctctgtgagtaccctttgtgagggaaccatcagctagcagatgagcaccgtatattcattccaccctggggagattcctgataagcaccacatatgtgggaggctttcatgaggtgtgttgcactttgtaactgtctagagctcttgatggaattatatcactgccagtgcctgtggcggaagccatcttattgctaccagctgtgtgtgtcaatcactccattttgctcagggaaggcagacttctgtgctttctttcctgttccctacaggtaatcatgaatattttcaaggacttccccccccccccacttcaccccctaccattgagggtcctcatcttttccctcatgattaggttctgagcaaacatgatctagctctcaccaaaaggacctgagctagggtctgctgggatttcctgacacgattttccatcttcatggacaatgttaactgtaaacgtgatagctgtgacttacttgtcttactgccaaatcgcccaaatttggaactgcttgtcccatgctgctctgatttatacagtgataagggcctattgtggcagtctttactcttggggattttgttactgtgtagagtggattgagaaaagaattgggttctgtcatgaagggagtagcaccttttgtgggcaccacctttatgtgcctcagaggggaccaaaggatggcagaaaactgttctcagtctagtttgacctaatttacactattgccctaggcttgctaggaaagactgaaaaaatttttgtgcctaactttgtggcctggctgccaggatttcctgtgagcccagtgaggagggcatagttggtgcgaaaatctcctgtgcttgtggaagcaacataagttgggtcccttaactgtcacgtactccccagcactgttgagggattgctgtcttctgtacctgtacaggatcaagtccctgatatccagaaccccataggcaagtaacattgactgtaagacctctgtagggcaatgtgaaaatcatgattgctacagaagcactgagataatggagtggggatgactgtggcaaacaaaaggagattcgaacattctagaggggcatccacaagtctcggtgcagttatgatggtgtgggatgggagtgcatagaaattctcaggaccttcagacatctgtatctcctgtggccaaggccactgtcagaggaaataatctaaatgtttgtggattcctgtgtctccctgggcagttgacctgcacagacaggaacctcagcagtgacagaagagagatccagggatgggtcttctctgacccagccagcattccgagtgactgaggtggatgtggacatcattgcttaccaatttttaccaacattgaggcagggctcactctcctaaattgtagggagaggaatatggtaaagccaaaatagttgacagatctaactttcctagtggaacagtatatatagattttaatgaggaacatttatttaatagctttatggaggtatgattaacatgcaataaactgcaaatatgtaaagtgtaaaatgtgctgtttcagcatgtgtgtacacctatgaaaccaccacagtcaagatatccaacacaacaaaagattgtccctttataatcctcaatttttccttatcttgttttccacaattcacaagcaacagcaagcattttctataattttataaatgaaaccatatggtgtgtactttttagggggtggggctctggctttttcagtaaacataactattttaaggttaatccattatcttgttgcatgaatcaattgtttgctcatttgtattgctgcgtagtatttcagtatttcattgtataccacaatttttcttctttgtcaacttaattgttatggatgtttgggtaactttcagtttttggctattacaaataaacctctgaagatttgtgtgcaaa

SEQ ID NO: 1324 - DNA, 3931 bp, Homo sapiens
gggtcccaaaagggttcgaggcctcttgccttcgctccgtaggagggagttctcttctggccctgggggccgcaggactgtccaggaatacagtttccaggtgagatcttacttgaaacaccggtagttctagcacagctaaaatggcatctacttgggctatccaggcccacatggaccaggatgaacctttggaagtaaagatagaggaagagaaatataccaccagacaggattgggacctgcgtaaaaacaacacccatagcagagaggtcttccgtcagtacttcagacagttctgctaccaggagacatctggtccccgtgaggctttgagccgactccgagaactttgccatcagtggctgaggccagagacccacaccaaagaacagattctggagctgctggtgctggagcagttcctgaccatcctacctgaggagctccaggcctgggtgcaggagcagcatccagagagtggggaggaggtggtgactgtgctggaggatttagagagagaactggatgaaccaggagagcaggtctcagtccacactggggaacaggaaatgttcttgcaggagacggtacgtctacgaaaagaaggagaacccagtatgtccctccagtccatgaaagcccagccaaagtatgaatctccagaacttgaatcccaacaggagcaagttttagatgttgagactggaaatgagtatgggaatttaaagcaagaagtttctgaagaaatggaaccacatgggaagacatccagtaaatttgaaaatgatatgtccaagtctgctaggtgtggagaaactcgtgaacctgaagaaataacagaagagccctctgcttgctccagagaagataaacaacctacctgtgatgaaaatggagtaagcctgactgagaactctgaccatactgaacatcagagaatctgtccaggagaagaatcttacggatgtgatgactgtggaaaagcttttagtcagcactcacacctcatagaacatcagaggatccatactggagatagaccctacaaatgcgaagaatgtggaaaagctttccgtgggagaactgtgcttattcgacacaaaataatacacactggagagaaaccgtataagtgtaatgaatgtggcaaagcctttggccggtggtcagctcttaaccaacatcagagacttcacacaggagaaaaacactatcactgtaatgactgtggcaaagcctttagtcagaaagcaggcctctttcaccatatcaagatccacacaagagacaaaccttatcagtgcactcagtgtaataaaagttttagtcggcgttccatacttactcagcatcaaggagttcataccggcgccaagccgtatgagtgcaacgagtgtggaaaagcctttgtttataactcatcccttgtttcccatcaggaaatccaccacaaagaaaaatgctatcagtgtaaggaatgtgggaaatccttcagtcagagtggccttattcagcatcagagaattcacactggggaaaaaccctacaaatgtgacgtatgtgaaaaagcctttattcaaaggacaagtcttacagaacatcagcgaattcacactggagaaagaccctataaatgtgataagtgtgggaaggcgtttactcaaagatcagtcctcacggaacatcagagaatccacactggagagaggccctacaagtgtgatgagtgtgggaatgccttccgaggaatcaccagcctcattcagcatcagagaatccacactggggagaagccctaccaatgtgatgagtgtggaaaagccttcagacagaggaagaagaccagctacaaggaaatacttctgaaaaatcactctgaaccccaagctggagtgaatcttctcctgagctctctcattccagaatggcaatcttgtttcaggagagatctctaatagtgactgatggtaaaggaagaaggctgtgcctagaacaaagaatcaggctggcaaagaaatcacaggtctttcctcaaactttaaattgctactctctggagatagctacctggactttacagagctgtcagaagacttgggaaggtttgccagcattggaaaaagccacttggacttcacagagctgtcagaagacttaggaagctttgccagtagttcctgagaccagaaatacatattatgaagcaggtgctggaacaggccctggcccctacttgtgaagctgcagatatagatggtgttactgagaaggaaactaaggacttggctccaaaacaaaacaaaacaaaatctggagatgctgaattttgttggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccacatgagagagagactgcataaatgtaataactgaggaggcctttgttcagcaaagaaaccttatacaaactcgtataaagaatgtaggaagaccttcacccagaagccaggactgactgtgcaccagagaatctgcacaataaacctgatgaatgtggagatgcttgcttcagcattggagaattcacagtaaagggaaaccctgccagtgtgatgagtacggaaaagtcttcagaggttggaacttgggaaaaatcagtgagtgaattcatattagagaggctcttataaatgagaggattgtggaaacttgtatagacagagatcagacctcaacaagggagcctccacagtattgaaaagttaatataattaatgtaagtgggcaagttgtatggggaatgggtagtctaaattgctcattttagccagtaaaaacattaaattagtttcttagatcaagaaaaggaaatgttagaagttatttttcccttccagaggggtctatatgtgtaagcaaccaggacttttgaaataagttgcatctctggatttgtgatctgtctcctggatgattatctctgttttgggagacaggtattttttcttcatgcctgctctagtctcatctcatatctttaattcattcagcaagtatacacaatagtattatcgtctactgtttgttgtaaatatatatatattattttctttttggtctgagtaggcttgtattggtaccctaggacataaaaatcacatatatcatgtttcagtaaatgcagtgaaaggaactatattattaaattgctgggaatttctgtaaatttgagactacctttatattctccaacacaagaccgtgtaggtgtcccttcagagagtatatttttctagcttggcttctttattttctttatttttttgagatggagtcttgctcctgtcgcccaggctggagtgcaatggcacgatctcggctcactgcaacctccgcctcccaggttcaagtgattctcctgtctcagtctcccgagtagctgggattacaggcacttgccaccattcccagctaatttttgtatttttagtagagacggggtttcaccatgttggccaggctggtctcgaactcctgaccttgtgatctgcccaccttggcctcccaaagttcagggattacaggcatgagccaccatgcccggctgttttttttaagatagaaaaatatacttcatgtatagcctattgacagataatgactgatattttttcttatagataacacataataaacattgtgaagactaaaaaaaaaaaaaaaaaaaaa

SEQ ID NO: 1325 - DNA, 2312 bp, Homo sapiens
agtggcttctgtgccccgccctgcgggtggtttgctagtttcaagcactttgtgagtatggggtgaatcggcgtcggccttccactgtggggttaaatctcatcccgcggctctcctcctgtcggtcctgcagttcttttgtccccgggtagagggatcttctgcagaaatagcgctggaagctagagtgaggcctgagtactgccttggcctaggatggctagagaattaagtgaaagcacagccctggatgcccagtctacagaagaccagatggagcttctggtcataaaggtggaggaagaagaagccggttttcccagtagcccagatctgggttctgagggctcccgcgagcgcttccgaggcttccgctacccggaggctgcaggcccccgcgaggcgctgagtcggctccgagagctctgccgacagtggctgcagcctgagatgcacagcaaggagcagatcctggagctgctggtgctggagcagttcctgaccatcctgccggggaatctgcagagctgggtgcgggagcagcatccagagagcggggaggaggtggtggtgctattggagtatttggagaggcagctggatgagccggcgccgcaggtttcaggtgttgaccaggggcaagaactgctctgttgcaagatggcactattgacaccagccccagggtcacaaagtagccaatttcagctaatgaaggctctgctcaagcatgaatctgtgggatcccagcctttacaagatagagttctccaggtccccgtgcttgcccatggaggatgctgcagagaagataaagtggtagcttctaggcttactccagagtcccaggggttgttgaaagtggaagatgtggccctgaccctcacccctgaatggacacagcaggattcatctcaggggaatctctgtagagatgaaaagcaggagaaccatggcagcctggtctccctgggtgatgaaaaacagactaagagcagggacttgcctccagctgaggagcttccagaaaaggagcatgggaagatatcgtgccacctgagagaagacattgcccagattcctacatgtgcagaagctggtgaacaggagggcaggctacaaagaaagcagaaaaatgccacaggagggaggcggcacatctgccatgaatgtggaaagagttttgctcaaagctcaggcctgagtaaacacaggagaatccacactggtgagaaaccctacgaatgtgaagagtgtggcaaagccttcattgggagctctgcccttgtcattcatcagagagtccacactggtgagaagccatatgagtgtgaagaatgtggtaaggccttcagtcatagctcagaccttatcaagcatcagagaacccacactggggagaagccctatgagtgtgatgactgtgggaagaccttcagccagagctgcagcctccttgaacatcacagaatccacactggggagaagccgtatcagtgcagtatgtgtggcaaagcctttaggcgaagttcacatctcctgagacatcagaggatccatactggggataaaaatgttcaggaacctgagcagggagaggcctggaaaagtaggatggaaagccagttggaaaatgttgaaactcccatgtcttataaatgtaatgagtgtgaaagaagtttcactcagaatacaggcctcattgaacatcaaaaaatccacactggtgagaaaccctatcagtgtaatgcgtgtggaaaaggcttcacccgaatttcataccttgttcaacatcagagaagccatgtagggaaaaacatcctatcacagtgacccatgccatacatgccagagttggtgctcatttgtcactgatctgaagccactccccctggagtctcaactatagaaattgtgggctgggctttatttaccactacacattatcaggtgttagaaaatgtagactgggttagacaaattatcttctaagttctagaaggggtttgtaatcaaaacatatttgataggaggctacgggagagttgtctagaagaggtaagacctgaaactgtttgttctctcccactagaattaaatggatgtttagactggctacttgccctaaaccagcacttggtgatgtctactgggtggatggttgtgatttgggggctgcttctctgaccattctttttgactgtaatgaatcctccacagttggtcagattcataaagtcttatatccccctctgtgccttttctgcaggtgctaataaatgtttattgaatgtaaaaaaaaaaaaaaaaaa

SEQ ID NO: 1326 - DNA, 4243 bp, Homo sapiens
agcattccccgcacgagcccgggagcacttccgccctgttgtgaagtgggtgtctcgagccttggggagcagtcccttttctaggagcctcttgaaggactcaccgtagatgcaggaagacattggatgaggtcagcatagctgaagtgaggtgtctgggttagacaatggctatggccctggaattgcaagcccaggcatctccgcagccagagcctgaagaactcctgattgtgaaactggaagaggactcttggggatcagaatccaaactctgggagaaggaccgtggctctgtctctggcccagaggcctcccgccagcgcttcaggcaattccaatacagggatgcagctggaccccacgaggccttcagccagctctgggctctctgctgtcgttggctgaggccggagatccgtctcaaagagcagatcctggagctgctcgtgctggagcagttcctgactatcttgcctagggaggtccagacctgggtgcaggcacgccaccctgagagtggtgaggaggctgtggccttggtggaggattggcaccgagagaccaggactgcaggacagtcgggactggaattgcatacagaagagaccaggcccttaaagacaggggaagaagctcagagcttccagctgcagccagtggatccctggcctgagggacagtcccagaagaagggggtgaagaatacatgccctgaccttcccaatcacctaaatgccgaggtggcaccacagcctttgaaagagagtgctgtcctcactccccgagtccctactctcccaaagatggggagcgttggagattgggaggtgacagctgagtcccaggaagccctgggccctggcaaacatgctgagaaggagctctgtaaagaccccccaggagacgactgtgggaacagcgtgtgcctgggagttccagtttcaaaaccaagtaatacctccgagaaagagcaaggaccagagttttggggtctaagtcttataaattctgggaaaaggagcactgcagattacagcctggataatgagccagctcaggcattgacctggagggattcaagagcctgggaggaacaataccagtgggatgtggaggacatgaaggtgtcaggtgttcactggggctatgaggagaccaagactttcctggcaattttgagtgaatctcctttctctgaaaagctccggacttgtcaccagaaccgccaggtatatcgggccattgcagagcagctaagggcaaggggcttcctgcggacactggagcaatgtcgctatagggtcaaaaacctcctacggaattaccggaaagccaagagcagccacccaccaggtacctgccccttctatgaggagctggaggccctggtcagggctcggacagccatcagagccacagatggcccaggagaggccgtggcacttcccaggctcggggatagtgacgcagagatggatgagcaggaggaagggggctgggatcctgaagaaatggcagaagactgtaacggtgctggcctggtcaatgttgagtctacccaggggcccaggattgcaggggccccagctctgttccagagtcgtattgcaggtgtgcactggggctatgaggagaccaaggccttcctggcaattctcagtgagtccccattctcggaaaagcttcgtacctgtcaccagaacagccaggtgtaccgggccattgcagagcggctgtgtgctctgggcttcctgcggacactggagcagtgtcgctacagattcaaaaacctccttcgaagctaccggaaagccaagagcagccacccaccagggacatgccctttctatgaggaactggactcgctgatgagggctcgggctgcagtcagggccatggggactgtccgagaggctgcaggtctccctaggtgtgggcagagtagtgctgagactgatgcccaggaggcctggggtgaagtggccaatgaagatgctgtcaaaccttcaaccttgtgtcctaaagccccagacatgggttttgaaatgaggcatgaggatgaagaccagatttcagagcaggacatttttgagggtttgcctggagccttatcaaaatgtcctacagaagctgtttgccaacctcttgactggggagaagacagtgaaaatgaaaatgaagatgaagggcagtggggaaatccctcacaggaacagtggcaagaaagttcttctgaagaggacttagaaaaacttattgaccatcaaggcctgtaccttgcagagaaaccctacaagtgtgacacatgcatgaagagcttcagtcggagctcccacttcattgcccatcagcgaatccacacaggtgagaagccctacaaatgccttgaatgtggaaaaaactttagtgaccgctctaacctcaatacccatcagagaatccacactggagagaagccctataaatgccttgaatgtgggaaaagctttagtgaccattctaatctcatcactcaccagagaattcacacgggggaaaagccctataaatgtggagaatgttggaaaagcttcaaccagagctcaaaccttctgaaacatcagagaatccacttgggaggaaatcctgaccagtgtagtgagcctgggggaaactttgcccaaagcccatcttttagtgctcactggaggaattctacagaagagacagctcctgaacaacctcaaagtatcagtaaggacttgaattctcctggaccacacagcacaaactcaggggagaaactttatgagtgttctgaatgtggaagaagcttctctaagagctctgccctcattagtcaccaaagaatccatacgggagagaaaccatatgaatgtgccgaatgtgggaaaagcttcagtaagagctccaccctggccaaccaccagcgcacccacactggagagaagccgtataaatgtgtggactgtgggaagtgcttcagtgagcgctccaagctcatcacacaccagagagtgcacacaggagagaagccctacaaatgccttgagtgtggaaaattcttccgtgaccgttctaacctcattactcaccagaggattcatacgggagagaagccgtataagtgcagagagtgtgggaaatgctttaaccagagctccagtcttattattcaccagagaatccacacaggggagaaaccctacaagtgcacagagtgtggcaaagacttcaacaacagttcccacttcagtgctcaccggagaacccatgcaggagggaaggcgtcgtaggggacagtttcctcaacaacaaaggaggactcaatgtatatatcttatatcataagatgtatgctagagataaactttccaatttttaagcttggtgtgtacccagggaagttatcttggtataaaccaggtaatttggaagtgaattacaaatactaaggatccagatttgaaggcacttttaagtgtaatttgtttttcttctgtaaagacccacacagaatcctgactgtccttgtatttgctatcatgtaagagctgtgtcagtatttgagccaaactggcaacttacgagattagagttaaatcagtggtcctgagcagtgattccaaactctcactgtgccttcacaccatccatgtgtaatccaccccatcagcagtggttctcctactttctcagtgggggcatatcctcaagggagaatgttgtgactctggtgagagaggagttggcctagagcaggccactgtgagctcagcacagagtaggaagaacagtgacatcattacaaaatcatcaatagcagcaatagctggtgtttattgagctgttgctctttggcaagctctgtgctaagaactttgtatacatcatctcatttaatcttcacaacggccccaggagataagtactaactttctccccatttcctagaggcttgggaaattaagtaactcgcactggtcacacatctgtaagtgggagaggcaggattcaacagatctgtctgtcttgagtctatcgtgctcttattgctatactgaattcccattcatgttaggtaacttaggggccagaatctccatgcactttgtagaccacatttcctgttatgaaatttccacattttgaattttttaaacaaatatggaaactgagaatccctaaggattaaaggacttgggatatccagaaaaaaaaaaaaaaaaaaaaaaaaaaa

SEQ ID NO: 1327 - DNA, 2478 bp, Homo sapiens
atcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacctggcgtccgagccgtggagctcgagcggcagatcgagagcacagagacttcttgccatggctgccgtaagaatttcttcctgtccaagatccggtcccacgtggctacttgttccaaataccagaattacatcatggaaggtgtgaaggccaccattaaggatgcatctcttcagccaaggaatgttccaaaccgttacacctttccttgtccttactgtcctgagaagaactttgatcaggaaggacttgtggaacactgcaaattattccatagcacggataccaaatctgtggtttgtccgatatgtgcctcgatgccctggggagaccccaactaccgcagcgccaacttcagagagcacatccagcgccggcaccggttttcttatgacacttttgtggattatgatgttgatgaagaggacatgatgaatcaggtgttgcagcgctccatcatcgaccagtgagcagagtccgtgcttgctatctgtctcatgttacagagcttccattacatattaaacgtgaaatctatgactcctgtaccttacctgttcaacagacctgaaaatgagccatggcattgggacagggtcacttctgacaggggaagtgggtccccaggtcagcccttctcttccctttgggctcttgccaaagctgtcttcccctactgttaaccttgtttgtcacacggtcgagttcgtattggttctcggctacttcctggagcttctgccgcctcctgtggaagataatctagcttctccacctcttgtttcacactcattcctcccatccagtgtttgtctctcgggtccttcaagccagccaggaccttttctgggtcatgaatagcacaatgaagcaagtgtctcctttccttgtccccaaggtgtgcagactttggcagccgtgcacctgaccagagctgaagctcccgctgggctgtggggttgccagaagctggggttgccatcccggggtacatgtcaccagtcctcttggggttttgtaccatctgatgctggaagttttgattagtgatattttctactactacatatttagagttcactggttcagtcttaaatgcctgcatggtgcctttttaggataaggtataaccatacatttttggtggaagtgtttctgggttagggaagttaaagtctgtttatccgtaagtggggaggagggtcagctaagagaagtgggagggccagagctttttggttctgatttacaaattaatgaagtagtttcaaacaacgcggtcatgtttacctctccatttgggagcctgcctacattcttgttctagaagcacaaaaaatcctcagatgaattagaagaaagaggtttggggactcagcggatactagttcttttaccttctgcttggtaacttagattaaactgagcattgtttttctgtcacaaatgttttccttatgacactggtttcgacatgtaaaatgtgtttgaaaacctgctttgtagatgcagagagaagctataggaaacccagtaccacccctggtctgttctgacgagacatcgttcataaggcacagcacatcgcaagatgaacagttgttaataaaagctgttgctggaaacttgctttaggaacagctcaagaaccttggagttcatatttcacaaatattaataaatataagtccaagagctgtcagcctaatctgtaggagcagaacctctgattgaccaaaaggcatatgggtttaggttggttttttgatgtcatatgtctctgatggggctgcaagtgctacctcgcgcttgtacactgctgctgtggggctccgcgcctgccggtgaagagctgcagatgccgagaagccagcaaacacagggcccactggaaaaaaatagttttttcattagtatttctcgggaggacccaaaagttaaggtcagcttgttcactgtaatttctggaagaagttcactcagaccttcctgaattcagatcatctcagaagtctggagggaaatctggcgaaaccttcgtttgagggactgatgtgagtgtatgtccacctcactggtggcaccgagaaacttacttccttgtattaagtgcacttcttgtatttctaataagatgactttccagaaagtgagatttgttatgttctggcttttaaaaggtaaaatataaataaatttcataacttaatctaaaaaaaaaaaaa

SEQ ID NO: 1328 - DNA, 4072 bp, Homo sapiens
ccattactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacatgaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggccgcaaaccacggccagctgcttgtctttgtatggcttgccagctaacaatagtggttccatctttaaggaagaagaatgtttgatggagaaaatttgtggccaatgaagtctgaaatacttcctgtcatctgcccctttccagaaaaacttggccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgcacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtaccatccatgtctcacagccctggccactgacagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaagctgcaaaaaaaaaaaaaaaaaaaaaaaaaaaaa

SEQ ID NO: 1329 - DNA, 4220 bp, Homo sapiens
cacagcggacctacaggcgctcagagaagcccaccttccccctctctgtcccgagaaggcttagagtggtacctgcttgctcaagcaacctgctgcctccacccagagcagccgctcctctcctccctcccttccggaagatgctgaggatgacagcttttagcctgactcttacatttctttggcagagcagttagaggccagactgtcctgtgaaggcttctccttccttcttcctctgctcaggagaaaacttacaaacttttaaatgtaagaggcagatgagctgggaacctggaagtgggttgcatctgactctgaaagttcctccctctcgctggcattacctcatgctgccacaaagtgaacggatcactggggaaggcagagtctccccggcactgctgggaccctcccttgaagagcccccatgtcctgtaggcagagccttgtagtctgtccgcttggttactgactcgggctgtctgaccagcccctcttctgtgccttgtctgaggtccttgtccatctctgtgattgggcagcttctctctctggattgggtcacgtgaagcgggaaactgaagccattactctccaaaccctgtttcatcttcccaagcatgtcggaaagctggcaacagccgccacagacgcagccgcagcagccacagccaccgcagcctcagcaccatgcagagccaccgccagccctggcagagcacacgctgcctccgggcacggcggagaaccccctgggctgtgctgtctatggcatcctcctgcagccagaccccggcctgcagcccccacaacacgcacccctgcaggcagcaggagagccaggccccaaatgtggcgtgtgtggtcacgacctggcgcacctgtccagtccgcatgagcaccagtgtctggcgggccatgaccgctcattccagtgcacacagtgtctcaagatcttccaccaggccactgacctgctggagcaccagtgcgtgcaggctgagcagaagcccttcgtctgtggggtctgcaagatgggcttctcactactcacctcactggcacagcaccacagctcccacagtggcctggtgaagtgttccatctgtgaaaagacctacaagccagctgaggcagcggagccagccaccacagccgccccgtcgcttcccgcagcacccgcgccttccactgtcacccctgctgaacaggccgacaagccctacagctgccccatctgccaaaagcccttcaagcacctgtcggagctctctcggcatgagcggatccacaccggtgagaagccctacaagtgcacgctgtgtgacaaaagcttcagccagtcgtcgcacctggtgcaccacaagcgcacgcacagctccgagcggccctacaagtgcgcagtctgcgagaagaccttcaagcaccgctctcacctggtgcgccacatgtacgcgcactcgggcgagcaccacctgttccgctgcaacgtgtgcgagttgcatttcaaggagtcgtcggagctgctgcagcacccgtgcacgccaagtggggagcggcccttccgctgcggcgagtgccagaaggccttcaagcggccctcggacctgcggcagcatgagcgcacacacagcgccgagcggcccttcaagtgcgacctgtgccccatgggcttcaagcagcagtacgcactgatgcgccaccggcgcacacacaagaccgaggagcccttcaaatgcggcctatgtgagaagggctttgggcagcccagccacctgctctaccaccagcacgtgcacaccctcgagactctcttcaagtgccccgtgtgccagaaaggctttgaccaatctgccgagctgctgcggcacaagtgcctgcccggcgcggccgagcggcccttcaagtgccctgtgtgcaacaaggcctacaagcgcgcgtcggccctgcagaagcaccagctggcccactgtgcggcggcagagaagcccctgcgctgcacgctttgcgaacgccgcttcttctcctcttccgagttcgtgcagcaccgctgcgatccggcccgcgagaagccactcaagtgcccagactgcgagaaacgcttcaagtacgcgtcagacctgcagcggcaccggcgggtacacacaggcgagaaaccctacaagtgccccaactgcgacaaggccttcaagcagcgggagcatctcaacaagcaccagggcgtgcacgcccgcgagcagcagttcaagtgtgtatggtgcggggagcgcttcctagacgtggccttgttgcaggagcacagcgcgcagcacagtgccgccgccgcggcagcggagggcgcctaccaggtagccgcctgcctgccctgactctgcggctgtggcccctgccagcctgacctgagtcggcgccgtgggcccagcaggcctcgcgcagcctagctcctcacagctgccttgcaccaagggccccacccagctcggtgttctgagacctcgggagtgaggacgcaggggtatgaggcagggagagggtgtgccgctcgtactcctggcaccagcgggcagtgcgggcggccagattgctgtggcccatccggattccacaaacctctttcccatgacaagattcactttcttgagagccatcagcaccccccttatttccggggcactggagccaggctggaagtcaagtggcttctccctgccctaaggagggtgtgatgccagcccagccttcccatatctttcaagctagcagccacataggttaggaaagcggaggctcatggtggggctggggccccagaggtgggctaggtgtaaggcatcagttgccgtgtgggggagaaggccagctttaagacgtaggcctggggactgggagggcagagggtgagtcacagccctctccgtctgctctagccaggggcgacgtgtccccaggtttctggcaggggagatgtgcagggtgggtcttggggctgggtctgcctggagaccagtgggcccagggggaagggggaagctgagaagttcgtgtgacaccctcagccaagggacagtgccatccttggggacaggaggaaaagcagcctgtctctgctaagggcaaatcctccggttttggaagcgcccctcccacctttgtagtgcagttcctaggtgtggtggggaatgtgccgtgctctcagcagacagaactgctggtgtgaaaggcagggattgtcagcccacctgaggctgggaggaagcaggaccaggcctaggatctccccagcagatgcaaacaagtgtcctcccctgaattgtgtgaaccaaagcgtcaggggcttggggcacagccccagtcagctcaacccagtcctgcttcagagccaagactaggccagggtggggacccccccagtaccctccctacatcaatgtggctgctggcctggaccccaggggtctggtacagccaagatgttctggacaacatccagctacttcaaaggccagagtgtcctttgggtcctcctagagtccccctaggtctctggctgcccatgaggctcatgaagcagagggtatcccagtcatagggagcagaaagagcaagtgggttaaggaagcctgtgggggacctggtggatggagttgaccaacatcgctgggtggctacggccctccttaggaagcccagaaggacctttattattaaaataatcattttgaaccctgctctatcccctgccctcttccagccccacccctccctggtcttgaaagaagactaatcagtgggcacaccaagggccctgaggggcagggagatgccaccatgcttctctgtcaccgtaagaaggctgaccagccacgcccacctcctctgtctgactgagttccttcctgtggccacagggaggggctggtccttccccttggtgctggctctctgtcacaatgcctcaaaagacatggaacccaggcctacaaccgtcccaactgctaattcttttcctttcattttgctttctgaaagcagtttgttatactattcataacattgtagagtttaatttcatgtcattttggatcttatataaaaatgtgaggatttggatttttaaaaagaatgactccattttaggtagccacttttgatgttaatatatagtgagtccaatgtatgctttagaagtaaagacattgaccgtcacagaccactgc

SEQ ID NO: 1330 - DNA, 1176 bp, Homo sapiens
gtccattccgccggcgccggcgctggcgctgctgcgggctcggcgccggcctttgtctgcgggcacgcgccgctgcggtgctcaggaacagcccatggaagaatcatatgaagaggtggtgactgaggtcgtaagcaggagtggacatgtttggatttccaacagctaccctgctggactgtcatggaagatatgcccagaatgtagcgttcttcaatgtgatgactgaagcccaccacaaatatgaccactctgaggctacaggatcctcaagctgggatatccaaaattctttcagaagagagaagctggaacaaaaatccccagattcgaagacactacaggaagattcacctggagtgagacaaagggtctatgagtgccaggagtgtggaaaatccttccggcaaaaaggtagtctaacgttacatgagagaatccacactggtcaaaagccttttgagtgcacccactgtggaaaaagcttcagggccaaaggcaatcttgttacacatcaacggatacacacgggagagaagccttatcagtgcaaggagtgtgggaaaagcttcagtcaacgaggtagtctcgctgtccacgagagactccacactggacagaaaccctacgagtgtgctatttgtcagagaagcttcaggaatcagagtaaccttgctgttcacaggagagttcacagtggtgagaagccctatagatgtgatcagtgtggaaaagccttcagtcagaaaggaagcttaattgttcacatcagagtccacacaggcctgaagccctatgcctgtacccagtgcaggaagagtttccacaccagggggaattgtattctgcatggcaaaatccacacaggagagacaccctatctgtgcggccagtgtggaaaaagcttcacccagagagggagtctggctgtgcaccagcgaagctgctcacagaggctcaccctttgaccactttcctgaagagaagttctctttatgaattaagagtacaaaatcctctgagatgaagcaacctatccagttctatggaatgaatggagaatctttcagaaagaccatcattgggtagggcaaactgatttttttcctttcccccaaaagagtatgaaaaataaatgtcttgtttattatcattatcaaaaaaaaaaaaaaaaaa

SEQ ID NO: 1331 - DNA, 4800 bp, Homo sapiens
ggcctcttcccagccagcttgaaagggtttgcgtagccggccttgtgggcccttgaagcgctctgttaaagcgctctgtgggcggcctggccccaactcctctagtctaggcgcacgaagggagttgctcctaggtcttgtccgtgccgggttcgcttttctttccttcccgaagcctggcccttagatctactatcgcagagtctgcggccgccaggaagcccagattcgagtgtccggagagtaaccggaagtgctgtccccaggcctaggggcggcgccggcggctgccagggagaggcaagaattgagtgttgtgaatagttctgaactagagaccttttgaaaccaaaaggaagatggtcttgagtctttcttgttacgaatgctatcttctttgagaagtcaaattgtcaggatcaggaatgtatgttttcttccatctggattctagggttggaaataccaagtaaggaattaacatatatgatgctggaaacttgtagaggctcatgattgaaaggcctgaaacagatgtatcttccaagttcttatcaagaaaatgactgtgagggcaacgatgggtcaagaagaccagcggaaaactccctaggagagagccatagaaaatgtacacttcagaagagaaatgtaatcagagaactcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaatgtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaattcacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaaatttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcgttggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggtgggtcagagtagacctgatgggtaactcaggtaaagatgcttttcttttatctgaactacttaatgattgctttacttttactttttaaaaaattcagaaatccaataaaggaaaggacggtaaccttatgatagaaggtgtggcatgtgttactgttgggggaaaggagtatattgactttgccttggttgatatttttatgcttgtctaggatgggactagagtgttgatagtaacatggcagccttttgctggcagtgaaatgaacttaagaagctagggagtagctatcctagatcaaaactctcctaatagtttttcctttgcaggaccaatcttataaagaaacagcatactcagctttttacttagtgtcagttgaggcatactctcaaaagttttttcccctaaaatatctttcaagttattactggtatttgaaatttcaagtttagaaattcatttctttttaactcaaagtgcaaatttcatataatgattatgatggttttagtgtccatatttttgtggcttcacttatcatctctttcagcagtagctacccacagtcagctcctagtaaaatggctacaggaaaactgaaagaaaagtttaagcctgagtaggcatagagtaaaaaatgcataatgatgcattattaatataagagtaaggctttttttattttgagtatcctaactccaaacctagtgttcttttcactccattatcctgctgtttatagcaaatcaagacccataatgatacgtctttcatttatttcagttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgacatgtttttgtaatatttagaaatagctcttgtatcataaaaagttgcccagtataagacacacaagatgtattttttttctctggtgaaaatcatgcctatcactagtatatgtttgacatttgtagtatacttaaaatagtattgggtgtgaggcatggtggtgatgaaaagtagtccttacggctacttgttagtcattagagagaacatggagaaggggtcaaagttggtatcattaacagggcaatgacttgacccttctttcaactgatcttactggtagttgtctctagtttttaagtaaattaatgatggaccatcccccaaacagagaactatgggggtatgaaacaaggctgaaggcttttaaccatgggagaaaaaggtgttggtattattcatatagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctgaaaaactcca

SEQ ID NO: 1332 - DNA, 3039 bp, Homo sapiens
gttttgggtctcgatgaccatctaactcctaaatgctgggggccgctccccatagaaatgcctcgccggatttctccgcctcgcacccagtgggactgggatttttggccccggggtttgcaataagggagtcaccaagcagcagccacctctggaattcctagaaaggaaagagttgcctggcttcagccagtgggctcagaacggctgacgcatttccggcctttgcggttgatcggtcattggggtgctgcagccccgccacctgttccgtagcttgccggtgccccgaaggtgtcttctcctaaggaagattaaatcagaaaattttaaatcacagttatccctttacttaaagccagagtaagccttccaaattaaccccaggaatggcttcaacagaggaacagtacgatcttaagattgtgaaagtggaggaagaccctatctgggaccaagaaacccaccttcgagggaacaacttttctggccaagaagcctcccgacaactttttaggcagttttgttaccaagagactcctggtccccgagaagctctgagccggctccgagaactctgtcatcagtggctaaggccagaaatccacaccaaagagcaaatcttggagctgctggtgctggagcaattcctgactatcctgcctgaggagctccaggcctgggtgcgggagcaccatccggagagtggggaggaggctgtggctgtagttgaagatctggaacaagagcttagtgagccagggaaccaggctccagaccatgaacatggacattctgaagtgctcttggaggatgtggaacatctgaaggtcaagcaggaaccaacagacatacagcttcagcctatggtgacacagctcagatatgaatctttttgcctccaccaatttcaagaacaagatggtgaaagtatacctgagaaccaggagttggcatcaaagcaagaaatcttaaaagaaatggaacatttgggggatagcaaactccaaagagatgtatctttggattctaagtacagagaaacttgtaaacgagacagcaaggcagaaaagcagcaggcacattccactggagagagacgccacaggtgcaatgaatgtgggaaaagcttcactaagagttcagtactcattgagcaccagagaatccacactggggagaagccatatgaatgtgaagaatgtgggaaggccttcagccggaggtcaagcctgaatgaacatcggcggagccacactggagagaaaccctatcaatgtaaggagtgtgggaaagccttcagtgccagcaatggcctcactcgacacagaagaatccacacaggggaaaaaccatatgaatgcaaagtgtgtgggaaggctttcctcctcagctcatgccttgttcagcatcagaggatacacactggagagaagcgctatcagtgtcgtgagtgtggcaaagccttcattcagaatgcagggcttttccagcatctccgagtccacactggtgagaaaccctatcagtgcagtcagtgcagtaaactctttagtaagcggacacttcttaagaaacatcagaaaatccacactggagagagaccataagggtgatgagtttgggaaagccttcagtcatcattgcaaccttattaggcattttagaatccatactgttccagcagaactggactaattctgtggaccctcagacccctaaatggggccgtcttggaaagtaagattttcaagtggcttattctgttcttataaaatttattttgtattgcattgaaccacttgtctacaaaccaggtgttggtgtctcctgtgtggatgactgtgattgtagggggttgctgggtggccttcttattccctagcctttggtccatttcttatgatttcctttaaaggcaccaaatcttatctggaaataaattgttatggaggggctgtttttgagcaatactgcatattgaacaattctaaaagaccagtatctatgtatacttttaaaaaaaagatttgctaagatcaaaggatattcagaggtgcatctttttctgtaagagtgacattttaaacaaatgtaaggttttggggaataagaatcgtccacattcccacaggaaatcattgctatggtctcccctaggaatgtgatagatagcttctataattatgcagcattatccatagtatgaaacctgtagttttaatggtttagaaatctatgtctcatttcatatctaactcatgtttttgatacgaatcaatatatatgttgatatcatgagttaatatgagtttgacatgaatcatcaacatagtatatacatatcaacataactatgttgatgattcatatcaaattctcaatgcaggtcattactgtaagttttccatttttgttacaaataataagtaagatgatactttaaaatctctgttcttcacaaggtacctctttaattcatagccttttatgtcagcattattcttcttttgggggttggtcagcaactttgagtgccattgcaagcagcatcatttaagtagttttataaagaaaagaagtctgatatcttgggcagcttgctgcttactggggagaccagcatgcttagacacttattgccagggttaaacatatgctctggcaccaagttcaaatctttcctccccatttgtgagctgtgggactttaggcaagttatctaaatgctgctatgctatagtctccccacctgtaaaacagaggatgataccaataccttcctcatagggtacataagattaaataaatacaaacttgtacttaaaatgtagctctcaataaatatgcattatgatttacatacgaaataatagcatttaacaaatgtaggtagaattttaagtatcatgttaaaattaggatacgaaatgcctctgctgacattcttgttactcttttctccacagtcaaaacctgaatcagaatatttcaaaagagaggaaataaaagttcagcttaaaactgttctgccctaaa

SEQ ID NO: 1333 - DNA, 5074 bp, Homo sapiens
tcctgtgcgtccccaggtcaccgctcgccctagttcccaggctttggcctccggtgggcgagaatcgcggagcctgcggggctgggcgccgaagagccgggccggcacccaagcgggcgcggggctgtgcgggccaggcggaggctcaagcggggatccccgagcacgacccccggagccgacggcgctggggcccaaggggccggccgggcggtgacgacggcggaggcgaaggggcggcgggacccgggcccggcccgtgtgcgtcctcgacggcccggccccggctccgcaggacggtgagccccagggagacggatctgggctccgggagggacgccccgcctggatttgtcccgtaggcccggcccgggcccctctggagcagaacggccttggtgaggtggacaggaagggacctcgcgagcagacgcgcgcccgcgacagcaatcccgccccggcctgtcgggagcggtggggcagaggctgcggagccccaggaggatctgcctccgctttcacagtcctccagatttttccaagagcagcagaaaatgaataaatccctggggccagtgtcattcaaggacgtggctgtggacttcacccaggaggaatggcagcagctggatcctgagcagaagataacttacagggatgtgatgctggagaactacagcaatctagtttctgtggggtatcacattatcaaaccggatgttatcagcaagttggagcaaggagaagagccatggatagtagaaggagaattcctacttcagagctatccagatgaagtctggcaaactgatgacctaatagagagaatccaggaagaggaaaataaaccttcaaggcaaactgtgttcattgagaccctgattgaagagagaggtaatgttcctggtaaaacttttgatgtagaaacgaaccctgttccttcaagaaaaatagcctataaaaatagcctctgtgactcatgtgaaaagtgtttaacgtctgtttcagaatatattagtagtgatggaagctatgcaagaatgaaagctgatgaatgtagtggatgtgggaaatcactcctccatattaagcttgagaaaactcatccaggagatcaagcttatgaatttaatcaaaatggggaaccttatactctaaatgaagaaagtctttatcagaaaattcgtattttggagaaaccttttgaatatattgaatgccagaaagccttccaaaaggacactgtttttgttaatcacatggaagaaaagccctataagtggaatggatctgaaatagcctttctccagatgtcggacctcactgtacatcagacatctcatatggaaatgaagccctatgaatgcagtgaatgtgggaaatccttctgtaaaaagtcaaaatttattatacatcagaggactcacacaggagagaaaccttacgaatgtaatcagtgtgggaaatccttctgccagaagggaacccttactgtgcatcagagaacacacacaggggagaagccctatgaatgtaatgaatgtgggaagaacttttaccagaagttacacctcattcagcatcagagaactcactcaggagagaagccctatgaatgtagttattgtggaaaatccttttgccagaagacacacctcacacaacatcagagaacacattcaggagagagaccttatgtttgtcatgactgtgggaaaaccttctcgcagaagtcagcacttaatgaccatcagaaaattcacacaggtgtgaaactctacaagtgtagtgaatgtgggaaatgcttctgccgcaagtctactctcacgacccacctgaggacccacacaggagagaaaccgtatgaatgtaatgagtgtggaaaattcttctctcggttgtcatatctcactgtacattatagaactcattcaggagagaaaccctatgaatgtaatgaatgtggaaaaaccttctacctgaattcagccctcatgagacatcagagagtgcacacaggagagaaaccttacgaatgtaatgaatgtggaaagttattctcccagttgtcatacctcactatccatcatagaactcattcaggagtaaaaccctatgaatgtagtgaatgtgggaaaaccttctaccagaactcagccctttgtagacatcggagaatacacaaaggagagaagccctatgaatgctatatatgtggaaaattcttctctcagatgtcatacctcactatacatcatagaattcattcaggagagaagccctatgaatgtagtgaatgtgggaaaaccttctgccagaattcagcccttaatcgacatcagagaacacacacaggagagaaagcctacgaatgttatgaatgtgggaagtgcttctctcagatgtcctatctcactatacatcatcgaattcattcaggagagaaaccctttgaatgtaatgagtgtggaaaagccttctctcggatgtcatacctcactgtacattatagaactcattcaggagagaaaccctatgagtgtactgaatgtggaaaaaaattctaccacaaatcagcattcaacagccatcagagaattcataggagaggcaatatgaatgtaatagatgtgggaaggcttctctgaagtcagacctcattttatatcagagaaccctttcagtatagtgaatcagaaactcctgcctgaagtcaaacaccttgtacatcagagagttcacacaggttagtgtggacatccccttgtgtgttggactcataatctgaagactcacagaatggaaaccatgattataacaagaccacatggtataacaatactagactatagacaagtaaaaatttataaatattaagaatgtatatacatgtcaccatggattggaactgttttgcatatcagggaaatcatagccaaggggaaatctatcagtataaggaatgtggaagacataatcctttggaaactgttaatactaaaagatatgtttctgatacaatagcaaacttgaaaaaaaaaaaagaaatagaagattcctgctgtgaataaacatacttcttgtgtaaatagaaactgtaaagtcatcaggatagctagttaagtcggtaaccttaaactcatgtaagcagttcccaaagaacataggacttatgtttggggagagggttgtttttattacagtacattacaggaattgtatgttcacttcgaatcatgtttgaaaaaacgttgtatccttattttgtaattcatatagtaagagtattctaaacagcactacattaatatcatttgataggtataaagtatactttttcttgcactcttctctaggatttaatgcattgatcattcttaatgaacaatatcagctctaaaggaccaatgcttttataatgttttcaactgtatctgagtcagccagagagataaatatccatgtataaaatagatagaaaactttgcttggtaatttaaaattaataatgccagttttccaagagtgagaaaatcattgcactctatacagttttaagatatacttaaaatattcccatttgtatctatttttttttctactgttttttatttggacacttacataacagtgcagagcacaatgctgtgtaacataggaattcactgtgttttcatttgatgtcgtactggttttaaaccttgtgctctactccttcctgttaatgaattaagaacacattctaacaagggtctgtggcagacattgccgagtgactttctaacataggaattcactgtgttttcatttgatgtcgtactggttttaaaccttgtgctctactccttcctgttaatgaattaagaacacattctaacaagggtctgtggcagacattgccgagtgactttcttagtcactcccttactctgctggcggagtttggttatccatttatcctcaaaaggaagtgagataaatcctgattagttttaaccagtgacactccccttctcgttgccagcagttgatttacagtggtcacagggcccaattctagacataaaacaaaggatatacctgacagactacttctggaaaaggttttctcaaaggcccaaggattcaagcaaagggaagtggaatcttgtggtgaacagtaccttgtctggatgtggtgcctggtaaccatctttcagcaatggattatagtttaatcatggcctgagcagaaatactgaaagaccctgagacctggatgatgtctttgagccaccaaaccaagcagccttgtagccactcctcctttggactgtttcttttgtgagagactaaacttatttttaagccagttgatttaggatgctctattactaataactgaagacattctaattggtacagactgaaacctttataggagttatgcagttcagaagtggactttaggtaagtcatttattttaagctgttgatatagagatttattttctgtaaattttgacgtaaatagtttgagcattagaaatcaacttgaaacaataaaatgtatgcttccttgaactgtcatatcgttgacctgcaaaattcacctttggaacgtgacacaatgttaggcatacctccttttttctaatacatggaatacattttgttggaggtaatttatgtgattcatataccactgctacagtgttagctgacaacatatagtatgaggtaaggatctaattctgtttcctctcacatgattacttgatagctaagcatctgattggtttactgctttaccactgagctgaaatgccgtgttttccatttattaaaatcacacatggctcctgtttttgtcactcagcactttttctccatattcttcaagacgattgtgagtatggtacgtaacaggaattacatctggtaagttgtatagttttgtgtaggaactctatattcatagcatatttgtggaaatgatacctatggaggtttctcacactggtgtgtcattatacattaattgtacaatatgcattttcagtaaaatatttgaaaactgtaaaaaaaaaaaaaa

SEQ ID NO: 1334 - DNA, 3767 bp, Homo sapiens
gcgcgcggcggcggccgacggcggctgagctgtgctgcgcggcgcggcgcggtgcggcacggcacggtgggagtgtctccggctggcttgcagggagaacaccgactgagacctcaaaccctggctccagtgtcatggaatccgtcacctttgaggatgtggccgtggagttcatccaggagtgggcattgctggacagcgcacggaggagcctgtgcaaatacaggatgcttgaccagtgcaggaccctggcctccaggggaactccaccatgcaaacccagttgtgtctcccagctggggcaaagagcagagccaaaggcaacagaacgagggattctccgtgccacaggtgttgcctgggaatctcaacttaaacccgaagagttgccttctatgcaggatcttttggaagaagcatcctccagggacatgcaaatggggccggggctgttcctgaggatgcagctggtgccctccatagaagagagggagacaccattgactcgagaggaccggccagctctccaggagccgccttggtctctgggatgcacgggactgaaggccgctatgcagattcagagggtggtgataccagtgcctactctgggccaccgcaacccatgggtggccagggattctgctgtgcctgcacgtgaccctgcctggcttcaggaggacaaagtggaggaagaagctatggctcctgggctgccaaccgcctgttcacaggaaccagtcacctttgcagatgtggctgtggtgttcaccccagaagaatgggtgtttctggactctactcagaggagcctgtatagagatgtgatgctggagaactacaggaacctggcctctgtggctgatcaactgtgcaaacccaatgcgttgtcttatttggaagaaagaggagagcagtggaccactgacaggggcgtcctctcagacacctgtgcagaacctcagtgtcaaccccaagaggcaattcctagccaagatacttttacagagatcctgtccattgatgtgaaaggggagcaacctcagcctggagaaaaactctataaatataatgaacttgagaaaccttttaacagcattgaaccacttttccagtaccagagaattcatgctggagaggcatcctgtgaatgtcaagagattagaaattccttcttccagagtgcccacctaattgtgcccgagaaaatccgtagtggggataaatcctatgcatgtaacaaatgtgaaaaatccttcagatacagctctgaccttatcaggcatgagaagactcatactgcagagaagtgctttgactgtcaagaatgtgggcaagccttcaaatattcctcgaatctccggcgacacatgagaacccataccggagagaagccatttgaatgtagtcagtgtgggaaaaccttcacgaggaactttaacctgattttgcaccagagaaaccacacaggagagaagccctacgagtgtaaagattgtgggaaagccttcaatcagccatcatccctcaggagccacgtgagaactcacactggagagaagccctttgaatgcagccagtgtgggaaagccttcagggaacactcttcactgaagacacatctgcgaacccataccagagagaaaccatatgaatgcaaccagtgtggcaagcccttccggacgagcactcatctgaacgtgcacaagaggatacacacaggggagaaactgtatgagtgcgcgacttgcggtcaggtcttgagtcgtctttcaaccctgaagagtcacatgcgaactcacactggagagaagccctatgtgtgccaggaatgtgggcgagccttcagtgagccctcatccctcaggaaacatgcaaggactcacagtggcaagaagccctatgcatgccaggaatgcgggcgagcctttggtcagtcttcacatcttattgtacatgtgagaacacacagtgccgggagaccctatcaatgtaatcagtgtgagaaagccttcaggcacagctcctcactcactgtacacaaaagaacccatgtgggaagagagaccattaggaatggcagcctgcctttatccatgtctcatccatactgtgggccccttgctaattaacttccattttgtaaaaatataaacacatggggctatgactttccctcgtaatactcctttagctgcatcctgtgtttcaatgtataatattttcattttggtttaattgtaagtattgtcttaacctccattatcgtttattctttgacccatctattatttggaattagatttttcaaaactaatatgtggatatattttcatagaggtataatgacttatagtgaaatgcatacatctgaagtgtacagttggatgagtttgacagatgcatacatgcatgtaaccaccaccccattccagatatagaatgtttctatctctctggaaggttcctgcatgttatatggctatttcttagttgcctttttgttgttggtttctaatttaattacatggtgagaagagtatgtggcctctttgttactgagtcataggtatttgctgagatttgctattaggtctggtgtggcttattcttctagctgccaacccaaattaccccttcctccttagaaaagaacctgggttttctgttcagattggcagtgtgcactattaaaaagcttccatctcccggctgggcacggtggctcatgcctctaatcccagcactttgggaggctgaggctgggggatcacctgaggtcaggagttcgagatcagcctggccaacatggtgaaatcccctctctactaaaaatataaaaattagccaagtttggtggcatgcacctgtaatcccagctacttgggaggctgaggcaggagaattctttgaacccaggaggcagaggttgcagtgagccgagattgcgccactgcactccagcctgggcaacagagtgaaactctgtctcaaaaataataataataaaaaaaagcttccatctcccagcccttcttgcaagcaagggcaggccatttcctccggtcctggctagtatgaatatgagaagtcactggatgtgactctggggaagatattgtgttcagggatggtttcatgtagccacatctctccacttcttgccttttggacaagtagacatgatttctagacctagaggagccctcctgtgaccataagggtaaaagccgcaagctaagaagagggtggccggaagtcataaccatcttgcttctgtaatctaaaaaatatttaggatagatttaatagaattggcatatttatgtgattgcagcagccctggactatttatttctggatgtcccatacatgaaaaatatgcacttcttactggtacagttttcttttgtttgtttttgtttttggtgggaggtttatttcacctgaatataattcctaactgatgcacttagtatatgtcagtttttataaatgcttcatggatggttgaaatcaatgtattgtattctacaaatgtctgctagatcaagcaaatgtgtttaaaaaccatctacacatttataaatgttgatctgtgatctagcatttattgagagaggtatgttaaactctcccaccatgattatgtattgctgaaaaatctttgtcattctgtcagtttttaaatttatgtatatacatacatatatatgttttgaagcaatgaaattaaatatagatactgacattttttacatttccaa

SEQ ID NO: 1335 - DNA, 2467 bp, Homo sapiens
tcttccgggtgagggtcctgcagcccgtgaatccctggtcccgccgagacttggacctggtgcgaactggaggcgaagcgggtgcacccacaacctataggaagggctggcggcgagctctgagcactcgggcgtcggagggaacgctctgctttcaacactcttggccctttctcaagagaacatgaaaatgaaaaaatttcagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaaaaaaaaaaaaaa

SEQ ID NO: 1336 - DNA, 4462 bp, Homo sapiens
cgcagcggaggaaagaggatggcgacctcgtcgatgccggagtcagagaggaacgtggctacgaaagcctcggagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggccgccccggggcaggcagaggccgatgactctggcgtggggcaaagctcggaccgcggcagccgttctcaggaggaggtatctgagagcagctcgagcgcagaccccctgcctaatagctacctccctgattcatcgtctgtgtctcatgggccagtggcaggggtgacaggcggtcccccagcacttgtgcactctagtgcactcccagaccccaacatgctggtgtccgactgcacagcttcctcctcggacctgggctcggccatcgacaagatcatcgagtccaccatcgggcccgacctcatccagaactgcatcactgtgaccagtgctgaggatggcggggccgagaccacacggtacctgatcctacagggcccagatgatggagcccccatgacatcaccaatgtccagttccaccttggcccacagcctagcagccattgaggccctggcagatggccccacatccacatccacatgcctggaggcacagggtgggcccagctccccggtgcagctgcccccagcctccggtgccgaagagccggacctgcagagcctggaggccatgatggaggtggtggtggtgcagcagttcaaatgcaagatgtgccagtaccggagcagcaccaaggccacactgctgcgccacatgcgggaacgccacttccgtccagtagcagcagccgcagcagcagctggtaaaaaaggacgtctacggaagtggagcacctccaccaagagccaagaggaagagggaccagaggaggaggacgatgatgacattgtagacgctggagccattgatgacctggaggaggatagcgactataatccagctgaggatgagccccgaggccggcagcttcggctccagcgccccacccccagtaccccaaggccccgaaggagacctggccggccccggaagctgccccgcctggagatctcagacctcccagatggtgtggaaggagagcctctagtgagttcccagagtggacagagccctccagagccacaggatcccgaggctcccagctcctcaggcccaggacacctggtggccatgggcaaggtgagcaggacccctgtggaagctggtgtgagccagtcagatgcagagaacgcagccccctcctgcccggatgagcatgacactctgccccggcgccgaggtcgaccttccaggcgcttcctaggcaagaaataccgcaagtactattacaagtcgcccaaaccacttttgaggcccttcctgtgccgcatctgtggttctcgctttctgtcccacgaggacctgcgcttccacgtcaactcccatgaggctggcgatccccagctcttcaagtgcctgcagtgcagctatcgttcccgccgctggtcctcgctcaaggagcacatgttcaaccacgtgggcagcaagccctacaagtgtgacgagtgcagctacaccagtgtctaccggaaggacgtcattcggcacgccgctgtgcacagccgggaccggaagaagaggccagatccgactccaaagctgagctctttcccctgccctgtgtgtggccgtgtgtaccccatgcagaaaagactcacgcagcacatgaagacgcacagcactgagaagccccacatgtgtgacaagtgtggaaagtcctttaagaagcgctacaccttcaaaatgcacctgctcacgcacatccaggctgttgccaaccgcaggttcaagtgtgagttctgtgagtttgtttgtgaagacaagaaggcactgctgaaccaccagttgtcccacgtcagtgacaagcccttcaaatgcagcttttgtccctaccgcaccttccgagaggacttcttgctgtcccatgtggctgtcaagcacacaggggccaagcccttcgcctgtgagtactgccacttcagcacacggcacaagaagaacctgcgcctgcacgtacggtgccgacacgcaagcagcttcgaggaatgggggaggcgccaccctgaggagcccccctcccgccgtcgccccttcttctctctgcagcagattgaggagctgaagcagcagcacagtgcggcccctggaccacctcccagttccccaggacctcctgagatacccccagaggcgacaactttccagtcatctgaggctccctcattgctctgttctgacaccctgggcggcgccaccatcatctaccagcaaggagctgaggagtcgacagcgatggccacgcagacagccttggatcttctgctgaacatgagtgctcagcgggaactggggggcacagccctgcaggtggctgtggtgaagtcggaagatgtggaagcagggttagcatcccctggtgggcagccctcccctgaaggtgccactccacaggtggtcaccctccacgtggcagagccagggggcggtgcagcagccgagagccagctaggccctcctgacctaccgcagatcaccctggcacctggtccatttggtgggactggctacagtgtcatcacagcaccccctatggaggagggaacatcagctcctggcacaccttacagcgaggagcccgcaggagaggcagcccaggctgtggttgtgagtgacaccctaaaagaagctggcacccactacatcatggctactgatggtacccagttgcaccacattgagctcaccgcagatggctccatctccttcccaagtccagatgctctggcctctggtgccaaatggcccctgctgcagtgtgggggactgcccagagacggccctgagcccccatctccagccaagacccactgcgtaggggactcccagagctctgcctcctcacctcctgcaaccagcaaagccctgggcctggcagtgcccccgtcaccgccatctgcagccactgctgcatcaaagaagttttcctgcaagatctgtgccgaggccttccctggccgagctgagatggagagtcacaagcgggcccacgctgggcctggtgccttcaagtgccccgactgccccttcagtgcccgccagtggcccgaggtccgggcgcacatggcacagcactcaagcctacggccccaccagtgtagccagtgcagctttgcctccaagaacaagaaggacctgcgtcggcacatgctgactcacacaaaggagaagccttttgcatgccacctctgcgggcagcgtttcaaccgtaacgggcacctcaagttccacatccagcggctgcacagtcctgatgggaggaagtcaggaacccctacagcccgggcccctacccagaccccaacccagaccatcatcctgaacagtgatgacgaaacactggccaccctgcacactgcactccagtccagtcacggggtcctgggcccagagcggctacagcaggcactgagccaggaacacatcatcgttgcccaggaacagacagtgaccaatcaggaggaagccgcctacatccaagagatcaccacggcagatggccagaccgtacagcacctggtgacctccgacaaccaggtgcagtatatcatctcccaggatggtgtccagcacctgctcccccaggaatatgttgtggtccctgaaggccatcacatccaggtacaggagggccagatcacacacatccagtatgaacaaggagccccgttccttcaggagtcccagatccagtatgtgcctgtgtccccaggccagcagcttgtcacacaggctcaacttgaggctgcagcacactcagctgtcacagcagtggctgatgctgccatggcccaagcccagggcctgtttggtacagacgagacagtgcccgaacacattcaacagctgcagcaccagggcatcgagtacgacgtcatcaccctggccgatgactgagccccgagggcccaacacagatcatggatttgcggccagctctcctgggggtagggggccaccaggactcacctccctcttcatttaggatctccagatactggatagccagcatcctctcattcccagggagccagacctgtgctgttggggttaggggcagccatgggccccagccaggacatgctgggtgccccagcctgcaggcaggctttgggagagaaatttatttttgtttgggtggacccactggcctgtcagtctcaataaagggaccggagtccagtcctgaacagcttaaaaaaaaaaa

SEQ ID NO: 1337 - DNA, 4752 bp, Homo sapiens
atggaaagcggtgcagttctgctggaatccaaatcctccccatttaacctactgcatgagatgcatgagcttcgcctcctgggtcacctgtgtgacgtgacagtcagcgtggagtatcagggtgtccgcaaagacttcatggcccacaaggcagtgctggctgccaccagcaagttttttaaggaagtgttccttaatgagaagagtgtggatggtactaggactaatgtctacttaaatgaagtgcaggttgctgactttgcttcatttcttgagtttgtctacactgcaaaggtacaggtggaagaagatcgggtgcagcgaatgctggaagtggctgaaaagctgaaatgtttggatttatcagaaacttgttttcaattaaagaaacagatgttagagtcagtacttttggagttgcaaaatttctcagagtctcaggaggtggaggtgagcagtggctcccaagttagtgctgctcctgcccccagggcaagtgtggccaccgatggccctcaccccagtggtctcacggattccttggactacccaggagagagagccagcaatggcatgtcttcagatttgccaccgaagaagtccaaggacaaactagacaagaagaaagaggtagttaaacctccctaccctaaaatcaggagagctagtggaaggctggctgggaggaaggtctttgtggagatccctaaaaagaaatatacgagaagactccgagagcagcagaaaactgctgagggtgatgtgggggactacaggtgtccccaggaccaaagcccggacagggtgggcacggagatggagcaggtttccaaaaatgagggttgccaggcaggtgctgagttggaggaattgtcaaagaaagcagggccggaggaggaagaggaggaggaggaggaggacgaagaaggggagaagaagaagagcaactttaagtgcagcatttgcgagaaggcgtttctgtatgagaagagcttcctgaagcacagcaagcaccgccacggcgtggccaccgaggtggtgtaccgctgcgacacctgcggccagaccttcgccaaccgctgcaacctgaagagccaccagcgccacgtgcacagcagcgagcgccatttcccatgcgagctgtgcgggaagaagttcaagcgcaagaaggacgtgaagcggcacgtgctgcaggtgcatgagggcggcggcgagcggcaccgctgcggccagtgcggcaagggcctgagttccaagacagcgctgcggctgcacgagcgcacacacacgggagaccggccctacggctgcaccgagtgcggcgccaggttctcgcagccgtccgcgctcaagacgcacatgagaattcatacaggggaaaaaccttttgtctgtgatgaatgtggtgcaagattcactcagaaccacatgctgatttatcataaaaggtgtcacacaggtgaaagaccttttatgtgtgaaacatgtggcaagagttttgcttctaaggagtacttaaaacaccacaatagaatccatactggatccaaaccctttaaatgtgaagtatgtttcaggacttttgcccagcggaattcactgtaccagcatattaaagtccacacaggggagcgtccctactgctgtgaccagtgcggcaagcagttcacccagctcaacgccctccagcgccaccgccgcatccacacaggggagaggccattcatgtgcaatgcgtgcggacggacattcaccgacaagtccactcttcggcggcacacctcaatacacgataagaatactccatggaagtctttccttgtcattgtagatggctcgcccaagaacgatgacggacacaagactgaacagcctgacgaagagtatgtgtcatccaagctttcggataaattgctgtcttttgcagaaaatggccatttccacaacctggctgcagtccaagacactgtacctaccatgcaggagaacagttctgctgacacagcctgcaaggcagatgactccgtggtgtcccaggacaccctcctggccaccaccatcagtgagcttagcgagctgaccccacagacagactcgatgcccacacagcttcactctttgagcaacatggaataagagcttcaagcagttcccatcctgttagtctgcgtgtgtggtagctgaactcaagatgatgtggggctaagaaaaataattgtccatgtgcaaagatgtgggcaagaatggcctctgcagattttcctgaacttctgctaacttgcacggctttatcacagcatttttaaagctttccctcaaaaatcctgatctgcatgatctcagctactttattgacaaaaaggcagtgaacataacctcacttaattctggtgtagggtgtatgtgctaatcgttctaattcttgattacctagtttatagataactgctggtcttaattgcagagtacagagaactgaaccagctcctgatattgtagttagcagtcttcctggcttctcactctgccttatatttccatgtgggtttacttctctcataactactttcaaggtatttttcttccaagctgaaataaaactggggccacatattttcagtcatttcttccctgttgaattgaagcaaatcagattttctgtggggaccctcaaatgcaactgaagaaatagattgttgcattcattcctccccaccccccatttgtaggcagtaaacaaagtatgactgacagattgaacacctgcaaaactgctagcgtaatctcagcacatacgcagctaggaagtttgtcataaaatcaacttagaaatgagatgaggctgttcagtttgtcttaaaaaaatcagattaggtaaaagctgtcctaccaaagagtctagcaaaacaatatagtatttttttgcagaggcatgaaaaattaagacgctttagagtacttgaaagttgtgtagtcattttatttgcaaaatgaggtgactgtggcaaattatagaacacagagtattattacttttgccaggtttttctgacttgatttctgtaatttccagaaacccagacttctcatttccacacctagagatggaaacaggcaagtaactgacatgtctatttccttgggagcatgtgagaacatagcagtagggaccaaaagtctcagcacacttacctccgattatgccttaaagagttgattgtgaagaaccagtaactttgtcccaaatgcttctttggctgtttcatgcaggacttaattattgcttttaaaaattcacaatgaaaagacgattctgctgtatttgttaaacgttgacatttggttctagggccttgagtatgtgccacgtgcttgtgaaatgctatgattcacatgtaacatttaaacattaatttaaaaagggaaccttggagaattcttttgttcactagttccttttttctctacatttttaatttattaaacttgctgtgaaaacactttgattttctaagaggaaggtactttaagttccagaatgaacatgtagctgcactatgccagaaattaatgagggaagactttcttcctaagtgcttatgttttaacttatgttagtgaaaccactacaaggtgtttcaggcgctgataacatgcttcacacctgcccttggaggtcacagtactaatttacttcaaatttagttatgacagtgtcactgtatcctagttatgtttacagcacaaataaataatgactgtcatacatccagaggagaccgaacctgcccagctgatgtactgttttatggaataaagtcacttgatcagaaggaattgaaacaatagatcattttgttacctactggagggatttttgtcttgaatttgtttccttagaaattctacaaaaaaatgttgttaataaatgtctgctttgtaaaagcagttttgcaattttttaaagatctatttctgttataatttaggttctgcagaaatatgattcttaattgaaacatataatttgcttaattacgtgaataatgaaatgtaaaatccgggtccataagcctttatttcatacagtcctaggattaagctgtttaactgcttggatcccagttggtctctggcagtgggatcctggagaggagaaatcctggcctctgctcatgcgcaggccacaaccgggctggaagtgcggttgagctctctgccactttcttcaatgtaaaaagtaggcatcaaagatacgacttctactatatacatttctctgtccctgagaacagagaaacgtaaccctgtaggggactggttacagaggacctcctggagcatctgccccattcctccaagtccaagcacagccatgctgagtggaagcgaggccaccatctgagtggattggtcccaagtgtgtaatgaggaaagtggccaggtgccggcacagtgcctctcccagagcctcaagaagggccatttaggagcttgcttcaaccattttccaaccattttctgtgaaatgctgtcagcccaaactccaaagggatgtgcagcctttcgttttaccaaattctttgctgtcgtttggaaaaaatgggccatgtggtggagacctttatttaaggtgatttttacagaaatgtgattttgctgtaggtgattatccaaacaagtaaatttgagtgtataatttaatttttaacctgttaaataaaccttgtccctccaaggaaaaaaaaaaaa

SEQ ID NO: 1338 - DNA, 2328 bp, Homo sapiens
gaggacacactcaggagagaagccttttctgtgcaaggtgtgtggacgaggctataccagtaagtcatacctcactgtgcatgagagaacacacacaggagagaagccttatgaatgccaggagtgtgggcgaaggtttaacgataagtcctcatacaacaagcacttgaaggcgcattcaggggagaagccttttgtgtgcaaggagtgtgggcgaggctatactaataagtcatacttcgttgtgcacaagagaatacactcaggagagaagccttacagatgccaggagtgtggccgaggctttagcaataagtcacaccttatcacacaccagaggacacactcaggggagaagccctttgcgtgcaggcagtgtaagcaaagttttagcgtgaaaggaagtctcctcagacaccagagaacacactcaggggagaagccttttgtgtgcaaggattgtgagcgaagctttagccaaaagtcaactcttgtctaccaccagagaacacactcaggggagaaaccttttgtttgtagagaatgtgggcaaggatttattcagaagtcaacccttgtgaaacatcagatcacacactcagaggagaagccttttgtgtgcaaggactgtggacgaggctttatccaaaagtcaaccttcgctttacaccagaggacacactcagaggagaagccttatggatgtcgggagtgtgggcgtaggtttcgggataagtcctcctataacaagcacctgagggcacacttgggtgagaaacgttttttctgcagggattgtgggcgaggctttaccttgaagccaaatctcaccatacatcagaggacacactcaggagagaagcccttcatgtgcaagcagtgtgagaaaagttttagtttgaaggcaaatcttcttagacatcagtggacacactcgggggaaaggccatttaattgcaaggattgcgggcgaggcttcatcctaaaatcaactctcctcttccaccagaagacacactcaggggagaagcctttcatctgtagtgaatgtgggcaaggatttatctggaagtcaaatcttgtgaaacaccagcttgcacattctggcaagcagccttttgtatgcaaggagtgtgggcgaggcttcaactggaagggaaatctcctcacacaccagaggacacactcaggggtgaagcccttcgtgtgtaatgtgtgtgggcaaggcttcagctggaagagaagtctcaccagacaccactggcggatacactcaaaggagaagccttttgtttgccaggagtgtaagcgaggctataccagtaagtcagacctcactgtgcatgaaagaatacacacaggagagaggccttatgaatgccaagagtgtggacgaaagtttagcaataagtcatactacagtaagcacttaaagagacacttacgtgagaagcgtttttgtacagggagtgtgggtgaggcttcatcttgaagttatatctcaccatccatcagaggacacactcaggagagtaactttgctttgttacaagctttagttgaggctgcataacttgttcgtgaagatataacagaggcagacagaatccagagggctacagagaacctgaattcaacccatgtgtccccaagagattcagagaaaagaggtcaatgtttagggaacagagatgccagttgaggggagggcattacctgggctattggggaaatgtggtctctttcctactgagcacatattcttgttgtatttgtgccaggctgtgctttctaaggactgctcttagccagtgactgcagagcagggataccagggcaggcctgttacactctccccaacctccttggactgcaaacaatctaggacacctccatcaaacctcctcttgcactttccctctggcttccctcccagccttccttggtttggatgttttgtcccctccttaatttatgttgaaactctacataaactgtttactgttgaaacagtgtaagtattaggaggtgggacctttgggaagtggttaagtcaagtcacgaagatagagctttgcgaatgggatcaggtgcccttatgaaaaggcttgatagagggagtttgtcctgtggcccttctattttctgctctgtgaggacacaatgctcctcccttccaaaagatgcagcatgaaggcatcatcttggaaacagacatgagccctcaacagacaactgcacctactgatgttttgatgttgaacttcccagcctccagaactctgggaaaataaagtcctctttatacaaaaaaaaaaaaaaaaaaaa

SEQ ID NO: 1339 - DNA, 1555 bp, Homo sapiens
ttttccccggcgtggtctcactcgcgatttaaggcataggtgtcgccgagccgggaggctgggagtcgccaggcgtgcgggggagaggcctgggccgcgccgcggcggggggtggaggaagagggcaggcgaggcgggaaggtgggctctggccgccgggagccggggacggagccgccgccgttgcccctagcggggagcagccgggaggagggggccgcagtcgggagaggggaccccaccatgcccaaagtcttcctggtgaagaggaggagcctgggggtctcggtccgcagctgggatgagctcccggatgagaaaagggcagacacctacatcccagtgggcctaggccgcctgctccacgacccccccgaggactgccgcagcgacggcggcagcagcagcggcagcggcagcagcagcgcgggggagcctggaggagcagagagcagctcgtccccgcacgcccccgagagcgaaacccccgagcccggcgacgccgagggccccgatggacacctggcgaccaagcagcgcccggtcgccagatcgaaaatcaagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttaccgttagtgacgtcaggccctgtaacctgtgtcctgtctggcgcagttgctcacattcaccaaagtttgttttcatgatcctgatggccaagaacaccgtgtgggatttttttttcccccaaggattttcacacacggaaggagaggtatttcttagagagatcatcattttatggtgccttgaaataaaaatacttctacttgaaatgctgtttaagcaaggcaagtgaattttgttattctgaaagagtttacagaaactattttaataaatgaaatgttcttgtgaagcttttaaaagcaaaatggaacattga

SEQ ID NO: 1340 - DNA, 972 bp, Homo sapiens
gaattcacataggggagaaaccctataaatgtaatgagtgtggaaaagctttctgccataagtcagctctaattgtacatcagagaacccatacacaagaaaagccctataaatgtaatgaatgtggaaaatctttctgtgtaaaatcaggacttattttccatgagagaaagcacacgggggagaaaccctatgaatgcaatgaatgtgggaaattcttcaggcacaaatcatcactcacagtacatcacagggctcacacaggagagaaatcttgtcaatgtaatgaatgtggaaaaatcttttaccgtaaatcggaacttgctcaacatcagagatcacatacaggggaaaagccctatgaatgtaacacatgcaggaaaactttctctcaaaagtcaaatctcattgtacatcagagaagacatataggagaaaaccttatgaatgaaatggatattagaaatttccagccacaagtcagcctccataatgcctcagagtattcacactgtggagaaagccctgatgacatcctgaatgttcagtaactatccacaaactcaccttatgttactccaaagtaatagtaggggataaacccatagactacaacaattataggacagcttttgttaggaagtgatattctatgtaatatcagatggttaatacgggcataacaccttacagattttttttgaatttgtgaaagtttttggcaaaaatgcaaataaggttatgttagaatttacactgaggagaaaattgtcaatttaagaaatctaaagtgaaaattttgcttagaaataaaatacgacaagttatgttttgagtttgatgccataatagtttttagggcacctaacaataatttatagatgtatattgtggaatgtaaagctttaagaacttaaacaaaggtaataattaaaataacctcacaagaagtttaatgagtagagagaattc

SEQ ID NO: 1341 - DNA, 3330 bp, Homo sapiens
gcgacggcggcggctccaagatggcgcaggcgatctttgaggccctggagggaatggacaatcagaccgttctggctgtccagtcattattggatggccaaggagcagtccctgatccgacaggccagagtgtcaatgcgccccctgctatccagccattggatgacgaggatgtatttctctgcgggaagtgtaagaagcaattcaactcgctgccagcgtttatgacccacaagcgggaacagtgccaggggaatgcccccgccctggccacagtctcactggccaccaacagcatctacccaccttcggcagcacccacagcggtccagcaggccccaactcctgccaatcgccagatctccacatacatcacagtgcccccgtccccactgatccagaccctggtgcaggggaacatcttggtgagcgatgatgtgctcatgtctgccatgtcagccttcacatccctggaccagcccatgccccagggccccccacctgtgcagagcagcctgaacatgcattccgtgcccagctacctcacccagcctccacctcctcctccacctcctccaccactgcccccaccgccaccacctcagcctccaccacctccaccccagagcctgggcccccctgggcgtcccaaccctggtgggaacggtgtggtggaggtgtacagtgctgctgcgcccctggctgggagtggaacggtggagatccaggcactggggatgcagccctacccacccctagaggtgccaaaccagtgtgtggagcctccagtatatcccacccccacagtgtacagccctggcaaacagggattcaaacccaaaggaccaaaccccgccgcccccatgaccagcgccaccgggggcacggtggccacctttgactctccagcaacgctgaagacccgacgagctaaagctgcagggaagccaaaggctcagaaactcaagtgctcatactgtgacaagtcattcaccaaaaactttgacctgcagcagcacatccgaagccacaccggtgagaagcccttccagtgcattgcatgtggccgtgcctttgcccagaagtctaatgttaagaaacacatgcagacccacaaggtgtggcctccaggacacagtggtggcaccgtgtctcgaaactctgtgaccgtacaggtcatggccctgaaccccagcaggcaggaggacgaggaaagcacagggttgggccagcccctgccgggtgcgccacagccccaggccttgtccacagctggtgaggaagagggggacaagccggagtccaagcaggtggtcctcatcgacagctcctacctgtgccaattctgccccagcaaattcagcacctacttccagctcaagtctcacatgacccagcataagaatgagcaggtgtacaagtgtgtggtcaaaagctgtgcccagacgttcccaaagctcgacacatttctggagcacatcaagagccaccaggaggagctgagctaccgctgccacctctgcggcaaggacttcccctcgctgtacgacctgggcgtgcaccagtactcccacagcctcctgccacagcacagccccaagaaggacaatgccgtctacaagtgtgtcaaatgtgtcaacaaatactccacccctgaggccctggagcaccacctgcagaccgccactcacaacttcccctgcccacactgccagaaggtgtttccttgtgaacgctacctgcggcgtcatctgcccacccacggcagcgggggcaggttcaagtgccaagtgtgcaagaagttcttccggcgggagcattatctcaaactgcatgctcacatccactcgggtgagaagccctacaaatgctcagtgtgcgagtctgcgttcaaccgcaaggacaaactgaagagacacatgttgatccacgagcccttcaagaaatacaaatgccctttctcgacgcacacaggctgcagtaaggagttcaaccggccggacaagctgaaggcccacatcctctcccactctggcatgaagctccacaaatgcgccctgtgcagcaagtccttcagccgccgtgcccacctcgccgagcatcagcgcgcccacacgggcaactacaagttccgctgtgctggctgcgccaagggcttttcccgccacaaatacctcaaagatcaccgctgtcgtctcggcccccaaaaggacaaggacctgcaaacccggcggcccccccagaggagggcagccccccgcagttgcggcagtggtgggcgcaaggtgctgacccccttgcctgacccgctggggctggaggagctgaaggacacaggggctgggctggtgcccgaggctgtccccggcaagccgcccttcgcagagccggacgcggtgctgtccatcgttgtgggtggtgcggtgggcgcggaaactgagctggtggtacctggacacgctgaggggctgggctccaacctggctctggcggagctgcaggctggggccgagggcccatgtgccatgctcgctgtgcccgtctacatccaggcctccgagtgacggacctgaggtgtctgtttcctgggcaggcctgatgctcctgtttgggtccagggcccctgggggcagaccggtgatccttaccagtggaagcgagccatcgagccattggcagaaatcctgctgaatgtcattcagaaacctcagcccatggtcgccctcctgtgcccctctcctgccggaaagccctgcaacattctagggttgggggcagggccatccacggtttctgggcagagccatggtggcaggagagagatggctgaagcctgagcagcccagagtcccgctggtctaggctggtggtcggggcccctgggagaggagacagggcattcctccccactctgtctccaggctgcctctgggtagcctctagtctgctgttcttcaggaggcctgccataaactcttcggagtttacgtgttgcaccttttcacagacggttccccacagcatcctcagacagctctgtgatgtagcttttaggaggcactcaggtgtcacggctagactgcagctatgagacagatctggcttcaaatccaagagttgccatgcacttgctgtgtgaccttgggcaagtcacttcacttctctgagccccgtgttcctcatctgtacaatggggcttacgatactactacctcatagggttgtcctggggatccagtatgatgaagtgcgccaggggcttggcatggtgcccggcacgcagaaagtgctcaataaatgtttttgtcataacgtgaaaaaaaaaaaaaa

SEQ ID NO: 1342 - DNA, 1604 bp, Homo sapiens
cctccgcccgcccgcctgcctgcctgcccgcccgctcgctcgcccggcccgcgactcatgtcccgccgcaaggccggcagcgcgccccgccgagtagagcccgcgcccgccgccaacccagacgacgagatggaaatgcaggacctcgtcatcgaactcaagcccgagccagacgcgcagccccaacaggccccaaggctggggcccttctccccgaaggaggtgtcctcggcggggcggttcggcggcgaaccccaccactcccctggccccatgcccgccggggccgccctcctcgccctcggcccgcggaacccgtggaccctgtggacgccgttgaccccgaactatcccgaccgccagccctggaccgacaaacacccagatctgttgacctgcggccgctgcctgcagaccttcccgttggaggccatcactgccttcatggaccacaagaagctgggctgtcagctcttcagaggccccagccgcggccagggctcagaacgagaggagctgaaggccttgagctgcctgcgctgtggcaaacagttcacagtggcctggaagctgctgcgtcacgcccagtgggaccacggactgtccatctaccagacagaatcagaggccccggaggccccgctcctgggcctggccgaggtggctgcagccgtgtcggcagtggtggggccagcagctgaggccaagagcccccgtgcaagtggcagcggcctcacccggcggagccccacctgtcctgtgtgcaagaagaccctcagctccttcagcaacctcaaagtgcacatgcgctcacacacaggcgagcggccctatgcttgcgaccagtgtccctacgcctgcgcccagagcagcaagctcaaccgccacaagaagacccaccggcaggtgccgccccagagccccctcatggccgacaccagccaggagcaggcctctgcagcccctccggagccggctgtccatgctgctgcccccaccagcacccttccatgcagcggtggtgagggggctggagccgccgccacagcaggtgtccaggaacccggggctcctggcagtggggctcaagccggccctggtggagacacttggggagccatcaccacggaacaaagaactgaccctgcaaacagccagaaggcatcacccaaaaagatgcccaagtcagggggcaagagccgcgggcccgggggcagctgtgagttctgcgggaagcattttaccaacagcagcaacctgacggtgcaccggcgctcacacaccggggagcgcccctacacctgtgagttctgcaactacgcctgcgcccagagcagtaagctcaaccgccaccgccgcatgcacggcatgacgcctggcagcacccgcttcgagtgcccccactgccatgtgcccttcggcctgcgagccaccctggacaaacacctgcggcagaagcaccctgaggcggccggcgaggcctgagcccaggaaagcccccctcactgtccctggtaccgctgccaacacccattgacctcctcgtttttgcccgccttctccaagtaaattttcccttttatttaaaaaaaaaaaaaaaaaaa

SEQ ID NO: 1343 - DNA, 4242 bp, Homo sapiens
acgcgcagttttctgcagttccggaagcggatcgtgttgggtgcgggtgacgccgccgagcgaagaacccttgaagaagaggaagaggaaagaaagacaagtcaggcatggctctcacccagggacaggtgacattcagggatgtggctatagaattctctcaggaggagtggacatgcctggaccccgctcagaggactttgtacagggacgtgatgttggagaattataggaacctggcctccctgggaatctcttgttttgacctcagtattatctctatgttggagcaagggaaggagcctttcactttggagagccaagtacaaatagcaggaaacccagatggatgggaatggatcaaagctgtgatcacagctctctcttccgaatttgtaatgaaagatttactacacaaagggaagagtaatacaggagaagtattccaaacagtgatgttggaaagacaggaaagccaagacattgaaggatgttccttcagggaagtccagaaaaatacacatggccttgagtatcaatgcagagatgctgaaggaaattacaaaggagtgcttttgacccaagaaggcaatctcactcatggaagagatgaacatgataaaagagatgcaagaaacaagcttattaaaaatcagcttggattaagccttcagtcacatctgcctgaactgcagctttttcaatatgaagggaaaatttatgaatgtaatcaggttgagaagtctttcaacaataattcctcagtttcaccacctcaacaaatgccttataatgtcaaaacccacatttctaagaaatatctcaaagattttatctcttctttattactcacacaggggcaaaaagcaaataattggggaagcccttacaaatctaatggatgtggcatggtctttcctcaaaattcacaccttgcaagtcatcagagaagtcatactaaagagaaaccttacaaatgttatgagtgtggcaaagcctttagaacacgttcaaacctaactacccatcaggtgatccatactggcgaaaaacgttacaaatgtaatgagtgtggtaaggtctttagtcgaaattcacaactctcacaacatcagaaaattcacactggagagaaaccttataaatgtaacgaatgtggcaaggtcttcactcagaattcacaccttgtaagacatcgaggaattcatactggagagaaaccttacaagtgtaatgagtgtgggaaagcctttagagctcgttcaagcttagctatccatcaggcaacccacagtggagaaaaaccttacaaatgtaatgaatgtggcaaggtcttcactcaaaattcacaccttacaaatcactggagaattcacactggagagaaaccttacaagtgtaatgagtgcggcaaagcctttggtgttcgttcaagcctagctattcatctggtaattcacaccggagaaaagccttacaaatgtcatgaatgcggcaaggtctttaggcgtaattcacaccttgcaaggcatcagctaattcatactggagagaaaccttataagtgtaatgagtgtggcaaagcctttagagcacattcaaacctaactacccatcaggtcatccatactggagaaaagccttacaaatgtaatgaatgtggcaaggtcttcactcaaaattcacaccttgcaaatcatcaaagaattcatactggagtgaagccttatatgtgtaatgagtgcggcaaagccttcagtgtgtattcaagcctaactacccatcaggtcatccatactggagaaaaaccttacaaatgtaatgagtgtggcaaggtcttcactcagaattcacaccttgcaagacatcggggaattcatactggagagaaaccttataaatgtaatgaatgtggcaaggtctttaggcataattcatacctttcaaggcatcagcgaattcatactggagagaaaccttacaagtataatgagtatggcaaagcctttagtgaacattcaaacctaactacccatcaggtcatccatactggtgaaaaaccttacaaatgtaatgagtgtggcaaggtcttcactcagaattcacaccttgcaagacatcggagagttcatactggaggtaaaccttaccagtgtaatgaatgtggcaaagcctttagtcaaacatcaaagcttgcaaggcatcagagagttcatactggagagaaaccatatgagtgtaatcagtgtgggaaagcctttagtgtccgttcaagcctaactacccatcaggcaatccatactggaaaaaaaccttacaaatgcaatgagtgtgggaaggtcttcactcagaattcacaccttgcaagacatcggggaattcatactggagagaaaccttacaagtgtaatgagtgtggcaaagcctttagtcaaacttcaaaacttgcaaggcatcagagaattcataccggagagaaaccatatgagtgtgggaaaccctttagtatctgttcaagcctaactacccatcagacaatccatactggtgggaaaccttacaaatgtaacgtgtggaaagttctaaagtcagagttcaaaccttgcaagccatcacagaattcatagtggagagaaaccttacaaatgaaggtggtaacttttgcagttagaattcattcctttgacaacgtcagagaatttatgcctgagagattccttgaaaatgcaatgactggctgggtgcagtggctcatgcctgtaatcccaacactttgggagtccgaggcaggtggatcacctgaggtcaggagttcaagaccagcctgaccaacatggcgaaaccccatttctactaaaagtacacaattagctaggcctggtggcgtgcgcctgtaatcccagctatataggaggctgaggcaggagaatcacttgaacccaggaggcggaggttgcagtgagccaagatcgtgccaatgcactccatcctgggcaaaaagagcaaaactccatcttaaaggaaaaaaaaaaaatgcaatgactgtggcaaactcctcatgagttcaagtattaatagacatccaagagtccataataatgagaaatcacataaatgtactgtgtgtgacagaggctttattcaggcctcacagctttgcaggcattaaaatctacgtatttgatggaaccacacaaatgtaatgtgtaagagcatcctgaagctcttactctaagactgtaactgtaggtgaggattcatacaaagagtgactcagtctctagttctttgattcacttttaaaatgataaactgcacaataattacacgttccaatatggtaaaacttaagacattatatatttcaaaggtcaaaggacatttggaaatggctacttaccttcaggttataaaatcttttattccattgtttgaggtttctcaaaaaggctactgtttgtgactttcaacctgaactatggatctgtggctattttgcatccttaagcacctttcgtggtgcctatctgggaaagaaccacagtatggaaaggcttacttcattacatgaggatcatttttatccatgtttattgaagaaggaggactctgccttgtaaaattaaatattctctcaattgagagaccatggttttggggcagaaaataatgtaaaactatgatatcaatcatcatactgattgtgttcagggtgcttttctgagagaaagacaccatgggttttagggaagtaaggctctacctgcattgagcaggccaagacctcaggacactggaatttttatgagaggagagtaataagttattagtgactgattatgtgatgggaatagtgcaggggaaatggttgccactttctctactgaatggcaatagctgttttatagcagagattgatgaaaaataggcttatttttgaaattgaagaggtaacagttattagagtggagagcttggtcagaaaaaccagaataccatggttttttttgttttgttttgtttttagtagaattcacactaattgctggaattacattttgctacagttttattaagaatgtgtcacagacataatgttttgctaaaaaaaattcaacgttttcttataactataaacaaatcacattctttgtaccaacatcattttatcctacctcagtaggatacttcatagcagataataacaatacactcagtcttttaggttggaaaaaaaaaaaa

SEQ ID NO: 1344 - DNA, 2664 bp, Homo sapiens
cattgttctcgtgccggtagaagctgaagtaccggtcagccagcctcctgctgcagagccagtgaactcaggtcgggcttctcagctgcgcacataggcagtactcatcttggccctgggaagaaactcaagaagaagcttttgaaacataaagcttggatggggtttgacctctgcagggcagcgcccagctataggagttcccctgctgagcagagaagatgactgcagaattgagagaagccatggccctagccccatggggcccagtgaaggtgaaaaaggaggaggaagaagaagaaaacttcccaggtcaggcatccagccaacaagtgcactccgagaacatcaaagtctgggccccagtgcagggtcttcagacaggccttgatggatcagaagaggaagaaaagggtcagaacatatcctgggatatggcggtagtcctgaaagcaactcaggaggcacctgctgcttcaacccttggcagctactcattaccagggactctggccaagagtgagatactggagactcatgggaccatgaactttctaggtgctgaaaccaagaacctacagttactggttccaaaaactgagatatgtgaggaagctgaaaaacccctcatcatatcagaaagaatccagaaagctgatcctcaaggacctgagttaggagaagcttgtgaaaagggaaacatgttaaagaggcagagaataaagagagaaaagaaagatttcagacaagtgatagtgaatgactgtcacttacctgaaagcttcaaagaagaggaaaaccagaaatgtaagaaatctggaggaaaatatagccttaattctggcgctgttaaaaatccaaaaacccagcttggacaaaagccttttacgtgtagcgtgtgtgggaaaggatttagtcagagtgcaaacctcgttgtgcatcagcgaatccacactggagagaaaccctttgaatgtcatgagtgtgggaaggccttcattcagagtgcaaacctcgttgtgcatcagagaatccacactggacagaaaccttatgtttgctcaaaatgtgggaaagccttcactcagagttcaaatctgactgtacatcaaaaaatccactccttagaaaaaacttttaagtgcaatgaatgtgagaaagcctttagttacagctcacaacttgctcggcaccagaaagtccacattacggaaaaatgctatgaatgtaatgaatgtgggaaaacatttactaggagctcaaacctcattgtccaccagaggatccacactggggagaagccctttgcctgtaacgactgtggcaaagcctttacccagagtgcaaatcttattgtacatcagcgaagccatactggtgagaagccatatgagtgtaaagagtgtgggaaagcctttagttgtttttcacaccttattgtgcaccagagaattcacactgcagagaaaccttacgactgcagcgaatgtgggaaagccttcagtcagctctcttgccttattgtccaccagagaattcacagtggagatcttccttacgtgtgtaatgaatgtgggaaggccttcacatgtagctcatacctacttattcatcagagaattcataatggagaaaaaccttacacatgtaatgagtgtgggaaggccttcagacagaggtcgagcctcaccgtgcaccagagaacccacactggggagaagccctatgaatgtgagaagtgtggtgcagctttcatttccaactcacacctcatgcgacaccatagaacccatcttgttgaataacaagtaaggaagaggaagacctccagcattggtcataaccttctgcctccctaatgagacacctctttgctgttttcttcctcctctataaaagtgagggctgtgtccttaaaagttatagttttcaggaatgcagcagaagacacaagaaaagcatttcagaggctaatttaaaacaaaaagtaagcacctaaaggcaaggactttgttttaactgtaccttaagcggtcatgttctctgaagtggaatgtggctttcctaggaatgggtcgtacaaagctaagtggtaatgatgctatttggggaaaggtcttttttgcttaattttgttttttaaaactctgatgattgcttgagcaacaggcaggttatctgcctggttgaattctggttgaaccgtgtattctaatatttctggttaagtggtgactgggtaaggaaaccacttggggtagcagttcaacaattcacttacgaatgtttataagctttccatttcctaggtaattttttaaaagccagtcaaaacaaaaactttactgaaaatggacagaaataggaaatggactttttccttactgtctatacctcctgaaccttggtattgtaaagatctggggacctctgggtctgttctgaccattccctagtctccatggccaagcactcaaggattgatggacaccacacaccagctatattcatttgccaagatcaacagctccttctccaaacaactcaagcccccaattcccatcgcattccatttgggtgagatgcaactaacagccccttcctggatgaaggagtcaaagaataaagcttgcctagaggcatgccccaaaaaaaaaaaaaaaa

SEQ ID NO: 1345 - DNA, 2358 bp, Homo sapiens
agcagtttacggaagtgtaacgttgaggcccttcttgtgtatctggagaaaatagaggttctgactcctcaggagcaaaaaacataacctgaagagggaggaagtggatttggggttcaccatttcttggggcacacttgattgaaaactgagacttctgaagagaaggccagaagatacaaagacagaccatcccagttgaatgctgtcttccaagaacagaagaaaatgatccaggcccaggaatccataacactggaggatgtggctgtggacttcacttgggaggagtggcaactcctgggcgctgctcagaaggacctgtaccgggatgtgatgttggagaactacagcaacctggtggcagtggggtatcaagccagcaaaccggatgcactcttcaagttggaacaaggagaacaactgtggacaattgaagatggaatccacagtggagcctgttcagacatatggaaagttgatcatgtgctggagcgcttgcagagtgaaagcctggtgaacagaaggaaaccatgtcatgaacatgatgcatttgaaaatattgttcattgcagcaaaagtcagtttctgttagggcaaaatcatgatatatttgacttacgtggaaaaagtttgaaatccaatttaactttagttaaccagagcaaaggctatgaaataaagaactctgttgagtttactggaaatggggactcctttcttcatgctaaccatgaacgacttcatactgcaattaaattccctgcaagtcaaaaactcatcagcactaagtcccaattcatcagtcccaagcatcagaaaacacgaaaattagagaagcatcatgtgtgcagtgaatgtgggaaagccttcatcaagaagtcttggctaactgatcaccaggtaatgcatacaggagagaaaccccacagatgtagtctatgtgagaaagccttctccagaaagttcatgcttactgaacatcagcgaactcatacaggagaaaaaccttatgaatgccctgaatgtggcaaagcctttctcaagaaatcacggctcaacatacatcagaaaacacataccggagagaaaccctatatatgcagtgaatgtggaaaaggcttcatccagaaaggaaatctcattgtacaccagcgaattcatacaggtgagaaaccttatatatgcaatgaatgtggaaaaggcttcattcagaagacgtgtctcatagcacatcagagatttcacacaggaaagacgccctttgtgtgcagtgaatgtggaaaatcctgttctcagaaatcaggtctcattaaacatcaaagaattcacacaggagagaaaccctttgaatgtagtgaatgtgggaaagcctttagcacaaagcaaaagctcattgtccatcaaaggactcatacaggagagagaccctatggctgtaacgagtgtgggaaagcgtttgcgtatatgtcgtgtctggttaagcataagagaatacacacaagggagaaacaagaggcagccaaggtggaaaatcctcctgcagagaggcacagctcattacacaccagtgatgtcatgcaggagaaaaactctgctaacggggcgactacacaagtgccttctgtggcccctcagacatcattaaacatcagcggcctcctcgcaaacaggaacgtagtccttgtgggacagccagtggtcagatgtgcagcctcaggagataacagaggatttgcacaggacagaaaccttgtgaatgcagtgaatgtggttgtgccttccgtgatcaattatgtcttattttatgttacagaaaacccataggaagaaaactcagatctatgtggaaaagggttgagcaaaaatttgtagttcattatgtggccgaaaagcatacactgagagaacatgtataaggctgagatagcctgataaactcatcctattaaaatgtatgctgtgatacacaggcaaatttgatgttaacctaagcacatacacagcaattgctcgactgtgtcaattaaatgagtaaaggaagcccaagtacttttaagtggaggaaatgaagtactgtgaatttttaaaacagatgagataattggtgtcgggagtgttgcagtgactgaaaagcttcataaggggcagttggtgggaaagggctaatactgtaatggtggaatgtgggacacatatgtgtcaattcagtttccttagaccagtgccagtgtggaggattaattgaaaaccaggaccataaactttcagaactttgtattatgcagagggatctgtgaaactagtcaatttgtttcattaaacaaatattttaaaattaaaaaaaaaaaaaaaaaa

SEQ ID NO: 1346 - DNA, 2555 bp, Homo sapiens
ccggcgcgccgcggggtgagcggcgccgggcctgaggtcgcccagacgccgtcggggcggagccgggtcgcgaggctgcatcccggccggcggttccggagcctcgcggctggggaggcgcggcccgggacgctcgagcttagggagatctgccttctggagactgcgccgtcctcccgggagagccagaaagaggacatggctgctgggcagcgggaagcgaggccccaggtgtcactgacgtttgaggatgtggctgtgctgtttacccgagatgagtggagaaagctggccccttctcagagaaacttgtaccgggatgtgatgctggagaactataggaacctggtctcactggggctcccatttaccaaaccaaaagtgatctccctgttgcagcaaggagaagatccctgggaggtggagaaagacggttctggcgtctcctctctaggatcgaagagcagtcataaaaccacaaagtcaacgcaaacacaagactcttcatttcagggactgatactgaaaagatccaacaggaatgtaccttgggatttgaaattagaaaagccttacatatatgaaggcagattagagaaaaagcaggataaaaagggaagttttcagatagtttcagccacccacaaaaaaatccccactatagaaagaagccataaaaatactgaattgagccaaaacttcagcccaaagtcagtgcttattaggcaacagatacttcccagagaaaaaacaccaccaaaatgtgaaatacaaggaaacagcctcaaacagaattcacaattacttaatcaaccaaaaattacagcagataaacgctataaatgtagtctgtgtgaaaaaaccttcattaacacttcatcccttcgtaaacatgagaaaaaccatagtggagagaaactatttaagtgtaaagaatgttcaaaagcctttagccaaagttcagctcttattcaacatcaaataacgcatactggagagaaaccctacatatgtaaagaatgtgggaaagcctttactctcagtacatccctttataaacatctaagaacccatactgtggagaaatcctacagatgtaaagaatgtggtaaatccttcagccgaaggtcaggcctttttatacatcaaaaaattcatgctgaagaaaacccttgtaagtataatccgggtaggaaggcatctagttgcagcacatccctttctggatgtcaaagaattcattctagaaagaagtcctacttatgtaatgaatgtggcaacacctttaagtctagctcatcccttcgttatcatcagagaattcacactggagagaagccttttaaatgtagtgaatgtgggagagccttcagccagagtgcctctcttattcaacatgaaagaattcacaccggagaaaagccctatagatgcaatgaatgtgggaaaggctttacttctatttcacgacttaatagacaccgaatcattcatactggagagaagttttataattgtaatgaatgtggtaaagccttaagctcccactcaacacttattattcacgagcgaattcatactggagaaaaaccatgtaaatgtaaagtatgtggaaaagccttcagacagagttcagctctcattcaacatcagagaatgcatactggagaaagaccctataaatgtaacgagtgtgggaaaacattcaggtgtaactcatcacttagtaatcaccagagaattcatactggagagaaaccatatcgatgtgaggaatgtgggatatcttttggccaaagttcagctcttattcagcatcgaaggattcatacaggagaaaaaccctttaaatgtaatacatgtggaaaaacttttagacaaagctcatcacgtattgcacatcagagaattcatactggagagaaaccctatgaatgtaatacatgtgggaaacttttcaaccataggtcatcccttactaatcattataaaattcatatcgaagaggacccctagaaagtagatttgtatgtgtgaaagccttaaaccaaagctcatcgaagaatacatccttgagagagatgtaataaatgtaatggatgtgaaaaaaactgtaataatttagccctcattaggtatttaattccatggataaacctcagctatataatagatatgaggaaagtgtttgtgcctgtcagacacttaaaaaaataacctgagatgaagaatttacaattgaagacattgactttagccatttgtgaaatgggtttgctttttcccttttcctacagacgtatatgctagatgtcacgtgatcatcagaaacagatatccgagtgggtggggaggtgtgctttagatttctcattagaagaccaccaaactggtaatatttttatagcattttaatagcttgatcaaattgtacctttttagagaaaaggaccaaaataaaagaaaaatgaattatgaactacctctcagtctctggggtttgtccttttcctaccctgatgtcaaacttatgcatggatttcattaaaaaagaa

SEQ ID NO: 1347 - DNA, 2003 bp, Homo sapiens
ggagcgcctggcggggccgctgggccgagggggccgccggcggggctggcgggcggggggcttcctgcgggcccggggggagccggcggccggcgcgggcgcggcgggccgggcaggggcgaggggcgccgggtcttgccccagaagctgcgggcacatccacgcctgaaatgcggcgctcagtcctggtcaggaacccaggccacaaaggcctgagacccgtttatgaagagctcgactctgactccgaggacctagaccccaatcctgaagatctggacccggtttctgaagacccagagcctgatcctgaagacctcaacactgtcccggaagacgtggaccccagctatgaagatctggagcccgtctcggaggatctggaccccgacgccgaagctccgggctcggaaccccaagatcccgaccccatgtcttcgagtttcgacctcgatccagatgtgattggccccgtacccctgattctcgatcctaacagcgacaccctcagccccggcgatccaaaagtggaccccatctcctctggcctcactgccaccccccaggtcttggccaccagccccgcggtgctccccgcccccgccagcccgccccggcccttctcctgcccggattgcgggcgagccttccgccgcagctccgggctgagccagcatcgccgcacgcacagcggcgagaagccgtaccgctgccccgactgcgggaagtccttcagccacggtgccaccctggctcagcaccgtggcatccacactggggcgcggccgtaccagtgcgcggcctgcggcaaggccttcggctggcgctccacgctgctgaaacatcgcagcagccacagcggggagaagccgcaccactgcccggtgtgtggcaaggccttcgggcacggctcgctcctggcacagcacctgcgcacgcacggcggcccgcggccccacaagtgcccggtgtgcgccaagggcttcggccagggctctgcgctgctcaaacacctgcgcacgcacacgggcgagcggccctacccgtgtccgcagtgcggcaaggccttcgggcagagctcggcgctgctgcagcaccagcgcacacacacggccgagcgcccctaccgctgcccccactgcggcaaagccttcgggcagagctccaacttgcaacaccacctgcgcatccacacgggcgagcggccctacgcctgcccgcactgctccaaggccttcggccagagctcagcgctgctccagcacctgcacgtgcattcgggcgagcgtccctatcgctgtcagctctgcgggaaggccttcggccaggcctccagcctcaccaagcacaaacgggtgcatgagggtgcagccgctgctgcagctgccgcggccgctgcagctgcagcagcggccgccggcctgggcctcgggcctggcctaagccctgcatccatgatgaggccggggcaggtctccctcctgggtcctgatgctgtttctgtgctcggctctggcttgggcctcagccctggcaccagctctggccgcaaccctgaccctggctctgggccgggcactctgccggatcccagctccaaacccctccccggctccagatccacccccagccctactcctgtggaatcttctgacccaaaggctgggcacgacgctggtcccgaccttgtgcccagcccagaccttgatcctgtgcccagcccagaccctgatcctgtgcccagccctgatcccaaccctgtgtcctgccctgacccctgttctcccactcgtggcactgtcagcccagccctccctaccggcgagagtccagagtgggtacaggagcaaggggcactgctggggcctgatggctgaaggagacgccggcatcctcgggggcctggggaagttgtgtgttgtgcagtcagtaaaatcctcccactgcctccggaaaaaaaaaaaaaaaaaaaaaaaaaaaaaaaaaaaaaaaaaaaaaaaaaa

SEQ ID NO: 1348 - DNA, 3505 bp, Homo sapiens
aggaatgagggatgtcagaatctggctcggaggaatctcagtagggacaacaggcaggagaattatgggagcgcatttccccagggtggtgaaaacaggaatgagaacgaggagtcaacctcaaaggctgaaacctcggaagattcagcatcacgcggggagacaacaggaagatcccagaaagagtttggagagaaacgtgaccaggagggcaaaacaggagaaagacagcagaaaaaccctgaggagaaaaccaggaaagagaaaagagattcagggccagctataggaaaggacaaaaaaaccatcacaggagagagaggtccaagggagaaggggaaaggattgggaagaagcttcagtctgagctccaacttcaccacccctgaagaagttcccacgggaacaaagtctcacagatgtgatgaatgtggtaaatgcttcacgagaagttcaagccttatccgccataaaataatccacactggagaaaagccctatgaatgtagtgagtgtgggaaagccttcagtcttaactccaaccttgtcctgcatcagaggatccacacaggagagaaacctcatgaatgtaacgagtgtggcaaggccttcagccacagttccaatctcatcctccatcagcgcatccactctggagagaaaccttatgaatgtaatgagtgcgggaaggccttcagccagagctcggacctcaccaagcatcagagaattcacacgggggagaaaccctatgaatgtagtgaatgtggaaaagctttcaaccgaaactcatacctgattttgcatcggagaattcacactcgagaaaagccctacaagtgcactaagtgtggcaaggccttcacccgcagctccaccctcactctgcatcacagaatccatgccagagagagagcctctgagtacagcccagcctcccttgatgcatttggcgcgttcctgaaaagttgtgtgtaaaggaagaatttgccatcaagccatttcccccttttgtttctaaaattatttcagagatgtgtgctcctggagggaaaaagaaatacagcctcaacagattaaaaaacaaaagtcacacttaaggatccttctagtcacatcagcagtgttctgcctttatgtagtagttgggcatataatccttccacacagcccctgcagggaaaggctaatcttacggataatccacgtgagatttccacacaagagaaaagcacacgcatagtgaaatgtcagtcttttcagtaatgaggatacctttaaggcactcttggactctcggcaaccacaacataatagttgaaagatcaagattggctccacgaaagtgatacggaggttaggatgctacttgctgcaaacaagccctactttggccaacatcctgcttatttctcaaaaaagagggacagtgaaaacaaaaacgacattgggacatgctgctcaaggtagttatatatacgataagttgtatatatgatcactggtagcctaccaaagctgtagaaatctaggactgtgctaatcagtatcaaaccaaagatttctatctcttcccgaaagagagggtatgtgcaccagtctacagttccaaaggactgcaacaaatgtagatggttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcatttttttttttttgacatctttctgtggcaaacctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgagggtatgaaactttcattggtcccatcgttgtgcgcagggtgcaactggctacctagaagctgatggcaggagactgttcacacacaggagattgtgagctgtgtaagtagtcatcgccactcaagtaggacaagggtcctacccaaggctaggaccgcctgcggaaacagaaacatagactgagaacaaacctcaagactatcagtgtgacctccccataacaagagaaccccatatatagtttgagactttcccttgagaaacttatactaaaactattactcatcagtcattcactgatcagcagctaaagtccatgagaccaaatggttttatatggaaccaacgaagtgggagctaaaactgcacagtggtcattctttggcctctccttggctttatgacttaaaccaactacaacttccctatagcttctaagcagtttcatcagcattacttgggaaaacgtgttgcaagtcaaccagtcactaggatatttctacccatgcaacggaagaaaaacccattactccagaagagtatatctaagtaactaaaatggaggcagaaaatgttttaaggattttcttcaaagaataagccacagcaatggttttgtagaaaactcctgtgcttttgagcaaggacttttgccctctagaaagcaactgaggccaggtgcggtgtcacgcctgtaatcccagcactttgggaggccgaggtgagcggatcacctgaggtcaggagttttgagaccagcctggccaacatggtaaaatcccgtctctactaaaattataaaaattagccgggcatgatggtgggcacctgtaatcccagctacttgggaggctgaggcaggagaatcacttgaacccaggaggcagaggttgcagtgagccaagattgcacactgcactccagcctgggtgactagcaaaactccatcctttagagcacatc

SEQ ID NO: 1349 - DNA, 5163 bp, Homo sapiens
atttgcgccgtgtagagttgcatgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtgtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaaaagaaaagaaaaaaatcatatactgaggttgctaagatctacatgacaataagatattttgggagagagatacgttcacataattttattacatatattgttacaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtgtccactgcgggtcttcaaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgagcaggaaaaaaaaaaaaaaaaaaaa

SEQ ID NO: 1350 - DNA, 1161 bp, Homo sapiens
gagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaaggaatactacaacacatctttgcaggattctttgcaaattctgccattcctggatctccacaccctttttcctggagcgggatgctgcactccaaccctggggactatgcctggggtcagacagggcttgatgccattgtaacccagcttttaggacaactggaaaacacaggccctcccccagctgacaaggaaaagatcacatctcttccaacagtgacagtaactcaggaacaagttgatatgggtttagagtgtccagtatgcaaagaagattacacagttgaagaggaagtccggcagttaccttgcaatcacttctttcacagcagttgtattgtgccgtggctagaactgcatgacacatgtcctgtatgtaggaagagcttaaatggtgaggactctactcggcaaagccagagcactgaggcctctgcaagcaacagatttagcaatgacagtcagctaaatgaccgatggactttctgaagctaaagaccacacctgaatcagggctgtggtaatcatcttaccatagctgtaaattgtatcaaaacaaaaaattagtagatggatttaggaatatgtaagaaactcaacacataatataaatgcaatgaatgtttttcttctttaaatttaaagttagtatctacagatggaattgtatctacaaccaaatgcctcttatccctgaattcagagtgataattttataagtgtgaaacttaattatgtagggctccccccgtctgaatagaattaattccttaaagtctagttagggtcctgctgtctgtcatgttgccttgtaacggatgtttccacctccttctccaacctctaccccaccattagtgtattttactataaaaacagtggaaccacagccctaaagtcctgctgatataaagtccttttgtcttaattgtatttaaaaaaaaaaaaaaa

SEQ ID NO: 1351 - DNA, 2770 bp, Homo sapiens
attgttcctgttctctttcttaagtcattcgaaacactgtccctgcgagttctttaagttccctgcaatctgtacacaagagaaagagggagagagagagggagagagacagagagagcagggatcaggtaaaggagtggggctgctgcagccattcagacctcaggagctggaaaattgccaaggatgcagaaggaaatgaagatgatcaaagacgaggatgtgcatttcgacttggctgtgaagaagaccccctcctttccccactgcctgcagccagtggcttctcggggaaaggctccccaaagacaccccttcccggaagctctccgagggccattttcccagtttcggtatgaacctcccccaggagacctagatgggttccccggggtcttcgaaggagcagggtctaggaaacggaagagcatgcccacaaagatgccctataaccaccctgcagaagaagtcaccctcgccctccactcagaggagaacaaaaaccacggccttcccaacctccctttgctgttcccgcagcccccgcgccccaagtatgactctcagatgatcgacctgtgcaacgtgggcttccaattctaccgcagcctggaacactttgggggcaagcccgtcaagcaggaacccattaagcccagcgccgtgtggccccagccaacgcccactccattcctgcccacgccctacccctactaccccaaagtccacccgggcctcatgttccccttcttcgtgccctcgtcctcgcccttccccttcagccggcacaccttcctgcccaagcagcccccggaacctctgctgccccggaaagccgaaccccaggagagcgaggagaccaagcagaaggtggagagggtggacgtgaacgtgcagatcgatgacagctactacgtggacgtgggcggctcgcagaagcgctggcagtgccccacctgcgagaagtcctacacctccaagtacaacctggtcacccacatcctgggccacagtgggatcaagccgcacgcgtgcacgcactgcgggaagctcttcaagcagctcagccacctgcatacccacatgctgacccaccagggcacgcggccccacaagtgccaggtgtgccacaaggccttcacccagaccagccacctgaagcgccacatgatgcagcacagcgaggtgaagccgcacaactgccgcgtgtgcggccgcggctttgcctaccccagcgagctcaaggcccacgaagccaagcacgccagtgggcgcgagaacatctgtgtggagtgcggcctcgacttccccaccttggcccagctgaagagacacctcaccacgcaccggggccccatccagtacaactgctccgagtgcgacaagaccttccagtacccgagccagttgcagaaccacatgatgaagcacaaggacatccggccctacatctgctcagagtgtggcatggagtttgtgcagccgcaccacctcaagcagcactccctcacccacaagggtgtgaaggagcataagtgtgggatttgtgggcgggagttcaccctgctggccaacatgaagcgacacgtgctgatccacaccaacatccgcgcctaccagtgtcacctctgctacaagagcttcgtgcagaagcagaccctcaaggcacacatgatcgtccactctgacgtgaagcctttcaaatgcaagctttgtgggaaggaattcaaccggatgcacaacctgatgggccacatgcacctgcactcagacagcaaacccttcaagtgcctctattgcccaagcaaattcaccctgaaggggaacctgacacgccacatgaaagtcaagcatggagtcatggagcggggccttcattcccaaggtctgggaagggggagaatcgccctggcacagacagccggtgtcctgaggagtctggagcaggaggagccctttgacctctctcagaagcgccgggccaaggtgccggtgttccagtcagacggggagagtgcccagggcagccactgccacgaggaggaagaggaggataactgctacgaggtggagccctacagccctggcctggccccccagagccagcagctctgcacacccgaggatctgtccaccaagtcggagcacgcccccgaggtgctggaggaagcctgcaaggaggagaaggaggatgcatccaagggagaatgggagaagaggagcaagggtgaccttggggcagagggcggccaggagagagactgtgccggcagagatgagtgtctcagtctcagggcttttcagagtacccggcggggcccctctttttctgattacttatacttcaagcacagagatgagagtttgaaagaattactggagaggaaaatggaaaaacaagcagtgcttttaggtatctaagtggacagttttaaaattacatttggaaaatgagaacgaggcagttcaaatatagctttctgtatgaactgtcattttctggagactggcgaatagtaccaatctctacaaatggcttagactaaatgagcagggatgtaggtaatggaaagccttctcaggtcattcacggggcccttgatacccttcacacatgtgcagggtcttcatcagtggcgttttatgcattgccagtataataaactgtgagtattcttccagatatctaattgtaagctgatgctgaggtgcttttagaaattctactttcctttgattcatatgcaatacatggtaaatttctaattgc

SEQ ID NO: 1352 - DNA, 1007 bp, Homo sapiens
gaattcatacaggggagagaccttatggatgtcatgaatgtgggaaatccttcagtgaaaagtcaacccttactcaacatcaaagaacgcacacaggggagaaaccatatgaatgtcatgaatgtgggaaaaccttctcatttaagtcagtccttactgtgcatcagaaaacacacacaggggagaagccctatgaatgctatgcatgtgggaaagcctttctcagaaaatcagacctcattaaacatcaaagaatacacacaggtgaaaaaccttatgaatgtaatgaatgtgggaagtcattctctgagaagtcaacccttactaaacatctaagaactcacacaggtgagaaaccttatgaatgtattcagtgtggaaaatttttctgctactactccggtttcacagaacatctgagaagacacacaggggagaaaccttttggatgtaatgaatgtgggaaaaccttccgtcagaagtcagccctaattgttcaccagagaactcatataagacagaaaccctatggatgtaatcaatgtggaaaatcattctgtgtgaagtcaaaactcattgcacatcatagaacacacacaggggagaaaccctatgaatgtaatgtttgtggaaaatcattctatgttaagtcaaaactaactgtacatcagagaatacacttggggagaaaccctataaatgtagtaaacgagggaaattactctgggtgaagtcagaactttgtagaacacagaacataaagggtgagagaaatctgttaatataatgataatgagaacacctttgccctgaagtcagttctcacagtatagaagagaacttaaagagggaaaaaacaatatgaagatagggaatgcaggaaaacattattctggaatttggaccatacactatgttacaaaactaaaagtggaaaaaacttattggtgaatgaatataggaaacattttgcccaatgccactcttcattaaacatcagagaattc

SEQ ID NO: 1353 - DNA, 6505 bp, Homo sapiens
gcgggagccgcttcgggccttctgggcatgtctgccatatggctccaggtttgtttttctccccggcactctgacggggagggctcccggcatctcctggcgtccgggtaaaggacccggaggatgctgagctgctggcgcactgcagcacaactagagatgtacggatgcccccatcttgatcttacagaatcagaggtacagccgcgagaaagagtcaagaacagacagagtcgcttgaggactcaggagggtgtttgctgcgttgacaacagactacaccctcacagtttgctctgctcttccaacaccagtggaagatgatcacatcccagggatcagtgtcgtttagggatgtgactgtgggcttcactcaagaggagtggcagcatctggaccctgctcagaggaccctgtacagggatgtgatgctggagaactacagccaccttgtctcagtagggtattgcattcctaaaccagaagtgattctcaagttggagaaaggcgaggagccatggatattagaggaaaaatttccaagccagagtcatctggaattaattaataccagtagaaactattcaataatgaagttcaatgagtttaacaaaggtggaaaatgtttctgtgatgaaaagcatgaaataattcattctgaagaggaaccttctgaatataataaaaatgggaacagcttctggctgaatgaagacctcatttggcatcagaaaattaaaaattgggaacaatcttttgaatacaatgaatgtgggaaagctttccctgagaattcactcttccttgtacataagagaggttacacaggacagaaaacctgcaaatatactgaacatgggaaaacctgtgatatgtcatttttcatcactcatcagcaaacacatccaagagaaaaccactatggtaatgaatgtggagaaaatatctttgaggaatccattctccttgaacatcagagtgtttacccattcagccagaagttaaatctcactccaattcagagaacccactcaattaacaatattattgaatataatgagtgtggaacatttttcagtgaaaaattagtccttcatttacaacagagaacacatacaggagaaaaaccttatgaatgtcatgaatgtggaaaaaccttcacccagaagtcagcccacacaagacatcagagaacacacacagggggaaaaccctatgaatgtcatgaatgtgggaagaccttctataagaattcagacctcattaaacatcaaagaattcatacaggggagagaccttatggatgtcatgaatgtgggaaatccttcagtgaaaagtcaacccttactcaacatcaaagaacgcacacaggggagaaaccatatgaatgtcatgaatgtgggaaaaccttctcatttaagtcagtccttactgtgcatcagaaaacacacacaggggagaagccctatgaatgctatgcatgtgggaaagcctttctcagaaaatcagacctcattaaacatcaaagaatacacacaggtgaaaaaccttatgaatgtaatgaatgtgggaagtcattctctgagaagtcaacccttactaaacatctaagaactcacacaggtgagaaaccttatgaatgtattcagtgtggaaaatttttctgctactactccggtttcacagaacatctgagaagacacacaggggagaaaccttttggatgtaatgaatgtgggaaaaccttccgtcagaagtcggccctaattgttcaccagagaactcatataagacagaaaccctatggatgtaatcaatgtggaaaatcattctgtgtgaagtcaaaactcattgcacatcatagaacacacacaggggagaaaccctatgaatgtaatgtttgtggaaaatcattctatgttaagtcaaaactaactgtacatcagagaatacacttggggagaaaccctataaatgtagtaaacgagggaaattactctgggtgaagtcagaactttgtagaacacagaacataaagggtgagagaaatctgttaatataatgataatgagaacacctttgccctgaagtcagttctcacagtatagaagagaacttaaagagggaaaaaaaaacaatatgaagatagggaatgcaggaaaacattattctggaatttggaccatacactatgttacaaaactaaaagtggaaaaaacttattggtgaatgaatataggaaacattttgcccaatgccactcttcattaaacatcagagaattcacacggggtgaaacctgggtcagcatccctaggttgagaagggatgcatttttctgctactactacagtttcacagaatacctgagaagacacacttggagaaaccttttgggtgtaatgaatgtgggaaaacctttcatcagaagtcagctctaattgttcaccacagaactcatataagacagaaaccctatgggtgtaatgaatgtggaaaatcattctgtgtgaagtcaagaggccagagaaaatgcacaaactgtaggaaactataggaaagcatttactatgaggttatattttatggagtatatgtaataagaagtagcttctcagtgaacatcagatagtagagaaagtatttttaactgtatccaatgtgtggatgttttaagttaaaatctaaatttaatatagaacagaggtgttgagttgcaggatatctagcaatttaagaaaatgtggaaaaaatatttttattgagaaatagcattttactttgttaatatctagtttagttcattgtcaagactgctattttctaagagacttctaaagacgccactcaagccaatggctataagtagttcaaaggtttattgcttagccatatgaaaaataagggaagattttttagcaaggggacccacaaacaagagtgctcttgtatgtccagaagaaagagaaagaccatcaatcaggggccatagtacaggagcccaccagcaggatttttgaataatcctagggcagactaaattcagacgacccatctcagaatggtggatcaaagcagcaagtcaatttgccttgtatgcaacttatgaggattagtagaagagagtgggtccagatttctggtggtttctgccctgcagatgtctaacacataagccaggacattctgctgtgagtgacttattgtacccaactctatttctctccatactgaaacatgtctttcataggtgatacaactttttaaaatgtatgtgtagatataacttaaatatggagctttcaaaaagcacaaataggctggacatggtggctcatgcctgtaatcccagtactttgggaggctgaggtgggcaaatcacctgaggtcaggagttccagaccagcctggccaacatgatgaaaccctgtctctactaaaaatacaaaaattagccgggcatggtggtgcacatcggtagtcctggctactagagaggttgaggtgggaggatcacttgaacctgggaggtgggggtttcagtgagctgagatcatgccactgcactccagcctgagtgacagagagagattcaaaaaacaaaaaaaagcaaaaatatactttgctattgggtaaggtatagtagttggcagcagaatggacccattgaggataactataaaattacagaaaatatttaaatgcaacttattgctatagaagcaaagaggactaaagggcaaaattctagagagtggtaaatctcagaaagcacaagcataaaatgcagctctgggggccctttccacttctggctatagggaagaacctgaatactgaacttgattcaggcagaggaccataacctgggggtcaggggaaggcatgggggggaccagaaaccagaagaacaatcaagactgcaatgaaaaaaatggatacattaggagcttcaaacacatataatttctcaagaaatttccagatgtctcatgctgcatagggcaggagcctgaaaagctaatttgagaagataataagtaggatttttgttttgttttgcattttgcagtacaaaggagaaatgattagaacttaggaagtgccagtgggttggtgaacatgccatcagtaaaagccctggaaacaaggtcatactagagattggttgtgccttgtcacaactgcaaacaatacctgagtggagtattcaaaaacttgcttagaaagaaaactctaggaacagatggcttcactgaagttattccaaatatttaagaaataataccaggcttttataaacttttctagaagaaaaaagatggaacttttccaattcagtttttgagggcagtacaaccttgataacaaaacctaaaaaaaaaacaacaaaaaaacccataaagctatagaccaaagtctcatagatttagatgcaaaatcctaaaattgaaaaaaacatctagccatatccataaactatatcatcaccaagagatgtttattagggcaatcaaaagatttattattttaaaaaaatcagtgtggacttccattcctctttcttttgattcccccctttgacttttcatgtatctctcctgccttccttccccagagtggaggagttagacttgcctcgtgggatgagaggagttgtggctttgtgtctgctggcaccaagagggctgagggtgaggtgtggaagggacagggggaggagatgggcagcattgttgagagattggtaacactgagcaaataaatatgttgagaatgatgacagcaagatttctccattagagaaggtatttataaaaataggaatgaggagagctagaaaacctggagtgtggcattagaatagaactcatatcttttaaatatataggaacaaataaataaattgttgtgtgtgcacatatgcatatattttgtgttcattctactgagaggacctaaacacaatgacacctcagtaacagtaagcacaccaactgccaagttattagttcctaaatactatccacaaaaaaggggaacagggatgattcctagtcagagattgggagaaatacaagatgagcctgaatcatctcatgtacctgacagtaagaaaatactctggctggtctcagtggctcatgtctgtaattctagcatgttagaaggtcaaggtgggtgggttgcttgagctcaggagtttgagaccagcctgggcaacatggcacaattgtctctacaaaaaatacaaaaattagccaggcatggtggcatgcacctgtagtccgaggtactcaggaggcagagacgtgggaggatcgcttgagcctgggagattgaggctgcactgagctgtgatcgtgccactgtactctagcctggaagacagagtgagaccccatctcaggaaaaaagaaaaaaaaaaagatgtcattcagcaggttaatggataaactgtggaacatccagaaaactttaacattcttcaaagaaatagaaaacacaatcctaaaatttatatgggaaccacaaaagacttagaatagtcagctatcctgagcaaaaggaatcaaactggaggaatcatattacctgacttccaattattcaacagagctacagtaaccaaaacagcatgatactggcataacaacagacacataggaacagtatagacaacccagaaacaaattcatacatctatggtgaccacttttgacaaaggaatgaagaacatacactggggaaaagataatgtctttaataaatggtgctgggaaaactggatatccatatgcagaagaatgaaactagacccccatctcttagcatatacaaaaatcaaaattaattaaaaagttaaatctaagacctcaaactatgaaacagctaaaagaaaacatcggggaatctctccaggacattggagtgggcaaagatttcttgtgtaatacctgacaaacaggcaaccaaagcaaaagtggacaaatgggatcacatcaagttaaaaatcttctgcattgcaaaggaaataacaaagtgaagagacaacccatagaatgtgagataatatttgcaaactatccatctgtattaggccatttttgaagtactacaaagaaatacttgagactgagtaatttataaagaagaggtttaattggctcacggttttgcaggctgtacaggaagcatggtgctaacatctgatcagcttgtagggaggcatcaggaagtttccaaccatggtggaaggcaaaaggggaataagtatctcacatggcaggtgcagggcaaagagaggggggaagggaagtgccacacaaccagatcttgtgagtactcagattttgtgaggggtgcttgaggtcatggatacccatttaccctgatgtgtttatacacatttcatacctgtattaaaatatctcatgtaccccataaacatatacacctactttgtacccacaaaaatttaaaaataaagttaatttcaatgttt

SEQ ID NO: 1354 - DNA, 2837 bp, Homo sapiens
aaacgagggggaacttccgttctttgttctgtccccggtgtgtgggtctgtgacagggtccaacagggcctggtccgtgtccggtcccccaaatctgtcgtccctgcccccaggcattggcatcaacaaaagtcagaattcccgggaacttgaacagaggctgctaaattcccagtaattgctcctttggccttctagggactgacttcaaagaaggaaggaaagaatcagtgcttcctcattctcttttaaaacccgcttcccgctgagtctgcacccaggagaccagagagcaccttgcccttccatggaaactcaggctgatctcgtatctcaggaacctcaggccctgcttgacagtgctcttccttcaaaagttcctgccttttccgacaaggacagcctgggggatgagatgttggcggctgcgctcctaaaggccaagtcccaggagctggtaacctttgaggatgtagctgtgtacttcatccggaaggagtggaagcgtttggaacctgctcagagggacctctatagagatgtgatgctggagaattacgggaatgtgttctcactggatcgtgagaccaggactgaaaatgatcaagaaatttctgaagacacaagatcacatggggtcctactgggaagatttcaaaaggatatttctcagggtctcaagtttaaagaagcctatgaacgagaagtcagtctgaaaaggccgctggggaactcccctggagaaagactgaacaggaaaatgccagattttggtcaagtgacagttgaggagaagctaacccccaggggagagagaagcgagaaatataatgattttgggaacagcttcactgtgaattccaaccttatctcacatcagagactccccgtgggagacagaccccataagtgtgatgaatgtagcaagagctttaatcgaacttcagaccttattcaacatcagagaatccacactggggaaaagccctatgaatgtaatgagtgtgggaaggccttcagccagagctcacaccttattcagcatcagagaatccacactggggaaaaaccttatgaatgtagtgattgtgggaaaaccttcagctgtagctctgccctcattctgcatcggaggatccacacgggggagaaaccctatgaatgtaatgagtgtgggaagaccttcagctggagctccaccctcacccaccatcagagaatccacactggtgagaaaccctacgcctgcaatgaatgtgggaaggccttcagcaggagctcaacccttattcaccatcagagaatccacactggagaaaaaccctatgaatgtaatgaatgtgggaaagccttcagccagagctcacacctctatcagcaccagagaatccacactggagagaagccctacgaatgtatggaatgtggaggaaagtttacctacagttcaggccttattcagcatcaaagaatccacaccggggagaacccctatgaatgtagtgagtgtgggaaagccttcaggtacagctcggctcttgttcgccatcagagaattcacactggagagaagcctttgaatgggatcggcatgagcaaaagctccctcagagttacgaccgagttaaatatcagagagtccacgtgaaagagccacacacccattttcctcactttccctgagtctcaagagctcttgccttaccctataaatctcaacagcttaggatgtgtccctttcaactcagacttttcattttagagaatggggcagatggggcaaatcgttgaattttcccagaaatcacaccagccttagaaagcgtcaaggcaagtggatggcgtgctgggaatagaaagcagctctgggaccagttaccccatttaggaaaggagtttgcactaaactgtttttctcacagcagaggaacctttccaaggtggggatggaagcacagtcgggacagaattcgatggattcctttagttggagtccgcgtagtcagcacagacagcagtggaaaggacgctctgggtcctgttatttgctagggagggtaaagggagactatttcaaagctactgttcctagtccagctttaagtttcggtaagaaacatgctgttttgtttcatgatttcgttaattatggaaatttggcattgagggattattttattgagggtagaagagattccagaatcatcatctgtgatgatggtgtcctttagggctcttggagcagccagaccatgtttccaagagaaacctggtgatattgccagcagaccccctgccatcccccccagttgtcctggggctgaatgggcaaatctgtccaaacagctagtaaccggctgtgagggagagggtcagaagcacttagcgttggcctctgattgctgtcctctcttgtcctcttcccactccaatgatgaaaatgattttctctaaatgcctgggtaaggatgctttcaaggagctcacttggcctgcttgccctgccctctcacctctgacacccagccccaggagccagaccactcctgcctccacctctgactcttcagcagctgaagattaatgcagagaaagagcaaagcccaaaagggagaaaaaaaaaacaaaaaaacaaaaaaacgaagcccagagaaggcaggctgtgcctgagcctggtagcagagctcgttgctgggtgaggatggcactccccgagttttcccaaccgacgggatgaccttccattgtgttttcccaaccctgctcatcctgtagcataaatgaagtgcactattaaacagaatagtttttcagaagagaaaaaaaaaaaaaaaaaa

SEQ ID NO: 1355 - DNA, 2830 bp, Homo sapiens
gactcaccctgggccgggggtgaggcttggactgtttctttttccaaaagaggagctcaaaagagaaagttcatctagaaatctcaaagccatgtctcaggatgaactagagtatgcccttacagggatcagtgtcattcaaggatgtgactgtggacttcacccaggaggagtggcagcaactagaccctgctcagaaggcgctttacagggatgtgatgttggaaaactattgccacttcgtatctgtggggtttcacatggctaagcctgatatgatccgcaagttggaacaaggagaagagctatggacacagagaatttttccaagttacagctacctagaagaagatgggaaaactgaagatgtcttagtgaagttcaaagaataccaagacaggcattctagacccctcatattcatcaaccacaaaaaactaattaaggagagaagtaatatttatggtaaaacatttactctaggcaagaaccgtatttcaaaaacaatactatgtgaatataaacctgatggaaaagttttgaaaaatatttcagaactagtcattagaaatataagccccataaaagagaagtttggtgacagtactggatgggagaaatcactcctcaataccaagcatgagaaaattcatcctgcagtgaatctccataaacaaacagaaagagttctcagtggtaaacaggagcttattcagcatcagaaggttcaagctccagagcaaccatttgaccataatgaatgtgaaaaatccttcctgatgaaaggaatgctatttacacatactagagctcacagaggagaaagaacctttgaatacaataaagatggaattgccttcatagaaaagtcaagcctcagtgtccatccaagtaatcttatggaaaagaagccctctgcctacaacaaatatgggaaattcctctgcagaaagcctgtttttattatgcctcagagacctcaaacagaagagaaaccctttcactgtccttactgtgggaataactttagaaggaagtcatacctcattgaacatcagcgaattcacacaggtgaaaaaccttatgtttgcaatcaatgtggaaaggccttccgtcagaagacagccctcacccttcatgagaaaacacatatagaggggaaaccctttatttgtatcgattgtgggaagtccttccgccagaaggccaccctcactagacatcacaaaacacatacgggggagaaagcctatgaatgtcctcagtgtggaagtgcctttaggaagaagtcatacctcattgatcaccagagaactcacacaggagagaaaccgtatcagtgtaatgagtgtgggaaggcatttatccagaagacaaccctcactgttcatcagagaactcacacaggagagaaaccctatatttgcaatgaatgtgggaagtccttctgccaaaagacaaccctcactctccaccagagaattcacacgggggaaaaaccctatatttgtaatgaatgtgggaagtccttccgccagaaggcaatcctcactgttcatcacagaatacatacaggagaaaaatccaatgggtgtcctcagtgtgggaaagccttcagtaggaaatcaaacctcattcgccatcagaaaactcacacaggcgagaaaccatatgaatgtaaacagtgtgggaagttcttcagttgtaagtcaaacctcattgtccatcagaaaactcacaaggtagaaaccacgggaattcagtaagtaatgtggctttttttgtaaaaaaatgttaagtcatagtaaaccctgtagatgatgttgcttgcaagcgtaatatccaacagtttaaggtactataccacatggtaacctactgtttgccagcctgtaaaacacacacacacacacacacacacacacaaatattattagacaaattagatgacaaaaatcattaagaagtccaaactttttttttattactagcttcagcagacaaaaacttcctctgtcaaggtgttataaacatttaaaatcacattttccatttccatacatatctttttgttcatcagtaataactagttggccaactgactgtggtccatggactacacagtgagtagaggttctttaaaagaaggaggtatgaactgtatttctcattgcaaatacaaaataaaaattagttgttacctcctcacagttgaccatgattctgacttctaacattacaaattagtttttactattataaacctttctataaattggattatatatcatgtattctttcatatacagcttattaccttcatcatgtccgtgagtctaatcattagtacgtgtggcagaagtttatttatttttatccagtatagaattcaattatatgattatatcacaatttatccattctgctgttgatggacttttacattgtttacagcttagggtcataataaatcatgcttctgagaacatacttgtcttggtgtacatacatgtatttctcttgtgtatatacttaggagtggaatcgctgggtcttagagcatgtgtgtattcagtcagatactggcagacaattcagaactttcaccacatgagataattgacactgaagggaaacagctataaattttatcaatatggtgctggttcaaaccagagaattcatgctgcagggaaactcaatcaatgttattgtgaaaactgggaatgtgaatgtaatatatgtagaaaaacatttagccacagcccaaatcttccaggcaaatgtaataaacgtgacattgccgttagccaaaaaaaaaaaaaaaaaa

SEQ ID NO: 1356 - DNA, 3117 bp, Homo sapiens
gcaaggggagggcagcaaggagggggggccacccactacctcgcgcccccgccctgcgggtgtctcgcgcgcgttccgtgcgtgtgagtgtgtgggtctgtctcgctccagaagtgcgtgcccgcgcgctgcgccttgcgctttttcccctccctcgccccttcctggtcctcccaccctcctcggctccctcctttcccagcaaacgccgcccctcccgcgccctggctcaggctctggcgccgccgcagccgtcgccgcccgaaagttcaggagccctggaaaggagaaggaataagacggcaggaggaagagagagagagggtagaatggaagaatctcacttcaattctaacccgtacttctggccttctatccccacagtctcaggtcagatcgagaacacaatgttcatcaacaagatgaaggatcagctgttgccagagaagggctgtggtctggccccacctcactaccccaccttgctgacagtgcctgcctcagtgtccctgccctcaggcatcagtatggacacagagtccaagtcagaccagctgaccccacacagccaagcgtccgttacccagaatatcacggtggtccctgtgccgtctacaggactgatgactgctggagtctcctgttctcagaggtggagaagagaagggagtcaatcaaggggtccgggtttggtaatcacgtccccctcaggctctcttgtgaccacagcatcatcagctcagaccttccccatttcggctcccatgattgtctcagctcttccccctggctcacaagccctgcaggttgtccctgacctctccaagaaggtagcatcgaccctaaccgaggaaggaggcggaggtggtggtggaggtggcagtgtggctcctaagccaccccggggccggaagaagaagcggatgctggaatcagggctgcccgagatgaatgacccttatgtcctctcccctgaggatgatgatgaccatcagaaagacggcaagacctacaggtgccggatgtgctcactgacattctactccaagtcggagatgcagatccactccaagtcacacaccgagaccaagccccacaagtgcccacattgctccaagaccttcgccaacagctcctacctggcccagcacatccgtatacactcaggggctaagccctacagttgtaacttctgtgagaaatccttccgccagctctcccaccttcagcagcacacccgaatccacactggtgatagaccatacaaatgtgcacacccaggctgtgagaaagccttcacacaactctccaatctgcagtcccacagacggcaacacaacaaagataaacccttcaagtgccacaactgtcatcgggcgtacacggatgcagcctcactagaggtgcacctgtctacgcacacagtgaagcatgccaaggtgtacacctgcactatctgcagtcgggcatacacatcagaaacataccttatgaaacatatgcgcaaacacaacccgcctgatcttcagcaacaggtgcaggcagcagcagcagcggcagcagtggcccaggcccaggctcaagctcaagcccaggctcaggctcaggctcaagcccaggcccaggcccaggcctcccaggcatcacagcagcagcagcagcagcagcagcagcagcagcagcagcagcaacagccaccaccacacttccagtctcctggggcagccccccagggtgggggtggtggggacagcaatcccaaccctccaccccagtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaattttcatatttgatgttttgtttatttttgtcctttttttccctctctccacccctgtcctctagccacagcatttttctttttgtcttttttttttttttttaaatcatggcagatttcagaggaaaggaaattaaaaaaaaaatcaggaaaccagttgttataaagtaatttaaaaatgaagaaaaaaagaaaaaaacttatgtacaaaccaaggggtgtttttagaacattgtatagaaataaattcatgtaaaagga

SEQ ID NO: 1357 - DNA, 2259 bp, Homo sapiens
gtaggcgcaaagctgaggaaaggagagtgtggagaggggcctggtgtggtggggcccggtgtttgggaccggagggtgttgacggctgatgagttccttgggtttgctctttcttcacctgaaaagaagactccaggaagggcagcacatgccggagaaagatgaattccagcttgaccgcccagaggcgcggcagtgacgccgagttgggaccctgggtgatggctgcgaggtccaaggacgcggcgccgtcccaacgcgacggacttttgcccgtgaaagtggaggaagactcacccggaagttgggagcccaactatcccgcggcttcgccggaccccgaaacttctcgactgcactttaggcagctgcgttaccaggaggtggctggaccggaagaggcgctgagccggctccgagaactctgtcgtcggtggctgagacccgagctgctctccaaggagcagatcctggagctgctggtgctggagcagttcctcaccatcctgcccgaggagcttcaagcctgggtgcgagagcactgcccagagagcggggaggaggcggtggccgtggtgcgggctctgcagcgagcgctcgatggaacctcatcccaggggatggtgactttcgaggacacggctgtgtctctaacctgggaggagtgggagcgcctggacccagcacggagggacttctgcagagagagtgcgcagaaggattccgggagcacagttccgccgagtttggaaagcagagtggagaacaaagagttgattccaatgcaacaaattttagaagaagcggagccacaggggcaactacaagaagcgttccaggggaagcgccccctgttttctaagtgtggcagtacccatgaggacagggtggaaaagcagtccggagaccccttgcccctgaaacttgaaaattctcctgaagcagaaggactcaacagcatctcagatgtcaataagaatggttccatagaaggggaagactctaaaaataatgaattgcagaacagtgccaggtgttccaaccttgttctatgtcagcacatcccgaaagcagagaggcccactgacagtgaggaacacgggaacaagtgcaagcaaagtttccacatggtgacgtggcacgtgctgaaacctcacaagtctgacagtggagacagtttccatcattccagcctttttgagacccagaggcagctccatgaagaaagaccttataaatgtggtaactgtgggaagagtttcaaacaacgctctgacctctttagacaccagagaatccacacaggtgagaaaccctatggctgccaagaatgtgggaaaagcttcagccagagtgctgccctgaccaagcaccagaggacacacacaggcgagaagccgtacacctgtctgaaatgtggggagcgcttcaggcagaattcacacctaaatcgtcatcaaagtacccacagtagagacaaacattttaaatgtgaggaatgcggggaaacctgtcatatttccaacctttttagacatcagagactacataaaggggaaagaccctataagtgtgaagaatgcgagaagagcttcaaacagcgctctgacctctttaaacaccacagaatccacactggggagaagccctatggatgttccgtctgtgggaaacgcttcaatcagagtgcaaccctcattaaacaccagagaattcacactggggaaaagccttacaaatgtcttgaatgtggggaaagatttagacaaagtacacaccttatccgacaccaaagaattcatcaaaataaagtgctgtcggctgggcgtggtggctcacgcctataatcccagcactttgggaggccaaggcaggcagatcatttgagatcaggagtttgaaaccagcctggccaacatggtaaaatcctgtctctactaaaaatacaaaaatgagccgggcatggtggtgcatgcctgtaagcccagctattcgggaggctgaggtaggagaatcacttgaacccaggaggcggaagttgcagtgagctgagatcatgccactgcactccagcctgggcaacagagcgagactccatctcaaaaaagaaataaagtgctgtcattttgatatgtttctatgtgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 1358 - DNA, 2788 bp, Homo sapiens
agaaccggaagttgttgcgcagctggcagttccccggtttctccccgacggcgtcgggaggagtgtccatcaggacagcttcacctccttgaggattaaagcctaacagtactgagctatttgtctgtcaaaatgtctgcaaaattgggaaagtcatcatcactcctaacacaaacttcagaggagtgtaatgggattctgacagagaagatggaagaggaagagcagacctgtgatccagactctagcctccactggagcagcagctacagcccagagaccttccgccagcaattcaggcagtttggctaccaggattcacctgggccccatgaggctctgagccggctctgggaactttgtcatctctggctgaggccggaagtgcacaccaaggagcagatcctggagctgctggtgctggagcagttcctggccatcctcccaaaagagcttcaggcctgggtgcagaagcatcatccagagaatggagaggaaactgtgactatgctggaggatgtggagagagagcttgatggaccaaagcagatcttttttggacgaaggaaggacatgattgcagagaagctagcaccttcagaaatcactgaggaattgccaagtagccagctcatgcccgtgaagaagcagctccagggagcatcatgggagcttcagtccttaagaccacatgatgaagacatcaaaactacaaatgtgaaatctgcttcaaggcaaaagacttctttaggcatagaactgcattgcaatgtttccaatatccttcatatgaatggctcccagagttccacatatagaggaacctatgaacaagatggtaggtttgaaaagagacaaggaaacccttcttggaaaaaacaacagaaatgtgatgaatgtggcaaaatctttagtcagagctcagcccttattttacatcagagaatccacagtggaaagaaaccttatgcatgtgacgagtgtgcaaaggcattcagccgaagcgcaattctgattcagcatcgacgaacccatactgattcaaaatatgaacatgcgattgcagaggcccaaaagaatatgtacttcaagactaggctgaagtgccccaggtcactttcaggaggcagataaataaaggccttatcttatgaaagcacacaagagcctccatactattaatatcaagttaatttcccgtgttggaaaaaaataatctcctttgcaatgtaatttggaaataagtcaatggaaacatgaaaatgactgcttgtctacaaggagtcagctaaacataaggaatgttttcataacaatattaatctatgggtgcttctgtaagatggatgatcatcttaatataaagaaaaaagggagatgaacaaaattgtcaaacaagactgatgtaccacaagtgttgtcaagtacagtgtgtgtcggagagatgtaccacagcttaactggaagaggaagcccgtaactgctgatgacaatactttcagtgtccccttttctggcataaatcaactatgaatatgtttcaagcatcacaagacaaccttttcagagtcttctgtattcttagtaagatgagtttctagacacgctgtcatgaaatgagaccctggattttgatgctcttgtacatatggacaaatcactgaagttcaatttaaagggtccactgcagtcccttataaacaattgttgaacctaaccattatagtttataagttttaagacatttatgggatatcttatttggcttatctatgggatatgagtaactatgttttacctgcatttaattcagccagattccctgtttaaaattactgaatcgtacattattaaaattattctgacagtatacaaacaacaaaattatctattttccagagattcttgataaaactctgtaatgttactacaataatacatgtattgtgttttccatggtgctacagttacacaatatggaggcaaacatcagaaatcaaagtccttggaataagggaagagactcatagtaaacttctttgtctggttgggttcctcataaagtataaaacatttcattctcagaaaatccaaccatatcttagagtatctccagaaactggcttagaggagctccaaatatgtggaattaccacactctgcttagttagtatgctgataaatgtaagattagtaggaggagaagtgaatgtaaattttattatagaattttctgatagtgattatgatttgtagctctagtgaatatgaattttatattgagttgtgtgtatcttgagtcactaaaaatgtaggatactttttatttggggctcattgtctttgtaattacggagaggaacaaaccatctattgaaacaacaagtgcctcagagatgtatatattgtgaattactgcttaattacggaaagagtttcttaggttctatgtgaataagatggcagaatctaaatcaagtattttgaaggaagcacccatcttcacttggtgctgccatcaactttgtaagattgcattctatttattgtgaataatttgagtgtttccacaggaaagtggtatgaatcatatcgtctaagtatatgatgaatctttaaagggtgtctctgtgtactttgaattattttgcagttatgtaggtatcctaatgagtgaatggtactagtttatataaaaggagaattcattgagctaaccttggttttaaaaattagcattagcacccccattatattaattttcagggatagtaaatactccaaaatg

SEQ ID NO: 1359 - DNA, 1494 bp, Homo sapiens
ctgcgtacgcgcacttccggtctttgtggcttgcagctcggggtgggtggctcatttcctggccgctcctgggcttcgcggaaagaagagattactcacactccttcgcaagcacagaaccagttgtactgagctttttgctaagctgtttcagccaagaatggctgtggaatctggagtgatttcaaccctgatacctcaggatcctccggaacaagaactaatactagtgaaagtagaagataacttttcctgggatgagaaatttaagcagaatgggagtactcaatcctgccaagaattgtttcgtcagcaattcagaaaattttgctaccaggagacacctgggccccgggaggctctgagccgactccaggaactttgctatcagtggctaatgccagagttgcacacaaaggagcagatcttagaactgctggtactggagcagttcctgagcattctgcctgaggagctgcagatctgggttcagcaacataatccagaaagcggcgaggaagctgtgaccctgttggaggatttagagagggagtttgatgacccagggcagcaggtcccagctagtccacagggaccagcagtgccatggaaggatttaacatgtctcagagcatcccaagagtcaacagacatccacctccagcccttaaagacacagctgaaatcctggaaaccatgcctttcccctaaaagtgattgtgagaacagtgaaacagcaacaaaagagggcatctcagaagaaaaatcacagggactccctcaggaaccttcatttcgaggaattaagttgtccagacctcccaaagcttcttcagctatccgttgggaatgtgtttctccaggaagttttcccggcgatatcatagctgctgaggctacacattcaacaatttcttgctttgccatcaacactttgccagccaccatcctgccatctaaaaatgtgaatagaaagtatttttcctgaagaacacatcgtcaataaatcacctgcacccaaatctccatctcaggcgctacttctggcaaggcatatcatgaggctagtgaagcacctacaagaaacttataactcaaggttgtaaaaatggcatggtgactcttacaatcatatcacagtgggcctctccaacaatttaaacctcatgacctaggtgaaagctgtgaaaggatccacattaattcttcagaggcagggctaagactttcaagactgaaaagagactagcataaggagacttaacaggaacccagtcaaggccattcatggccatgggaccacgcataaatggagaacgagtaaattttgctaagtccaaggacattggagagatagagtcactattactgatatggtgactgagtcaacaacatactgccactatgaagtaataagaaaataaaaagttaaaaaatgtaacagataacagttggagggtgaatatattttaaatcaatcagaaaaaaaaaaaa

SEQ ID NO: 1360 - DNA, 5508 bp, Homo sapiens
tcggtcctcagaggaggggcccgggcaccctccgtgcgggccgcagcacgccggtctttgagggacccttggactcccggatctgcatgcgagggatgcggtcgaagacgagatgagggagctgacgggaggggaaacggaggggcaggtgaacatggagagagcaggaacagggagagagtagggacagcgactgggagacgcgctccacagaaacccggactgagaggcagcgagaggacgtagtcttgctctgttgcctaggctggagtagagtggtgtgatcttggctcactgcaacctccgcctcccaggttcaagcgattctcctgcctcagcctcccaagtagttgggattacagacatctgaatgggactccgagtgccttacatccctgcagccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtgcctgtggcatttgatgatgtctccatctacttttccactccagagtgggaaaaattagaagaatggcaaaaggaactttacaagaatatcatgaagggcaactacgagtctctcatctccatggattatgctataaatcaacctgatgtcttatctcagattcaaccagaaggggaacataatacagaggaccaggcagggccagaggaaagtgagattcccacagaccccagtgaagagcctggtatttcaacatcagatattctgtcttggattaaacaagaagaagagcctcaggttggggccccaccggagtccaaggagagtgacgtgtacaaaagcacttatgctgatgaagagcttgtcatcaaagctgaaggccttgctagatcctcgttgtgccctgaggttccagtccctttctcttctccaccagcagcagcaaaggatgctttttcagatgtggctttcaaaagccagcagtctacatccatgacaccttttggacgtccagccactgacctgcctgaagcctctgagggacaagtgacttttactcagttgggtagctatcccctcccacctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatctggcacatcaatgaatttggggtcctatacacttgactagagacatgcttgtgttttggaatttcacacccttacaagaataccacattttgaaacccagaaagacctggaaaggagcccagcatgtccatcttttcaaagatacaacaaaagcagaagttacaagaatattgcggagaggttggaaagcaggatttaacctctagttctcttgttctcagagaacagcaggttgatagtagattatgtctctaggtagagacagatacatgagaagagcctccaaaactggaagcccatcataaggcatgagaatgtttaactataaagccttttattagttctttgatagctaagatggttgttggagaaagtgcttaagccactgtttatgttgctgcctcctctctcaaaaccagccaagatctgttcacacacctctgtggctgtctttccctgaaacatggtaactcaagactgcctgcctaggtttcttagattaattattcacataaattttgtttaatattggttgaacaagaaatctgactttaaaagattattaaggagaatattccttaactatactggcttgatttgaaacaggctcttattgccatttaaactgccagaaatctttgccaaggtcctggttaaaaaaattggaaacggttttcttagccccagctttaaaagctagagatctcagagaaatagctggcttaacaatgacagaacagcttaaaatttgtgcctacaccatgttctgagagtcgttcacatcaaattcttatcttttccaagccagtaagttggcttctccattcctggtgtctgatattcttgacaatcatcagcaacaaagatcacagcactttccagaagcatggagcttcagaaagtgccagtgaactcttggtcctcagtagtgagatgataacagtgttataatgcagcttccttgagccatcagagagagtgtatgttcaccctatctggctgtatcccattggcagtggacagattgaggaaattcctagatcactgagagctaagcaccatgcatagacaacagtttgttcttgcctgtgttgcttttagggactttgactaccacatgttcttttcttggggtgatttaatcacctgggagcatctgagtctgctcctaagtggctttgcaactgggcctaagttctgtttcctttatggatctcaaattttcatctgcacaatgaggctgttgaaaggaaaaaaagtgagcctctaggaattattcaaaaaaagtctgtgatacattccttttcctgccaaagttctgtctctgtctttggcttctgtccaggcaaagctaaataagacagcaaagtcaaagcagataaattcttgttgaaacttgactaaaatttatttgatttgttgttttactcccacttggaatcctgaggtagaagacagaatgcagaagtcttacatcttgggcaggaaactggtttattcctatactcttgtttcctctgcttcttcctgaggtctagaacaaggtctggaaatgtttagacaggatattttcttgatgaagtgataaggaaaggacccatttttttgctcatcacctagcccatccttcactctctctagttatgcataacaacactagaagaaggtgttagcccagctaactttgcttctgggaaggctatgtctgaacatgttgctctgtaggataatcacacttagaaaacatctgctccatgacattcacaataccagggaccatgggagacacaagaaatgtgtgtctgctgtcataacttacagtgaaaaagcccaataatacagaacaagacatgatgggcaataccctagcatattgggattaagagctttctagccagaatctggacctataccatgggaaaatttaggggtgctgggaatcccaaagccaaggttctggcttcattggcaacccactaggaacttgaatgtgagattcagctctagtttgcaccttgatttccccagtgaaaagggagaagagccaaagtattgtctaggtgctgagttcccttttctgagtggatttcaagcatttgccagggtatgctggaggagggactcctaaagtaggtgagatgtgggactaggtaacactttaaatacttttttactcaaagatttgccaagaacacagcttattagtgaaagagacctgtggattgaaatggctgcagatagatcccgcagtcccttctgaaaggaactgtgtagccagcagggacctaaactttggcaaaaagtgaacacaattcaaatacgaatgaaggaagagccctcagatggaacgaaaggcgatgtgcaaggccatcccagagagacggaagcaggtgcgatactaagcctcagcccaagaataaaagagagttcaactgttactcttttctttcatcaatcccctatcagttagaactgcaggccagttccaaagagtgtttgcttaagattcaaaagtgggtaagtaaaatggatcagtgggaaggataaggtgtccaacagaaagtgtggaggagaaactcttggcctatcaagtgctcctgagagaaaccatgcaatttaacacttcagttaaagaaatacatgagaactgcttgtcatgaccagacaagataggaaaggggaaaccccagaaacgtgctcttcatctgtcagccttttggaccaagaagctgtcactatcacacataagcaccattcccttagagtggatccaggtgttgactataaccagatttactctttgcttactaggttttccattgtcaccattggatgaacctctggtttagccacagttgtgaaaataaatggaagttggttgattgtctagaaagtgcaagaagatggccctgctccttttctgctgaacatttagtattggaaactcctacttcccttttcattaataatgtgtgcaagtttcctattagcggggaaggtgtggggctctgctgggcttctcttgagcatatctgagaagtgatgttcatgtctatctcaaccaggaccagaccctgtgacttactcggtaataacagtccacacaagcctcgttgatattaaaaaaaaaaaaaaaaaa

SEQ ID NO: 1361 - DNA, 4006 bp, Homo sapiens
gctgaatttgggtgaggaggaaggagaagcaggtaacgagtctgaccttgaactagaaaagaagtgtaaggaagatgatcgggaaaaagcctcgaaaagaccacggtcacagaaaacagagaaagtccagaagatctcaggaaaggaggccagacagctttctggggcgaagaaacccatcataagtgtggttttaactgcacacgaagcaattccaggtgctaccaagattgtgccagtggaggctgggccccctgaaacaggagctacaaattctgagaccacttcagcagacctggtgcctcggagaggctaccaggaatacgccattcagcagacaccttatgagcaaccaatgaagtcaagcaggctaggtcccactcagctcaaaatcttcacttgtgaatactgcaacaaggtcttcaagttcaagcactcgctgcaggcccacctgaggatccacaccaatgaaaagccatacaagtgcccccagtgcagctatgccagtgccatcaaggccaacctcaatgtgcacctgcgcaagcacactggagagaagttcgcctgcgactattgctcgttcacctgcctgagcaagggccacctcaaggtgcacatcgagcgagtgcacaagaagatcaagcagcactgccgcttctgcaagaagaagtactctgacgtcaagaacctcatcaagcacatccgagacgcgcatgacccacaggacaagaaggtcaaagaggccttggacgagctctgcctgatgacgagggagggcaagcggcagctgctctatgactgccacatctgtgagcgcaagttcaagaacgagctggaccgtgaccgccatatgctggtccacggagacaagtggccttttgcctgtgagctctgtggccatggggccaccaagtaccaggcgctggaactgcatgtcaggaagcaccccttcgtgtacgtctgtgccgtctgccgcaagaagttcgtcagctccatcaggctgcgcacccacatcaaagaggtgcacggggctgcccaggaggccttggtcttcaccagttccatcaaccagagcttctgcctcctggaacctggtggggacatccagcaagaagctctgggggaccagctacagctggtggaagaggagtttgccctccagggcgtgaatgcactcaaggaagaggcctgtcctggggacactcagctggaggagggccggaaggagccggaggcccctggggaaatgcctgccccagctgtgcacctggcctccccgcaggccgaaagcacagccctgccaccctgtgagctggaaaccaccgtggtctcctcctcagacctgcattctcaagaggtggtttcagatgattttttgttgaaaaatgatacctcctccgcagaggctcatgctgctcctgagaagcccccagacatgcagcacagaagctcagtccagacgcaaggtgaagtgatcacactactgctgtccaaggcccagagtgctgggtcagatcaggaaagccatggcgcccagagccccctaggggaagggcagaacatggctgtgctttcagctggtgacccagatcccagcaggtgtctcaggtcaaacccagctgaggcctcagacctcctccctccagtagctggtggtggggacaccatcacacatcagcctgactcttgcaaagctgcccctgagcaccggtcaggcatcaccgctttcatgaaggtcctgaacagtttacagaagaagcaaatgaacaccagcttgtgtgagcggatccggaaggtttatggagacctggagtgtgaatactgtggcaaacttttttggtaccaagtgcattttgatatgcatgtccgcacccacacccgggaacatctgtattattgctctcagtgtcattattcttccatcaccaaaaactgccttaaacgccacgtaattcagaaacacagtaacatcttgctgaagtgtcccaccgatggctgtgactactcaactccagataaatataagctacaggcacatcttaaagttcacacagcactggacaaaaggagttattcttgtcctgtttgtgaaaagtctttttcagaggatcgattgataaagtcacatatcaagaccaaccatcctgaggtctccatgagcaccatttctgaggttctcgggaggagggttcagctgaaagggctaattggaaagagagccatgaaatgcccatattgtgacttttatttcatgaagaatggctcagaccttcagcgtcatatttgggctcatgaaggtgtgaagcccttcaagtgttctttgtgtgagtatgcaactcgtagcaagagtaacctcaaggctcatatgaatcgtcacagcactgagaaaacccacctatgtgacatgtgtggcaagaaattcaaatcaaaagggacactgaaaagtcacaaactccttcacactgcagatgggaagcagtttaagtgcacggtgtgtgactacacagcggcccagaagccacagctgctgcggcacatggaacagcatgtctccttcaagcctttccgctgtgcccattgccattactcctgcaacatatctggctctctgaagcggcactacaacaggaagcaccctaatgaggagtatgccaacgtgggcaccggggagctggcagcggaggtgctcatccagcaaggtggtttgaagtgtcctgtttgcagctttgtatatggcaccaaatgggagttcaataggcacttgaagaacaaacatggcttgaaggtggtggaaattgatggagaccccaagtgggagacagcaacagaagctcctgaggagccctccacccagtatctccacatcacagaggccgaagaagacgttcaagggacacaggcagcggtggccgcgctccaggacctgagatacacctctgagagtggcgaccgactggaccccacggctgtgaacatcctgcagcagatcattgagctgggcgccgagacccatgacgccactgcccttgcctcggtggttgccatggcaccagggacggtgactgtggttaagcaggtcaccgaggaggagcccagctccaaccacacggtcatgatccaggagacggtccagcaagcgtccgtggagcttgccgagcagcaccacctggtggtgtcctccgacgacgtggagggcattgagacggtgactgtctacacgcagggcggggaggcctcggagttcatcgtctacgtgcaggaggccatgcagcctgtggaggagcaggctgtggagcagccggcccaggaactctagaggacatgtggcatcggatggccacagggcggggctgccaggctctgcaggcacccagggtggggaggccacccttcctgccctacccgcagaatggtgctctcctttgccctccctgcccagcagcctgataggactctcctagtccaacttggggtgggcaaggcagtcagcatcaccagcaacaccacaggaccctcaccccagcatagacacacaccccctgacccttaccatctgcttcctgaaagacttcagtgtcagctcccctacacacaccccacaccttcaccccttgcttcaagattcaaacagagactcccagtccccctcagcatcttccctgaatcacagccccagctccttgacccccatctaggtgccaaatgttcatctgcaaccgctatgcagtctggtgagagggagacagccatcacatagaaagtgaccgtacgggtttttaatcactgctgggtggggtgggggtagggggattgtcctggctttgtcgacaaagtcccacttccccgagtattaagggcccttggtatcaagtgaggtaaattcacccatcacagggtctcgccctaccatcctggaattatttcacttttaagataaatgcactatttcactgttcgcctcccattctaaggaggtgaggtggttggaataaaaacagttcctgtc

SEQ ID NO: 1362 - DNA, 8008 bp, Homo sapiens
acaggttatgagtgccagtgagccgccttagatagaagcatcgtcagcactttattaatgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaagacagaaataaacatgcttccaaacgcaggaaattagatgaggcagagccccttaaatctggaaagcaaggtatttgtagattagaaacttctgagagctcagtcacagaagggggtattgcattagatgaaacagggaaggagacctttctgagtgactgcacagttggaggcacatgtctcccaaatgccctctccccttcttgcaattttagcactattgatgttgtttctctgaaaacagacactgaaaaaacatctgctcaggaaatggtttcccttgatctggaaagagaatctcctttccccccgaaagaaattagtgttagttgtaccattgggaatgtagatacagttctcaaatgcagcatctgtgggcatttgttttcttcttgctctgacttggaaaaacatgctgagtctcacatgcagcagcctaaggaacatacctgttgtcactgcagccacaaagcagagagcagctcagcactacatatgcatatcaaacaagcacatgggccacagaaggtcttttcctgtgatctttgtggttttcagtgttcagaagaaaacttgttgaatgcacattatcttggcaaaacacatctccgtcgtcagaatctggctgctcgtggaggatttgtacagatcttaacaaaacaaccttttcctaaaaaatcacgtacaatggcaacaaaaaatgttcactcaaaaccaagaacttctaaatcaatagcaaagaatagtgattcaaaaggattacgaaatgtgggaagcacgtttaaagatttcagaggaagtatttctaaacaaagtggtagtagcagtgagcttcttgttgaaatgatgccttccagaaatactttgtcacaggaagtagagattgttgaagaacatgttacttcccttggtctagctcagaatcctgaaaaccagagtagaaagctagacaccttagtaacctcagagggtctcttagagaaattggaatctacaaaaaatacccttcaggcagcacacggtaacagtgtaacctcgaggccaagacctgagcgaaatattctcgtgttgggtaatagctttcgtcgacgaagcagcactttcaccttgaagggccaggcaaagaaaaggtttaatcttttaggaattaaaagaggtacaagtgaaactcagaggatgtatatgaaacacttgagaacacagatgaaaacacacgatgcagaatcagtgctgaaacacctggaagcgtgcagcagtgtgcagagagtgtgtgtgactacctcagaaacccaggaggcagagcagggccaggggagtgcccgtcctccggactccgggctgcattccctgacagtgaagccagcttctggctctcagacgttgtgtgcttgtacagactgtgggcaagtagctacaaataggacagatttggaaatccatgtgaaaaggtgccatgccagagagatgaaattttactgccgtacttgtgacttctctagtatgtcaagaagggacttagatgaacatttgcacagtaaccagcatcagcaaactgcttctgtcctgagttgtcagtgttgttcatttatatccttggatgaaataaatcttagagaccacatgaaggaaaagcacaatatgcattttctttgcaccccttgtaatctgttctttttgtctgaaaaagatgtggaagaacacaaagccaccgagaagcatattaattcattggttcaaccaaagactttgcaatcatctaacagtgatttggttttacagactttacctttgagtactttagaatcagaaaacgcaaaagagtctatggatgactcaggaaaagcatctcaggaagaacctctgaagtccagggtaagccatggtaatgaagtgaggcattccagtaagcctcagtttcagtgtaagaagtgtttttataaaacaagatcttctactgttctcacgagacatataaagcttcggcatggtcaagactatcattttctttgtaaagcttgtaatctttattcattgagcaaagaaggaatggagaaacacattaaaagaagcaagcatcttgaaaatgctaagaaaaataatattggcttaagctttgaagaatgtattgaaagggtatgtataggtgcaaatgataaaaaagaagagtttgatgtttccggaaatggaaggattgaaggccatataggtgtgcaattacaagagcattcctatcttgagaagggcatgctggcgtctgaggaactgtcacagtctggtggtagcaccaaagatgatgaattagcttcaaccactactccaaagagagggagacctaaaggtaacatctcacggacgtgttcacactgtggccttttggcctctagtattacaaacttgactgttcacattagacgaaaacacagtcaccagtatagttatttatgcaaagtgtgtaagtattacactgtaactaagggagatatggaacgtcattgtgccaccaagaaacataaaggacgggtagaaatagaagcaagtggaaaacacagttcagatatcattgttggccctgaagggggtagccttgaagctggtaaaaagaatgctggctcagcagtgaccatgtcagatgaacatgctaacaaaccagctgagtcacccacctccgttttagagaagccagatcgtggaaactcaattgaagctgaagttgaaaatgtatttcattctctagatggagaagttaacagccatcttcttgataaaaaggagcaaatatcttcagagccagaggacttcgcccagccgggggatgtgtactcccagagagatgttacaggcacaggtgagaataagtgtttgcactgtgagtttagtgctcactcctctgcttctctagagctgcatgtaaaacggaaacatacaaaagagtttgagttttattgcatggcatgcgattactacgcggtgactcgtcgcgagatgaccaggcatgcagcaacagagaagcacaaaatgaaaaggcagtcttatctcaactctgctaatgtagaagctggttctgcagacatgtccaaaaacatcattatgcctgaagaagagcatcaacaaaattctgaggaatttcaaataatttcaggtcaaccatctgatactcttaaatctagaaatgctgcagattgctctattttaaatgagaatactaatttagatatgtctaaagtgctctgcgctgctgactctgtagaagttgagactgaagaagaatctaatttcaatgaagaccattccttttgtgagactttccaacaggctcctgtcaaggataaagttaggaaacctgaggagatgatgtcacttactatgtcctcaaactatggctccccaagcagatttcaaaatgaaaattcaggaagctctgccttaaattgtgagacagcaaagaaaaaccatgagatatcgaatgatgcaggtgagctgcgtgtccattgtgagggtgaaggaggaaacgcaggagacggtggaggtgttgtcccccacagacacctgtgccctgtgacgctcgatggggagcgctcggctgaaagccctgtgctcgttgtgacaagaataaccagagaacagggaaatctggagagcgggggtcagaacagagttgcacgtgggcatggtttggaagacttgaaaggtgtccaagaagatcccgttctggggaataaggaaattctgatgaattcacaacatgaaacagaatttattttggaggaggatggcccagcttctgatagcacagttgaaagtagtgatgtctatgaaactataattagtattgatgataaagggcaggccatgtacagttttggtcgatttgactcctccataataagaataaagaaccctgaagatggtgagttgatagaccagtctgaagagggcttgatagcaacgggagtgagaattagtgagctgcccttgaaagactgtgctcaaggtgtgaaaaagaagaaatctgagggcagttccattggtgagtctacacgaattcgctgtgatgattgtggcttcttagcagatggactgagtggactgaatgttcacatagccatgaagcatcctacaaaagagaagcacttccattgtttactctgtggaaagtcgttctataccgaaagcaaccttcaccagcatctggctagtgccggccacatgagaaatgagcaggccagtgtggaggagcttccggagggaggggccacctttaaatgtgtcaagtgcacagagccctttgattctgaacagaatttatttttacatattaaaggacagcatgaggaattgctgcgggaggtgaataagtatatagtggaagacactgagcaaatcaaccgcgagagggaggaaaaccagggaaacgtctgcaagtattgtgggaagatgtgtcgaagcagcaactcgatggccttcctggcacacattcgcactcacacaggatcaaaaccattcaagtgcaagatatgccattttgcaacagctcagcttggagatgccagaaaccatgtgaaaaggcaccttgggatgagggaatacaagtgtcatgtctgtggggttgcttttgtaatgaagaagcacttaaatactcatctactaggcaagcatggagttggcaccccaaaagaaaggaaatttacatgccacttatgtgatagaagtttcacagagaagtgggccctgaacaaccacatgaaactccacacgggagaaaagccgtttaaatgtacctggcccacgtgccattactcattcctcacagcctccgcaatgaaagaccactacaggacgcacacaggcgagaagtcgtttctgtgtgacctctgcggctttgccggcgggacccgccacgccctcaccaagcatcgcagacagcacacaggagaaaaacctttcaagtgcgatgagtgtaactttgcctccacaactcagtcccatttgactcggcataaacgtgtccacactggagaaaagccctacagatgcccctggtgtgactacaggtcaaactgtgctgaaaatatccgcaaacacattctgcatactggcaaacatgaaggagtcaagatgtacaactgtcccaagtgtgactacgggaccaacgtcccggtggagttccggaaccatttgaaggaacagcatcctgacatcgaaaacccggacctcgcttacctgcatgctggcattgtttccaagtcgtacgagtgccgtctaaagggacaaggagccaccttcgtggagacagacagccccttcaccgcggcggccttggcagaagagcccctcgtcaaggagaagcccctcagaagcagcaggaggccagcgccgccccctgagcaggtgcagcaggtcatcatcttccagggctacgacggggagtttgccctggacccctcggtggaggagacggccgccgccacgctgcagacgctggccatggccggccaggtggcccgggtggtgcatatcacggaggatggccaggtcatcgccacgagtcagagcggggcacatgtaggcagcgtggtgcccggacccatcctccccgagcagctggctgatggagccacccaggtggtcgtcgtggggggctccatggaaggccacggcatggatgagtccctcagtccaggtggcgctgtgatacaacaggtgaccaagcaggagattttaaacctctcggaggctggagtcgctccccccgaggcatcctcagccctggatgcattgctctgtgcggtcactgaattaggggaggtggagggcagggctgggctcgaggagcaaggcaggcccggcgccaaagacgtgctgatccagctgcccgggcaggaggtctcccatgtggctgccgaccccgaggcccccgagatccagatgttcccacaggcccaggagagcccggccgccgtggaggtgctcacccaggtggtccatccctcagcagccatggcctctcaggagcgggcacaggtggccttcaagaagatggtccagggcgtcctccagtttgctgtgtgtgacacggccgcggccggccagttggtcaaggacggtgtcacccaggtggtggtgagcgaagagggtgccgtccacatggtcgccggggagggtgcccagatcatcatgcaggaggcgcagggcgagcacatggatctggtggagtccgacggggagatctcgcagatcatcgtgacggaggagctggtccaggccatggtgcaggagtccagtggcggcttctccgagggcaccacgcactacatcctgacagagctgcccccaggggtgcaggacgagccgggcctgtactcccacaccgtgctggagactgcggactcgcaggaactcctgcaggccggggccacgctaggcacagaggccggggccccaagcagggcagagcagctggccagcgtggtcatctacacccaggagggctcctcggccgcggcggcaattcagagccaaagagaaagcagcgaactccaggaagcatgagacgcgcggcacctttactcagcacagggcaggtgtgggaaggtccagcttcggtgggggaccgtgttccctgagcttcatctgaaaccttcaaaaccatgaggacaaggctcccgtgagctctgagcatgccctcccagcgagagtcacactggccaccagccaggcgcccacagagggtaccgtgggctgggcctcggggagcaggctgccaagtgcaggggagggccgggcgcaggccgcacagggagctccggtccactgggggcccttcgatcagtggcctcccgcttcgtcctggccgctgtgctgaagagaagccaagtgttgttggtgtttttctctcccaagtgttttcccatttcagttatcagaaggtcatggccgtggggaaagtggtgaagatacccctcctggcttggggtgcacctgcttgtgcagtcagcatgtagctgcctttccatttcattctctactgggctaaaaattgcagctacaagtgttaccatcttgaagcagtccacttccattcaattttttttttttaattttagaataacagtgtccccataccaaaggaagcctgctagctcatttcatgtataaatttcccatcttcaaacagtttaggtgtatttgttgctctggtcacattctgcataaaagaaatcctcttaagcctatggttaagaaaagccttgaagtttatattcagttaaaatatatgtcggtggagatagccagtgcttctaattttgacttagtttcatacagtaaagcctaaatgtgaaacgcacacgctggaagatattgttcctatcaatattttgctttttataacaagggtttgttcatattgatgccatttttgcaggatttcttcgtgatttctgtccatatgaaaatgctgacattaaacattaacacatggagaccgtgccctgtggccctgccgtggctgccagcatggtctgtgtttccttgtggattcacctgtggccctgctgtggccaccagcatggtctgtgtcctcgtggattcactgcagctgtcggatgcgagtttctgtcataatcatttgtttcctgatacaattgttcttattcttttccaaaactgtaaaataatctcctccctcaaatgcaaaggttgtttttgttctgtttctgttttctttgaaataaaattataacgttaaaagatc

SEQ ID NO: 1363 - DNA, 2441 bp, Homo sapiens
gctttcccagctagtcgaatcactggtgcacctccggaatccgaggttcgcattgctctcggacagagttctgcctccccagtactcccaaactcccagtcctgtgcaccaatgaggtccagctctgaggcttctttcctgagaaaaaaatttggaagtccgtgactgtttcctggaggagctgagaagaggaagctcacttccggcgtagggaggctttctgacccggaatggaggaggcggaggagctgctcttggaggggaagaaggcgctgcaactcgcccgcgagccgcgcctgggcctggacttaggatggaacccttccggagaaggctgtacgcagggcctcaaagacgtcccacccgagccgacccgagacatcctcgctttaaagagccttccccggggcttggcccttggcccctcactcgccaaggaacagcgcttgggggtctggtgtgtcggggaccccctgcagcccggcctgctgtgggggccgctggaagaggagtctgcctccaaggagaagggcgagggagtaaagccacggcaggaggagaacctgtcattaggcccatggggagacgtgtgtgcctgtgagcagagttctggctggactagcttggtacaacggggcaggctggagagtgagggaaatgtggccccagtgcggatcagcgagaggcttcatctgcaagtgtaccagctggtgctgccaggctctgaactgctgctgtggccccagccttcctctgagggcccaagtctcacccagcctgggctggacaaagaggcagctgtagcagtggtgacagaagtggagtctgctgtacagcaggaagtggcctcccctggggaggatgcagcagaaccttgcatagatcctggttcccagtcaccctctggcatccaggcagagaatatggtgagccctggacttaagttcccaacccaggaccgaatttccaaggatagccagccacttggcccattgcttcaggatggcgacgtggatgaggaatgcccggcccaggcacagatgccacctgaacttcagagcaattcggctacccagcaggacccagatggcagtggagccagtttctcatcttctgccaggggcacccagccgcatggctacctggccaagaagttacacagccccagtgatcagtgcccacccagagcaaagaccccagagcctggagcccagcagtctggcttccctacactctcgcggagccctcctggcccagcaggaagctccccaaagcaggggcgacggtaccggtgtggagagtgtggcaaggcattcctacagctgtgccacctaaagaagcacgcatttgtgcacacgggccacaagccctttctttgcactgagtgtggcaagagctatagctcagaggagagcttcaaagcccatatgctgggccaccgtggggtgcggcccttcccctgtccacaatgcgacaaggcctatggcacccagcgagacctcaaagagcaccaggtggtacattcaggtgcccggccctttgcttgtgaccagtgtggcaaggcctttgcccgccggccctccctgcggctgcatcgcaagacccaccaggtgccagctgcccctgccccttgcccatgccctgtgtgtgggcggcccctggccaaccagggctccctgcggaaccatatgaggctccatacaggagaaaagcctttcctgtgcccgcactgtggccgggcgtttcgtcagcggggcaacctgcgtgggcatttgcggctccacaccggggagcgtccttaccgctgcccacactgtgccgatgccttcccccagctgcctgaactgcggcgccatctcatctcacacaccggggaggcccacttgtgcccggtgtgtggcaaggccctccgagacccacacacgctccgagctcacgagcgtctgcactccggagagaggccctttccctgtccccagtgtggccgtgcttacacgctggccaccaagctgcggcgccacctcaaatctcacttggaggacaagccctaccgctgccccacctgtggcatgggctacaccctcccgcagagcctcaggcggcatcagctcagtcaccggcctgaggcaccctgcagcccaccctctgtgccttctgctgcttctgagcccactgtggtgctcctgcaggctgagccacaactgctggacacacacagagaggaggaagtctcccccgccagggatgttgttgaggtcaccatttcagaaagccaggagaagtgctttgtggtgccagaggagccagatgccgcccccagcctggtgctaatccataaggacatgggcctcggcgcctgggcagaggtggtggaggtggagatgggcacctgacagctttgccttttgctgacacagctccataaagactcgtgctttctc

SEQ ID NO: 1364 - DNA, 5428 bp, Homo sapiens
ggagcgagcgagtgcccagggtgaatcaatggaaaccccctcacgaagccggggaaacacttcagccgcagccaaatagcattgattattttccttcacttccctcaccgccgtgaatttatttatttatttttttccgtctccgtccctgacgccccggagcgagcgctggagggagggaggaggaggggaaaaaagaggaatcaacacatcggagaagtcccttccaagagccgccccctcccctccccgcctcgcgctgctcggtggccgcggttcgactcccgtccctgcttccagctgaggtggtactggctgtcacgctgacatgagcccccagcactcctccgtctaccatggccacccttaactcagcctctaccactggtaccaccccctcccctgggcacaatgccccgtccctgccttcggacaccttctcctccagcaccccctctgatcctgtcaccaaagatccccctgctgcctcctccacctctgagaacatgaggtcctcagagccagggggacagctcctggagtcgggctgtggcctcgtcccaccaaaggagattggggagccccaggaagggcctgactgtggtcacttcccaccaaatgacccaggggtggaaaaggacaaggagcaggaggaggaagaagaagggctccctcccatggacctaagcaaccacttattcttcacagctggaggtgaggcctacctagtggccaagctgtccctgccaggtggcagtgaactcctgttaccaaagggcttcccctggggtgaggcgggcatcaaggaagagcccagtctgcccttccttgcctacccacccccctcacacctcactgcccttcacatccaacatggctttgacccaatccaaggctttagctcttctgaccaaattctgtcccatgatacctcagcaccatctccggctgcctgtgaggaaaggcatggagctttctggagctaccagctggctccaaatccacccggagatcccaaagatggccccatggggaacagcgggggcaaccacgtggcggtcttctggctctgccttctgtgccgcctgggtttcagcaagccccaggcctttatggatcacacacagtctcatggggtgaagctaacccctgcccaatatcagggcctgtcaggtagcccagctgtactccaggagggagatgaaggctgcaaggccctcataagctttctggagccaaaactccctgctcgcccctcttctgacataccccttgacaacagcagcacagtgaacatggaggcgaatgtggcccagacagaggatggcccccctgaggcagaagtccaggcccttatcctcctggatgaagaagttatggccctcagcccaccctctccacccacagccacctgggaccccagcccaacccaagccaaagaatcgccagtagcagcaggcgaggcagggccagattggttccctgaggggcaagaagaggatggagggctctgccccccactcaaccaaagctcacccacctccaaggaggggggcactctccctgccccagtgggctcccccgaagaccccagtgacccaccccagccctatcgcctagctgatgactacaccccagcccctgcagccttccagggcctcagcctgtccagccacatgtccctgctccactcacgcaactcctgcaagacactcaagtgtcccaagtgcaactggcactacaagtaccagcagaccctggatgtgcacatgcaagagaagcaccctgagagcaacagtcactgcagctactgcagtgctgggggcgcccacccccgccttgctcgtggagagagctacaactgtggctacaaaccctaccgctgtgacgtctgcaactactctacaaccaccaaaggcaacctcagcatccatatgcagtctgacaagcacctggccaacctacagggcttccaggcgggccctggtgggcagggaagtccaacagaggcatcactcccaccctccgcgggagacaaagagcctaagaccaaatcatcctggcagtgcaaggtgtgcagctacgagacaaacatctcccgtaacctgcgcatccatatgacctctgagaagcacatgcagaatgtcctaatgctgcaccaggggctgccgctgggcctgccacctggattgatggggccaggccctcctcccccaccaggggctacccccactagcccccctgaactcttccagtactttgggccccaggccctagggcagcctcagactcccttggctggcccggggctgaggccagacaagcccctggaagcccagctacttctcaatggtttccaccacgtaggagcacctgcccgcaagttccccacatccgcccctggaagcctatcccctgatgcccacctgcctccaagtcagctcctgggttcctcatctgacagcctgcccacctcaccacccccagacgacagcctgtccctgaaggtgttccgctgcctagtgtgccaggccttcagcacagacagcctggagctgctgctctaccactgcagcataggccggagcctcccggaagctgaatggaaggaggtggctggtgacacccaccgctgcaagctttgctgctatggcacccagctcaaggccaacttccaactccacctcaagactgacaaacatgctcagaagtaccagctggcagcccacctgcgggaggggggtggagccatgggcaccccttccccagcatccctgggagatggggctccttatgggtctgtctccccactacacctgcgctgcaacatctgtgactttgagtccaacagcaaggagaagatgcagctgcatgccaggggtgcagcccacgaagaaaacagccaaatctataaaaggacagaaactggactcttaataaaatgatctcttaggccctaccagttctaatactgtaattttccctctatcttctgtgtgggtgtttctttttgttggcttttcatactctcctacctgctgattgagccatccattttctccttcattgactggctgcttgtcctgcttcctctgtcctatgtcctcccttccctgatgccacacctctttaagctgactctccccccatcctacacagggaaggctcctgtcacccccttagctgagccacccacccctgagaaagatgcccagaacaagacagaacaattgggtgagttttccctcccttccccccagtcctcctaccttctgagacgctcacgggaccttgcagtaatccaggagcccagcaatgtctgtgctcaaggagcaaaactgattaaagaaagggctcatcagggggaagggaggctgagccacgagaggctaggcacttccgccctctttgagaactcagacctgaccatcctactgacccggagtcagcccttgccaagcctcacctatctactgagtttcctgccctttctctagtgcccaactccctaccctggaagctctctgctacaaatcatcttgagggctgtcagggttccttaatctcctcttctttcatcctcagcttcagaagagacagaaaacaagactggcccttccagagacagtgccaaccagaccacggtcagaattggggtaactgggaagagctgaagtgggggcctggctttactgagatctgctcatattctaaaggcagacgtaattttgtcatgctttgacttatttcactcagaatagcacagttaagaaattccacccagatccagttccacatgttcagcactttcgggggcagagctggcccagcagggtcaagcacagagggagatgataggagggagacagcaggaacttgagggaaagatgaataaaggaattgtgctgagagtaggaaagagtgggggtacatgctggaaggaggggaggagaaaggcaaaagcaaacaaccagctactgcccagctctttatcccttagttaggagcagaaagacaagacaccggtgttcctaccctacaaaacgccctgagcctggatggaactgtcctggcatcctcttactaagggtaggggcaccaaccaaatgattcacactgacagcatgtgccacaaatctctaaatccccaggactcagacctaggcagcacccaggaatggcagctctgtgttctgaggggattcccagcctctggtttgagatgccatcctgtgcctcacagctctccaaactggactacaatatgtaacatttattgttattgcaatacgcagtgttactgcattactgcaagctgaagtaatgccttatgtcctcagcatcttttcttcctaactcctgctcccgccaacagacctcttccagatgtctgctccaggggctaggtgcgttaagatgagcatctggatccccttcctttacagtcatcccctccctgacacacaggcctgtgccactggtgccagcctggatgcaggctgggtaggtctggcagtcaggtgatggtggggcctctggcagcctcacccctctggaagtgtggctgagaatgtgctgagagggctgggccagaattttcctgggccactgggggagctgtggtgtttattcacattaggaaaaagaagaaggaaaaagaaagatggaaaataaggtgggagctgctgagcctgagggaggatgagctggcttctgagcagacaggtagggcccctttccaggtgatggttcacagaggcagagtgggcagggacaagggagcctctgggtccagaaaatgcccagaggaaatggaaccatttcacagagaagacacgacaggataggataggtaagagaagaaaactaaatccaaggtgggggcagtaggtacagagccatctgttagctggagagttgaggcaggcagcaaagactgggaaagacacaccaagaaaaggcagagaggccaggatggtggaagagggccagacaaagaaggagtgcaaggtagcggcctaagctaggcctttgtcccaatccaagggaaagtggggaggagccagctctcaggactgtggctggaggctgggtctgctataatgccttcctatctggctagttcctcttcaattaggagtgagaggccaagcgtggtggctcacgcctgtaatcccagcactttgggaagccaagatgagtagatcacctggcatcaggagttcaagaccaacctggccaatgtggcaaaaccctgtctccactaaaaaatacaaaaattagctgggcgtggttgcacacgcctgtaatcccagctgcttgggaggctgagggcaggagaattgcttgaacctggaaggcggaggttgcagtgagccgagatcacgtcactgcactccggcctgggtgacagagccagactccatct

SEQ ID NO: 1365 - DNA, 1629 bp, Homo sapiens
acaggagcaaattcctgtgaacatgaccactatgaaaaacatctcagccacaaacaagctcccacccaccatcagaaaattcatcctgaggagaagctttatgtgtgtactgaatgtgtaatgggcttcactcagaagtcacatctgtttgagcatcagagaattcatgctggagaaaagtcccgtgaatgtgacaaaagcaacaaagtcttcccccagaaaccccaggttgatgtacatccaagtgtttatacaggagaaaaaccctatctgtgtactcaatgtgggaaagtctttaccctcaaatcaaacctcattacacatcaaaaaattcataccgggcagaaaccctacaaatgcagtgaatgtggaaaagcctttttccagagatcagacctctttagacatctgagaattcatacaggagaaaaaccttatgaatgcagtgaatgtggaaaaggcttctcccagaactcagacctcagtatacatcagaaaactcataccggagagaaacactatgaatgcaatgaatgtgggaaggctttcacaagaaaatcagcactcaggatgcatcagagaatccacacgggagagaaaccttatgtatgcgctgactgtgggaaggccttcatccagaaatcacatttcaacacacatcagagaattcatactggagaaaagccgtatgaatgcagtgactgtgggaaatccttcactaagaagtcacaactccatgtgcatcaaagaattcacaccggagagaaaccctatatatgtacagaatgtggaaaggtcttcactcacaggacaaacctcaccacacatcagaaaactcatactggggaaaaaccctatatgtgtgctgaatgtggaaaggcttttactgaccagtcaaatctcattaaacaccagaaaactcacactggagagaaaccctataagtgcaatggctgtggaaaagccttcatatggaagtcgcgcctcaaaatacatcagaaatctcatattggagagagacactatgaatgcaaggactgcgggaaagccttcatccagaaatcaacactaagcgtgcatcagagaatccatacaggagagaaaccgtacgtttgtcctgaatgcgggaaggcctttatccagaaatcgcacttcattgcgcatcatagaatccatactggagagaagccttatgaatgcagcgactgtgggaaatgcttcactaagaagtcacaactccgtgtgcatcagaaaatccacacaggtgagaagcccaatatatgtgctgaatgtggaaaggccttcactgaccgatcaaatctcataacacatcagaaaatccacactagggagaaaccctatgaatgtggtgactgcgggaaaaccttcacctggaagtcacgcctcaatatacatcagaagtctcatactggagaaagacactatgaatgtagtaaatgtgggaaagctttcatccagaaagccacactaagtatgcatcagataattcatacaggaaagaaaccttatgcttgtacagaatgtcagaaggcctttactgacagatcgaatctcattaaacaccagaaaatgcatagtggagaaaaacgctataaagccagtgactga

SEQ ID NO: 1366 - DNA, 2620 bp, Homo sapiens
gcgcacgtacacacgaagggcctgctgactacatctgccggaaagcatcgggccaagcctttctccattttgcggtctaggaagtagcagaggccccttcctgtagggagttgccatggagacgcggtggggcaccgacggagttctaatgacggccgtgattggtgcaggatcctgctaatctcaggaaggcccgtagagaagggcagacactggcctcagatacctgacctggtaccctctatgaggcctgcggtgctgggctccccagaccgagcacccccagaagatgaggggcctgtcatggtgaagctagaggactctgaggaggagggtgaggctgccttatgggacccaggccctgaagctgcacgcctgcgtttccggtgcttccgctatgaggaggccacagggccccaagaggccctggcccagctccgagagctgtgtcgccagtggctgcgtccagaggtacgctccaaggagcagatgctggagctgttggtgctggagcagttcctgggcgcactgccccctgagatccaggcccgtgtgcaggggcagcggccaggcagccccgaggaggctgctgccctagtagatgggctgcgccgggagccgggcggaccccggagatgggtcacagtccaggtgcagggccaggaggtcctatcagagaagatggagccctccagtttccagcccctacctgaaactgagcctccaactccagagcctgggcccaagacacctcctaggactatgcaggaatcaccactgggcctgcaggtgaaagaggagtcagaggttacagaggactcagatttcctggagtctgggcctctagctgccacccaggagtctgtacccaccctcctgcctgaggaggcccagagatgtgggaccgtgctggaccagatctttccccacagcaagactgggcctgagggtccctcatggagggagcaccccagggccctgtggcatgaggaagctgggggcatcttctccccagggttcgcgctgcagctaggcagcatctccgcaggtccaggtagtgtaagccctcacctccacgtcccctgggacctcggcatggctggcctttctggccagatccaatcaccctcccgcgaaggtggctttgcgcatgcgcttctgctccccagcgatctgaggagtgaacaggaccccacggacgaggatccctgccggggtgtgggccctgctctgatcaccacccgctggcgctcccccaggggccggagccggggccgccccagcactgggggcggggtggttaggggcggccgttgcgatgtatgtggcaaggtgttcagccaacgcagcaacctgctgaggcaccagaagatccacacgggtgagcgaccattcgtgtgcagcgagtgcggccgcagcttcagccgcagctcgcacctgctgcgccaccagcttacgcacaccgaggagcggccgttcgtgtgcggcgactgtggccagggcttcgtgcgcagcgcgcgcctggaagagcatcggagagtgcacacgggcgaacagcctttccgttgcgctgagtgcggccagagcttccggcagcgctccaatctgctgcagcaccagcgcatccacggcgatcccccgggccctggcgctaagcccccggcccctcctggtgcgcccgagcctcccggcccctttccgtgcagcgagtgccgcgagagcttcgcgcggcgcgccgtgctgctggagcaccaggcggtacacacgggcgacaagtcctttggctgcgtcgagtgcggcgagcgcttcggccgccgctcagtgctgctgcagcaccggcgcgtgcacagtggcgagcggcccttcgcctgtgccgagtgcggccagagcttccggcagcgctccaacctgacgcagcaccggcgcatccacaccggggagcggcccttcgcctgcgccgagtgtggcaaggccttccgccagcggcctacgctcacgcagcatctccgcgtacacacgggcgagaaaccctttgcctgccccgagtgtggccagcgcttcagccagcgcctcaagctcacgcgtcatcagaggacacacaccggcgaaaagccctaccactgcggtgagtgcggcctgggcttcacgcaggtctcgcggctcaccgagcaccagcgcatccacacgggcgaacggcccttcgcctgccccgagtgcggccagagctttcggcagcacgccaacctcacccagcaccggcgcatccacacgggtgaacggccctacgcatgccctgagtgtggcaaggccttccgccagcggcccacgctcacgcagcatctgcgcacccaccgacgagagaagcccttcgcctgccaggactgtggccgccgcttccaccagagcaccaagctcattcagcaccagcgcgtccacagcgccgagtagctccagccgggacgcactgtgtccgccatggtcagaacacctacctcccctggttattgtgaggctggcgattacataagtataagcaggtccgcccagggcttggctactgtaggtgtccaataaacagtagatggaaactgggtctccacccaaaaaaaaaaaaaaaaaa

SEQ ID NO: 1367 - DNA, 2320 bp, Homo sapiens
gtgagcgcctgagagtctttttgcctttcagagttaaggcctcactggcctgggaaaataattgctgccttttgcatccgcgttggctccgtccccaggatcttcccggttcagggacctggcgatttctgagtgttccggaatcccaataaccctgtttaaagaggaatggagattgccactgtccatttagattaatgaggtgtcctgaagtgatggtgacatcaatgaaaggagggttctgacacgttctcacctcgcgggatggcagctgctgatttgtcccatggacattatctttctggggacccagtttgccttcatgaagaaaagacaccagcaggaagaatagtggctgactgcctaacagattgttatcaggattcagtgacctttgacgatgtggctgtggacttcacccaggaggagtggactttactggactcaactcagagaagcctctacagtgacgtgatgctggagaactacaagaacctggccacagtaggaggtcagatcatcaaacccagtctaatctcttggttggaacaagaagagtcaaggacagttcagggaggagttctccaaggatgggaaatgcgacttgaaacccagtggtctatacttcagcaggactttttgaggggtcagacatccattgggatacaattggaaggaaaacacaatggaagggaactctgtgactgtgagcaatgtggagaagtcttcagtgaacactcatgccttaagacgcacgtgagaactcaaagtacagggaacactcatgactgtaatcagtatggaaaagatttccttaccctgtgtgagaaaacctctactggtgagaaactttctgagtttaatcagagtgaaaaaatcttcagcctgacaccaaatattgtataccagagaactagcacacaagaaaagtcatttgaatgtagtcactgtggaaaatccttcattaatgagtcataccttcaggcacatatgagaactcacaatggagaaaaactctacgaatggaggaattatgggccaggttttattgactctacaagcctttctgtgcttatagaaaccctcaatgcaaaaaagccctacaaatgtaaggaatgtggaaaaggctatagatacccagcctacctcagtattcacatgcgaacccacactggggagaaaccatatgaatgtaaggaatgtgggaaagccttcaattattccaactcatttcagatacatggaagaactcacactggagagaaaccctatgtatgtaaggaatgtgggaaagccttcactcagtactcgggccttagtatgcatgtacgatctcacagtggagacaagccctatgaatgtaaggaatgtgggaaatccttccttacatcctcacgccttattcaacatataagaactcacactggagagaagccttttgtatgtgttgaatgtgggaaagcctttgcagtttcctcaaatcttagtggacatttgagaactcacactgaagagaaggcctgtgagtgtaagatatgtgggaaagtatttgggtatccctcatgtcttaataatcacatgcgaacgcacagtgcccagaaaccatacacctgtaaggaatgtgggaaggcttttaactattccacccaccttaaaattcacatgcgaatccacactggagaaaaaccctatgagtgtaaacaatgtggaaaggccttcagtcattccagttcatttcaaatacatgaaaggactcacactggagagaaaccctatgaatgcaaggagtgtgggaaagccttcacgtgttccagttcctttagaattcatgaaaaaactcacacagaagagaaaccctataaatgtcagcaatgcgggaaagcttacagtcatccccgttcacttcgaagacatgaacaaattcactagtgagaaactgtccatgtaataaatgtgggaaagctctcatttgttccagttcactttaaagacatgaatgaactcactctggagagaagaagctgcatgaaaattacttaattcctgtaatcccagcattttgagaggctgaggtgggtggatcacttgaggtcaggagtttgagaccaccctggccaacatggtgaaaccttgtctctactgaaaatacaaaaaatttagccaggtgtggtgggcacctgtaatcccagctacttgggaggctgaggcaagtgaatcacttgaacccaggaagcagaggttgcagtgagcagagatcatgccactgcactccagcctgggcgatggagtgagactccatctcaaaaaaaaaaaaaaaaaa

SEQ ID NO: 1368 - DNA, 5225 bp, Homo sapiens
ttggagctctgcgtctcgtcttcgttcttctgtgtcctctgctgctagaggtccagcctctgtggctctgtgacctgcgggtattgggggatccacagctaagacgccaggaccccccggaagcctagaaatgggaccattgacatttatggatgtggccatagaattctgtctggaggagtggcaatgcctggacattgcacagcagaatttatataggaatgtgatgttagagaactacagaaacctggtcttcctgggtattgctgtctctaagccagacctgatcacctgtctggagcaagaaaaagagccttgggagcctatgaggagacatgaaatggtagccaaacccccagttatgtgttctcattttacccaagacttttggccagagcagcatataaaagatcctttccaaaaagcgacactgagaagatataaaaactgtgaacataaaaatgtacatttaaaaaaagaccataaaagtgtggatgagtgtaaggtgcacagaggaggttataatggatttaaccaatgtttgccagctacccagagcaaaatatttctatttgataaatgtgtgaaagcctttcataaattttcaaattcaaacagacataagataagccatactgaaaaaaaacttttcaaatgcaaagaatgtggcaaatcattttgcatgcttccacatctagctcaacataaaataattcataccagagtgaatttctgcaaatgtgaaaaatgtggaaaagcttttaactgcccttcaatcatcactaaacataagagaattaatactggagagaaaccctacacatgtgaagaatgtggcaaagtctttaattggtcctcacgccttactacacataaaaaaaattatactagatacaaactctacaaatgtgaagaatgtggcaaagcttttaacaagtcctcaatccttactacccataagataattcgcactggagagaaattctacaaatgtaaagaatgtgccaaagcttttaaccaatcctcaaaccttactgaacataagaaaattcatcctggagagaaaccttacaaatgtgaagaatgtggcaaagcctttaactggccctcaactcttactaaacataagagaattcatactggagagaaaccctacacatgtgaagaatgtggcaaagcctttaaccagttctcaaaccttactacacataagagaatccatactgcagagaaattctataaatgtacagaatgtggtgaagcttttagccggtcctcaaaccttactaaacataagaaaattcatactgaaaagaaaccctacaaatgtgaagaatgtggcaaagcttttaagtggtcctcaaagcttactgaacataagttaactcatactggagagaaaccctacaaatgtgaagaatgtggcaaagcctttaactggccctcaacccttactaaacataacagaattcatactggagagaaaccctacaaatgtgaagtatgtggcaaagcctttaaccagttctcaaaccttactacacataagagaattcatactgcagaaaaaccgtacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccctacaaatgtgaagaatgtggcaaagcttttaaccatttctcaatccttaccaaacataagaggattcatactggagagaaaccctacaagtgtgaagaatgtggcaaagcttttacccaatcctcaaaccttactacacataagaaaattcatactggagagaaattctacaaatgtgaagaatgtggcaaagcttttacccaatcttcaaaccttactacacataaaaaaattcatactggaggaaaaccctacaaatgtgaagaatgtggcaaagcttttaaccagttctcaactcttactaaacataagataattcacactgaggagaaaccctacaaatgtgaagaatgtggcaaagcctttaagtggtcctcaacccttactaaacataagataattcatactggagagaaaccctacaaatgtgaagaatgtggcaaagcttttaaactgtcctcaaccctttctacacataagattattcatactggagagaaaccctacaaatgtgaaaaatgtggcaaagcttttaaccgatcctcaaaccttattgaacataagaaaattcatactggagagcaaccctacaaatgtgaagaatgtggcaaagcatttaactattcctcacaccttaatacacataagagaattcatactaaagagcaaccctacaaatgtaaagaatgtggcaaagctttcaaccaatattcaaaccttactacacataacaaaattcatactggagagaaactctacaaacctgaagatgtgacagtgattttgacaacacctcaaactttttcaaacataaaataaattatactggtgagaaattctagaaatgtaaagaatgtgataaaggctttacatggttgtcacacttgattgtaggtaagataatttacattggagtaaacttctacaagtgtgaagaatgtggcaaaacttttaattaatgctcgtaccttattgcacaggaaagaatttttacttggaaaaaggtatatacacaaagaatgtggaaaagccattaatatgtgctcatatcttactcaacatcagagagtctgtacttaataaaaccattatagatgcaactagtgtcaaaagatctttcagaaaataaaagcctttaaagtgaagaagataattcattctgaagacaaacattacaaatattaagagggttgtagtaccattacttgcatcacagatcttattgtacacattttgtactaaagaaaaccctgaagcagttgctcaaatactgttcaacatcagaaaatttatattggaaaaaacccctggaaaatgtaataaatttgtaaaaacagttttgaaaaactacagcttataaaacatgagggtctataatgcttggttgatagtacaaagtttattcaacatcagggaatttatattggagaaaaaccctacaaatgtaatcagtttggaaaaacatttttaaaaaaaccacagcatagaaaacaccacagggttcatactaaaatatgtttttgcagatgcagtaaaaatgaaaaaaatttaatccgaaattaagtttatgtaaatatctgagaattcacagtagaaatatctaaggcgcggacacttcagacattacactaaatcagtgctaagtacagaaaacaacacaaaataaaacttggtggataaattatttgtatataacattaaaagaagtagaagattttcagttataattacaattaaagtatacttttatcttgaaaaaattactgatttttaaattagtgaataatgatgtaattaaactctcaaataactttatgctcttttttcattcctgctatattcacatgtgaaagcatgtgaccaattgttgctgcaccaaagatatgagagattcttttattaggtgggcattatttaaaacattttttatggaacagtaaggatattaaagtgtaagatgcagccaggcatggtggctcatgcctataatcccagcactttgggaggctgaggccggtggatcacctgaggtcaggagtttgagaccagcctgaccaacatggtgaaaccctgtctttactaaaaatacaaaaatttaccaggcacctataatcccagctacttcaaaggctgaagcaggagaatcacttgaacctggaaagtggaggtctcagtgagccgaaatcataccattgcactccaacctgggcaacaaaagtcaaactccatctcaaaaagaaaaaaaaaaaaaaaaaagatgcgtgatgaaaatgtaactggagaggctctttgtggttaacttataaaggagtgatgcaggagataggttttcagagtaatattcttctgcattatagtgacaaaagttttttattttagttaaaattggttaaattagtaagtcattttacttattgtaattttatgtaattaaatgtacatttttaaatttttagattacatgtaaatataacttttaaaaaaatgtgttaagaccattgtacattcaatgaagcattattatgcttctaactttaacctatttcaccttactcaagagtgtatgtaaaagatggtaacaatatactatttggtaacataatggactaacatttctattaatctatttcaccagtggctttcaactgcaaataagttaaagaatatttttctataggttaaatattcttttttgtcttatttaaacttactgttcttaatttctgtgggtacatagtatgattttaattaccttattttattctttgtgctattcataattttttttgtttgtttggtttttttttttgagacagagtcttgctctcgcccaggctggagtgcagtggcgcgatcttggctcactgcaagctccgcctcccaggttcactccattctcctgcctcagcctcccaagtagctgggaccacaggcgcccactacttgtttgggtttttttttggagatggagtctcgctctgtcacccaggctggagtacagtggcatgatcttggctcactgcaacccccacctccccggttcaagtgattctcctgcctcagcctcccgaatagctgggattacaggcgtccaccatcacaccaggctaatttttgtatttttagtagagatggagtttcaccatgttggccaggatggtctcgatcttctgacctcatgatctgcctgcctcggcctcccagagttctgggaccacaggcatgagccactgcacctggccaaatgtgtatatatttatgcaatatataacatgttttgatacaggcatataatatgtattagtcacatcaggataaagtatctattaccttcagcatttatcctttgtattacaagccaattctacacttcattattttaatgtacaattaaattgttattgactacagggtcattttaattataaaaattatatagaagtataaataaagtccatacattcctgagtcatgaaaaaaaaaa

SEQ ID NO: 1369 - DNA, 3861 bp, Homo sapiens
tttgtctctcgccgcagcctgagctccaggtctccccttcgctgctctgtgtcctctgctcctagaggcccaacatctgtggccctgtgacctgcaggtattgggagacccacagctaagacaccgggaccccctgaaagcctagaaatggacgacttgaaatatggagtgtatcctctcaaggaagcaagtggatgccctggggctgagaggaatcttctagtttactcttattttgaaaaggagacattgacatttagggatgtggccatagaattctctctggaggagtgggaatgcctgaaccctgctcagcagaatttatatatgaatgtgatgttagaaaactacaaaaacctggtcttcttgggtgttgctgtctctaagcaagacccagtcacctgtctggagcaagaaaaagagccctggaatatgaagagacatgagatggtggatgaacccccagctatgtgttcttattttaccaaagacctttggccagagcaagacataaaagattcttttcaacaagtaatactgagaagatatggcaaatgtgaacatgagaatttacagttaagaaaaggctccgcaagtgtagatgagtataaggtgcacaaagaaggttataatgagctaaaccagtgtttgacaactacccagagcaaaatatttccatgtgataaatatgtgaaagtctttcataaatttttaaatgcaaatagacataagacaagacatactggaaagaaacctttcaaatgtaaaaaatgtggcaaatcattttgcatgcttttacacctaagtcaacataaaagaattcatattagagagaattcttaccaatgtgaagaatgtggcaaagcttttaaatggttctcaacccttactagacacaagagaattcatactggagagaaacccttcaaatgtgaagaatgtggcaaagcttttaagcagtcctcaacccttactacacataagataattcatactggggagaaaccatatagatgtgaagaatgtggcaaagccttcaaccggtcctcacaccttactacacataagataattcatactggagagaagccctacaaatgtgaagaatgtggcaaagcttttaaccagtcttcaacccttagtacacataagttcattcatgctggagagaaaccctacaaatgtgaggaatgtgacaaagcttttaatcgattctcataccttactaaacataagataattcatactggagaaaaatcttacaaatgtgaagaatgtggcaaaggctttaattggtcctcaacccttactaaacataaaagaattcatactggagagaaaccctacaaatgtgaagtgtgtggcaaagcctttaatgagtcctcaaaccttactacacataagatgattcatactggagagaaaccctacaaatgtgaagaatgtggcaaagcttttaaccggtccccacaacttactgcacataagataattcatactggagagaaaccttacaaatgtgaagaatgtggcaaagcttttagccagtcatcaatccttactacacataagagaattcacactggagagaaaccctacaaatgtgaagaatgtggcaaagcttttaaccgatcctcaaatcttactaaacataagataattcatacaggagagaaatcttacaaatgtgaagaatgtggtaaagcctttaaccaatcctcaactcttactaaacataggaaaattcatactagacagaaaccctacaactgtgaagaatgtgacaatacatttaaccagtcctcaaaccttattaaacaaaataattcatactggagagaaactctacaaatgtcaagaatgtgggaaagcctttaagcagtcctcaactcttactaagcattaaatattggccgggtgcggtggcttatgcaaaatggctcccagcattttgggaggctgaggtgggtggatcacaaggtcaagagatcgagaccatcctggccaacatggtgaaaccctgtctctactaaaaatacaaaaattatctgggtgtggtggcacgtgcctgtattcccatctactcgggaggcttaggcaggataatcacttgaacctgggaggtggaagttgcagtgagccaagattgtaccactgcactccagtttggcaacagagtgagactccgtctcaaaaaaaatttatactgtacaaaaaccccacaagtgtgaaaaacatggcaaagcctttaagaagccctcaattcttaacagacataagataatttatactggagagaaactctacaaatcagaaagatgtgactacttttgacaacgcctcaaacttttctaaccataaaagtaattatactggtgagaaatcctagaaatctgaagagtgagataaagcctttaaatggttgtcacacttcattgtaggtaagataattcatactggagaaaacgcctacatgtgtgaacaatatggcaaaacttaatgctcacactttattgctaggaaagcatttatacttgagataaattatacaaatataaagactgtgaaaaagccatcattatctgctcacattttactcaacacagagagttcctgcttaataaaagcattataagtgcaattactgtcaaaagatctttcagaaaatataagcttttttagtgaagagtatttattttgaagttgaacatcacaaatataaaaagggttgtagtgcctttacttgtatcacagatctttttgtagacattttcttctagaggaaaactctgaagcagttgatcaaactttgttcaacatcagggaatttatattgaaaaattgtgcaaatataataaatttggaaaaacaatttttcaaaaactacagcttagaaatcaacagttatactagaatatattttttccagatgcagtaaaagtaaaatatttaatccataattaagtctatgcaaatatcagagaatttatggtagaaatatataaggtactgacacttcagatatactaaatcagagtgctaagtatagaaaatctgaaactaaagttggtagaaaagttatttgtatagaactttaagaggatcagaaggttttttgcagagttataattacattcaaagtatactttatttcttgaaaaatattacagattttttgaaaattgaataatgtcatcattcaactctgaaattatttcctgttgtttcttcattcctattggattcacatgtgaaagcatggggttaattgttgctacatcaaagagagagattcttttgtttgtttgttcgtttgttttttgagactgagtttcactctttcgcccaggctggagtgcattggcatgatctcagctcactacaacctctgccttctggtttcaagcaactcttctgcctcagcatcccaagtagctgggataacaggtgccagccaccatgcccagctaatttgtgtatttctagtagagatggggtttcaccatattggccaagctggtcttgaactcctgacctcatgtgatccgcccgcctcagcctcccaaagtgctgggattacaggcttgagccaccacgcccagcctgtagcatattttaataggagaatacaatatataatagtagcagggttaagtaaggcatccatcatctgtagcatttctcctttgttttacaaacaatccaattctacactttaaaaaaaaatttttaaatgtacaattaaatttttatttaccacagtgttatttttatcgtcataataaaaattatatacgagtataaatgaaattcatttctaaattcttaataaatattttctcatgcaaaaaaaaaaaaaaa

SEQ ID NO: 1370 - DNA, 2280 bp, Homo sapiens
gtccatcggggagggcgaaggccctgctctcctcggttcccggctccaggcggcgagctgaggttgggagcctggctttcccctccgagagggttcaggtgcctctgccatagcttctgtcgcctgtgctgtgacccgcactggtcgtgggagtcacctgaaaggcaagaaatgatgtttcaggattcagtggcctttgaggatgtggctgtgaccttcacccaagaggagtgggctttgctggatccttcccagaaaaatctctgtagagatgtgatgcaagaaaccttcaggaacctggcctctatagggaaaaaatggaaaccccagaacatatatgtagagtacgaaaatctaaggagaaacctaagaattgtgggagagagactctttgaaagtaaagaaggtcatcagcatggagaaattttgacccaggttccagatgacatgctgaagaaaacaactactggagtaaaatcatgcgaaagcagtgtgtatggagaagtaggcagtgctcattcatctcttaataggcacatcagagatgacactggacacaaggcatatgagtatcaagaatatggacagaaaccatataaatgtaaatactgtaaaaaacctttcaactgtctctcctctgttcagacacatgaaagggctcatagtggaaggaaactctatgtttgtgaggaatgcggaaaaacatttatttcccattcaaaccttcaaagacacaggataatgcaccgtggagatggaccttataagtgtaaattttgtgggaaagccttgatgtttctcagtttgtatcttatccacaaacgaactcacactggagagaaaccatatcaatgtaaacagtgtggtaaagcctttagtcattctagtagccttcgaatacatgaaagaactcacactggggagaagccttataaatgtaatgaatgtgggaaagcattccatagttccacatgccttcatgctcataaaagaactcacactggggagaagccatatgaatgtaaacagtgtgggaaagccttcagctcttcccattcctttcaaatacatgaaagaactcacacgggggagaagccatatgaatgtaaggaatgtggaaaagcattcaagtgtcccagttctgttcgcagacatgaaagaacccactctaggaaaaaaccctatgaatgtaaacattgtgggaaagtattatcttatcttaccagctttcaaaaccacttgggaatgcacactggagagatatctcataaatgtaagatatgtgggaaagccttttattctcccagttcacttcaaacacatgaaaaaactcacactggagagaaaccctataaatgcaaccaatgtggtaaagcctttaattcttccagttccttccgatatcatgaaagaactcacactggagagaaaccttacgagtgtaagcaatgtgggaaagccttcagatctgcctcactccttcaaacacatggtaggactcacacgggagagaaaccctatgcatgtaaggaatgtggaaaaccatttagtaatttctctttctttcaaatacatgaaaggatgcacagagaagagaagccgtatgaatgtaagggttatgggaaaacattcagtttgcccagtttatttcatagacatgaaaggactcacactggaggaaaaacctatgaatgcaagcagtgtggcagatccttcaactgttcgagctcctttcgatatcatggaaggactcacactggagagaaaccctatgaatgcaagcaatgtggaaaagccttcagatctgcctcacagcttcaaattcatggaaggactcacactggagagaaaccttatgaatgtaagcagtgtgggaaagcctttggatctgcctcacaccttcaaatgcatggaaggactcacactggagagaaaccctatgaatgtaagcagtgtgggaagtcttttggatgtgcctcgcgacttcaaatgcatggaaggactcacactggagagaaaccgtataaatgtaagcaatgtgggaaagcttttggatgtccctcaaaccttcgaaggcatggaaggactcacactggagagaaaccctataaatgtaaccaatgtggtaaagtctttagatgttcttcacaacttcaagtgcatggaagggctcactgcatagacaccccataaccccaggctttaggaggctgaggtggggggactgcttaagcccaggagttcaagaccagcctgggcaacatagtgagactctgttat

SEQ ID NO: 1371 - DNA, 3044 bp, Homo sapiens
gtaatgggcggagcgaatcgcgccgctgacttccggcccggaggctgagggagaatgtttgataggtttatattgtctttttccatcctcttcagacatccttcaaagttgagccctttttttccgctgtgagtctctacacatgtctgacactctcatgtcccacggattacagaaagacattccttgcaggagaacatggcttcccagtgatgtgggaaagatggactctgatctccagggtagaagtggcaaccagagtaagccagttcgttgaagcaaatgatggctgcagtgaagagtaccgaggcacacccatcctcaaacaaggatcccacacagggccagaaatcagccctccagggtaacagccctgactccgaggcctcccgtcagcgcttcaggcagttttgctaccaggaggtaactggcccacatgaagcttttagcaaactctgggaactctgttgtcagtggctgaggccgaagacccactcaaaagaggaaatcctggagctgctggttttggagcagtttctgactatcttgccagaggagatccagacctgggtgagggagcagcatccagaaaacggcgaggaagctgtggctctggttgaggatgtacagagagctcctggacaacagcctggcttgctcctcaggctcccaggaacctgcctcaaaacacaggtctccacgaccaggagacaggtgctgtggtctggacagctgggtcccaggctagagtggtgctattttatcggtagcagcagctccagtgttgttacagggaccagccatgcgtgacaacagagctgtatccctctgtcagcaagaatggatgtgcccaggccctgcacaaagggccctctacaggggtgccacccagaggaaggacagtcacgtctcgctggcaacaggtgtgccctggggctatgaagagaccaagacgctcctggctattcttagtagttctcaattttatggaaaactccagacctgtcagcagaacagccagatctacagggccatggcggaaggactctgggagcagggttttctgcggaccccagaacagtgtcgcaccaagttcaaaagcctacagttgagttaccgcaaagtgaggagaggccgtgtgcctgagccttgtatcttttatgaggaaatgaatgctctttcaggctcctgggcctctgcacctcctatggcaagcgatgctgttcctggccaagaaggaagtgatattgaggctggagagctgaatcaccagaatggggaacccacggaggtagaagatggcactgtggatggtgcagacagggatgaaaaggacttcaggaatcctggccaggaagtcaggaaactagacctgccagtgctgttcccaaacagacttggttttgagttcaagaacgagattaaaaaagaaaatctaaaatgggatgattcagaggaagtagaaataaacaaggctttacagagaaagtccagaggagtttattggcactctgagctacaaaaaggcttggagagtgagccaacatcaagaaggcaatgtagaaattctccaggggagagtgaggagaaaaccccatcccaggagaagatgagtcaccagagtttttgtgccagggacaaagcctgtacacatatcctctgtgggaaaaactgctctcagagtgtgcactctccccacaagccagcgctcaaactggaaaaagtatctcaatgtcctgaatgtgggaaaacctttagccgaagttcttatcttgttcggcatcaaagaatccacacaggcgagaagcctcacaagtgcagtgagtgcgggaagggctttagtgagcgctccaacctcactgcccacctacgaactcacacaggggagaggccctatcagtgtgggcaatgtgggaaaagcttcaaccagagttccagcctcattgtccaccagaggacccataccggggaaaagccttaccagtgcattgtctgtggaaagagattcaacaacagttcccagttcagtgctcaccggcgcatccacactggggagagcccatacaagtgtgcagtgtgtgggaaaatcttcaacaatagctcccacttcagtgcccaccgaaaaacccacactggtgaaaagccttacaggtgttctcactgtgagagaggcttcactaagaactctgccctcacccgtcatcagacagtacacatgaaagcagtactctcatcacaggaaggaagagatgcgttatgagtgtgtcggtaaactgtcagattaagttcctcaggtcagcatgtatgagctttcttctgctgtggagagatctagccagtccctgactttgcaacagacctactgactactggatcttaagacccatgtctaggaccaggagtcagcataaggacgctgacctctcctggctgtgcctgtgactccagagtcctatcttactgtgacttaaagtttgatggagagaaagctgtaggatccataaattctaccaggaaaccagggtcttcctgttcctagcactgagaatgggcacccagtggtccaagaacactttctgggctaacatagtcctcacacagggctgagaaagaaagtgtctcctttcctggaaagcacatgtaaaagttaagggcctgaatctcttctaaaccaataattgacctctaggcacccaccgtaatactgctaccttcagggcagaagacactgctctttgtaacccagccaccaccaaaaagcaaacagaaagaaggaaggatggttaagccattggataatactgaatctgtttccctaagtgacttaaccttagagcaagcacaacatccaggttaattttttgtaagatttctccttttattattgccctcatcatagttcctgattgtctcttaaagtaagtggtttatagacattactatttctgataataatttacaaactactataaacaaatttataaacattactaatttctgatgaaaataaagttgtttctccctccaaaaaaaaaaaaaaaaaa

SEQ ID NO: 1372 - DNA, 1290 bp, Homo sapiens
gagtctagtctttgttcggggctgtccaaaggacgctagctgttgcacctgttcctccctgcgcgtaagatagaggataaatctcctggcaaagcccagaatgaccacagccctggaacctgaggaccaaaaaggacttctgataattaaggcagaggaccattactggggacaggattccagctcacaaaagtgcagtcctcacaggagggaactctatagacaacacttcaggaagctctgctatcaggatgcacctggaccccgtgaagctcttacccagctgtgggagctctgccgtcagtggctgaggccagaatgccacaccaaggagcagattttagacctgctggtgctagaacagttcctgagcattcttcctaaagacctgcaagcatgggtgcgtgcacaccatccagagactggagaggaggcagtgacggtactggaggatctggagagagagcttgatgaacctggaaagcaggtcccaggcaattcagaaagacgggacatactcatggacaagttggcccccttgggaaggccatatgaatcactgactgtccagctccatcccaaaaagacccagctggagcaggaagctgggaaaccacaaaggaatggtgataaaactaggactaagaatgaagagttgttccagaaggaagatatgcccaaagacaaggaattccttggggagataaatgacagactgaacaaagatactcctcagcatcctaagtccaaagatattattgaaaatgagggcagatcagaatggcaacagagggaaagaagacgatataaatgtgatgaatgtgggaaaagtttcagtcatagctcagaccttagtaaacacaggagaactcacacgggagagaagccctataaatgtgatgagtgtggaaaagccttcattcagcgctcacatctcattggacatcatagagtacacacgggagtaaaaccctataaatgtaaagaatgtgggaaagacttcagtgggcgcacaggtcttattcagcatcagagaatccacacaggtgaaaaaccctatgaatgtgatgagtgtggaaggcctttccgagtaagttcagctcttattagacatcaaagaattcataccgcaaataaactctactaatatagcagtaatatcaaaagttctttggacactcaggcctaactagttatcaaagaatctattttagaaaccttgagtttcctcaatgtggtcaaagcttcagtcatcattaaacttctctggaccaaaaaaaaaaaaaaaaa

SEQ ID NO: 1373 - DNA, 4315 bp, Homo sapiens
gccggaaaggacccggcctcgagatggcagagcggaggcgttccctgggctgagctgagcacctcctccctgagacagcagcggtctaacccccggcgcgggagggacccagccagggggctgtcctagtagattccggcattgcctccaccccgctgtggcggagacgcagagggcgggtcgcgctcgagggtcagggaggagagtgacccggccctggtccagggccctccctgcccgccttggggccagaactccagccctggggagtgggcagggcctgttttccgtgcctcacgccctgcttttcgcctccttcagcgctgtctgctagctgcttttcctgctctctctccctggaggcgaacccttgtgctcgagatggcagccaccctgctcatggctgggtcccaggcacctgtgacgtttgaagatatggccatgtatctcacccgggaagaatggagacctctggacgctgcacagagggacctttaccgggatgttatgcaggagaattatggaaatgttgtctcactagattttgagatcaggagtgagaacgaggtaaatcccaagcaagagattagtgaagatgtacaatttgggactacatctgaaagacctgctgagaatgctgaggaaaatcctgaaagtgaagagggctttgaaagcggagataggtcagaaagacaatggggagatttaacagcagaagagtgggtaagctatcctctccaaccagtcactgatctacttgtccacaaagaagtccacacaggcatccgctatcatatatgttctcattgtggaaaggccttcagtcagatctcagaccttaatcgacatcagaagacccacactggagacagaccctataaatgttatgaatgtggaaaaggcttcagtcgcagctcacaccttattcagcatcaaagaacacatactggggagaggccttatgactgtaacgagtgtgggaaaagttttggaagaagttctcacctgattcagcatcagacaatccacactggagagaagcctcacaaatgtaatgagtgtggaaaaagtttctgccgtctctctcacctaatccaacaccaaaggacccacagtggtgagaaaccctatgagtgtgaggagtgtgggaaaagcttcagccggagctctcacctagctcagcaccagaggacccacacgggtgagaaaccttatgaatgtaacgaatgtggccgaggcttcagtgagagatctgatctcatcaaacactatcgagtccacacaggggagaggccctacaagtgtgatgagtgtgggaagaatttcagtcagaactccgaccttgtgcgtcatcgcagagcccacacgggagagaagccataccactgtaacgaatgtggggaaaatttcagccgcatctcacacttggttcagcaccagagaactcacactggagagaagccatatgaatgcaatgcttgtgggaaaagcttcagccggagctctcatctcatcacacaccagaaaattcacactggagagaagccttatgagtgtaatgagtgttggcgaagctttggtgaaaggtcagatctaattaaacatcagagaacccacacaggggagaagccctacgagtgtgtgcagtgtgggaaaggtttcacccagagctccaacctcatcacacatcaaagagttcacacgggagagaaaccttatgaatgtaccgaatgtgagaagagtttcagcaggagctcagctcttattaaacataagagagttcatacggactaagctgtaattatgatggctgagaaatgattcatttgaagatacaattttatttgatatcaatgaacgccctcaagactgagctgcttttatcatactctcctagttgtgggccacgatttaaaccatcagagatgacaagccatttgaaattctgaccctcagctttgggaatgttatctcctccaaaatggtgatttttattcactcaatgggttacttcattaaaagcagccccacaagtaactggaaatctgaagaccaggggacaaatgctggtgaatgcttaggcctggaaatggagtaaatctttcaatgttattttctcccatccttggcccaaggaactatgctaagtgaaacgtgggactgtaatagggtggtaatggctgctttggaaaaaggcaactagagactctgcctaaattgccacacctattcacacaccatagtagttgggcacacacatcttcccttccaaagggctttttccttgagttgctcatgcatttgtatcttttccatcttcctgagggcaagattttgcacgatgaaggcaatgattgtaacttttctccttctcattgtttctaattagctcctttaaagcttgcatctttgtgaaggctaactgaagatacggttggaaaggaaaaatgagacacaggtttggggaccaaggacccatcaatgatggtgactttagcagaagatgcccacagttattactgccattaatcagatttatgaattttctttggggatcactatagggaatattgtatagaaaatatcttcaagaaaagataggaccatcagtgacagttaagtgtaaggagcaagtggaattgagtccttcagggaaggaaccacagagtcccttcccaaggaatgtaggtcgtttctgtgttctttcccttctaatctttaagatcaactcttcctatcctgctaactctaagatttgataagggccacatcccagtgtttatcttagcttgcatcagggcatgtgtatgtacagtaatgtgtattcctgtggtttttctaatagaaactgaatttacagagacttagcatgttcttgggtgatgtgagtcatgtgacagaagtacagacataactccaatgtgagaaatgtccttttttcattatggaaaataatttaaacactagtgctttagtgtgcactctcctgtaaggtctgtctttgtacagagctaagcacttgtttgtatgtgtttgtcaattgtggaagataatgaccagacaaataggtcgattgtcctattctcagaatgaattatcttctatggtaatgaagaactctttggcttagtcagaaggaattaacgaacctcggtaggaatgtatttccatcctcccaccctacagatataagaggttaaaataacagttcgcccaatttaagcccagtagtgtcagttttcctaatctcagtccaggtaggaattaagaaatatctcaagtgttgatgctatccaagcatgttggggtggaagggaattggtgcccagaaaatgggactggagtgaggaatatcttttcttttgagagtacccccagtttatttctactgtgctttattgctactgttctttattgtgaatgttgtaacattttaaaaatgttttgccatagctttttaggacttggtgttaaaggagccagtggtctctctgggtgggtactataatgagttattgtgacccacagctgtgtgggaccacatcacttgttaataacacaacctttaaagtaacccatcttccaggggggttccttcatgttgccactcctttttaaggacaaactcaggcaaggagcatgtttttttgttatttacaaaatctagcagactgtgggtatccatattttaattgtcgggtgacacatgttcttggtaactaaactcaaatatgtcttttctcatatatgttgctgatggttttaataaatgtcaaagttctcctgttgcttctgtgagccactatgggtatcagcttgggagtggccatagatgaccgcatttccatgacctaactgtatttcacccccttttccttccctactgttcttgccccaccccaaccagttcctgctgctgcttttggcttcttggaggtgaagggcttaaaacaaggcttctaagcacccagctatctccatacatgaacaatctagctgggaaacttaagggacaagggccacaccagctgtctcctctttctgccaattgttgcccgtttgctgtgttgaactttgtatagaactcatgcatcagactcccttcactaatgctttttgcatgccttctgctcccaagtccctggctgcctctgcacatcccgtgaacactttgtgcctgttttctatggttgtggagaattaatgaacaaatcaatatgtagaacagttttccttatggtattggtcacagttatcctagtgtttgtattattctaacaatattctataattaaaaatataatttttaaagtca

SEQ ID NO: 1374 - DNA, 1012 bp, Homo sapiens
catgaaggaactcacactctagagaaaccctatgaatgtaagcaatgtgggaaattgttatctcatcgctcaagctttcgaagacacatgatggcacacactggagatggccctcataaatgcacagtatgtgggaaagcctttgattctcctagtgtatttcaaagacatgaaaggactcacactggagagaaaccctatgaatgcaagcaatgtgggaaagccttccgtacttccagttcccttcgaaaacatgaaacaacacacactggagagcaaccctataaatgtaaatgtggaaaagcttttagtgatttattttcctttcaaagtcatgaaacaacacacagtgaagaggagccttatgaatgtaaggagtgtgggaaagcatttagttcttttaaatacttttgtcgccatgaaaggactcacagtgaagaaaaatcttatgagtgtcaaatttgtgcaaagccttcagtcgtttcagttacttaaaaactcatgaaagactcacacggcagagaagccatatgaatgtaagcaatgcaggaaagcattcttttggccctctttccttctaagacatgaaaggactcacactggagaaagaccctatgaatgtaaacactgtggtaaagccttcagtcgttccagtttctgtcgagaacactgaaagaactcacatgagagaagccctatgaatgtaaggaatgtgggaaagccttcagttctctcagttcctttaatagacataaaaggacacactggaagatattctataagtgtatgaatgtgggaaagcattcattggttttatcacattcagatacttgaaagaaataaatcctgtgaatgtaaacgtggtaaagccttaagaagtttccaggctgggcgcagcggctcacacctgtaatcccagcactttgagaggccgaggagggcagatcacgaggccaggagatcgagaccagcctggctaacatgggaaaccctgtctctactaaaaatacgg

SEQ ID NO: 1375 - DNA, 4181 bp, Homo sapiens
agtgctgcgccgacagcggtcaggatctcggctttcttgcttcgagagggactaggtgcctccaccagagcttctgtcgctctgtaacctgcactgtgacctacactagtcgcgggagccacgcagaggacgccggaacaccctggaagccgagaaatggacccagtggcttttaaggatgtggctgtgaacttcacccaggaggagtgggctttgctggatatttcccagaggaaactctacagggaagtgatgctggaaactttcaggaacctgacctctttaggaaaaaggtggaaagaccagaacattgaatatgagcaccaaaaccccaggagaaacttcaggagtctcatagaagaaaaagtcaatgaaattaaagatgacagtcattgtggagaaacttttaccccagttccagatgacagactgaacttccaggagaagaaagcttctcctgaagtaaaatcatgtgaaagctttgtgtgtggagaagttggcctaggtaactcatcttttaatatgaacatcagaggtgacattggacacaaggcatatgagtatcaggaatatggaccaaagccatgtaagtgtcaacaacctaaaaaagccttcagataccgcccctcctttagaacacaagaaagggatcacactggagagaaacccaatgcttgtaaagtatgtggaaaaacctttatttcccattcaagtgttcgaagacacatggtaatgcacagtggggatggaccttataaatgtaagttttgtgggaaagcattccattgtctcagattatatcttatccatgaaagaattcacactggagagaaaccatgtgaatgtaaacagtgtggtaaatcctttagttattctgctacccatcgaatacataaaagaactcacactggagaaaagccttatgaatatcaggagtgtgggaaagcatttcatagtcccagatcctatcgtagacatgaaaggattcacatgggagaaaaggcttatcaatgtaaggaatgtggaaaagcattcacgtgtccccgttatgttcgtatacatgaaaggacccactctaggaaaaatctctatgaatgtaagcagtgtgggaaagcattatcctctcttacaagttttcaaacacacgtaagattgcactctggagaaagaccttatgaatgtaagatatgtggaaaagacttttgttctgtgaattcatttcaaagacatgaaaaaattcacagtggagagaaaccctataaatgtaagcagtgtggtaaagccttccctcattccagttcccttcgatatcatgaaaggactcacactggagagaaaccctatgagtgtaagcaatgtgggaaagccttcagatctgcctcacaccttcgagtgcatggtaggactcacactggagagaaaccgtatgaatgtaaggaatgtgggaaagccttcagatatgtgaataaccttcaaagtcatgaaaggacacaaacacacataagaatacactctggagaaagacgttataaatgtaagatatgtgggaaaggcttttattgtcccaaatcatttcaaagacatgaaaaaactcacactggagagaaactctatgaatgcaagcaacgttcagtagttccttcagtagttccagttccttttgatatcatgaaaggactcacactggagagaagccctataaatgcgagcaatgtgggaaagccttcagagctgtgtcaatcctttgaatgcatggtaggactcaccctgaagagaaaccctatgagtgtgagcaatgacggaaagccttcagatctgccccacacctttgaatacgtggtaggacacacaatggagagaagccctatgcatgtaaggaatgtgggaaacccttcggatctgcccagaaccttcgaattcatgaaaggacacaaacacacataatgcactctgtagagagaccttataaatgtaagatatgtgggaggggcttttattctgccaagtcatttcaaatacatgaaaaatcttacactggagagaaaccctatgagtgtaagcaatgtgggaaagcctttgtttccttcacttcctttcgatatcatgaaaggactcacactggagagaacccctatgagtgtaagcaatttgggaaagccttcagatctgtcaaaaatcttcgatttcataaaaggacacacactggagagaaaccctgtgaatgtaagaaatgtagaaaagcattccataatttctcttctttgcaaatacatgaaaggatgcacagaggagagaagctctgtgaatgtaagcattgtgggaaagcattcatatctgccaagatcctttgaatacatgcaagaacacacaatggagagaaaccctatgaatgtaaagaatgcagaaaagcattcagcttgcctacttcctttcatagacatgaaaagactcacactggaaggaaacactatgaatgcaagcaatgtggcaaagctttcacttcttccagttcttttcaatatcatgaaagaacacactagggagaaaccctatcaatgtaagcaatgtgcaaaagcctttatttcttccacttcttttcaatatcatgaaaggactcacatgggagagaaaccctatgagtgtatgccaagtgggaaagccttcatttcttctagttcccttcaatatcatgaaaggactcacactggagagaagccctatgaatataagcaatgtgggaaagccttcagatcagcctcgcaccttcaaatgcatggaaggactcacactggagaaaaaccctatgaatgtaagcagtatgggaaagcgttcagacctgacaagattctttgaatacagataatgaatgtaaacaattaactgtttataataactgtatactaacaaatgatattctttttaaataagaagctataatatcccattggtgtcatgtattagatcagccttatactgttaaattgttattatttggacattgtgagtcagtataaccatgtggataaaatgccagacatctttttattcgaaaattttacttttcatgcttctgtacttacatttttatctcaaccttaatttttctttctttttttttttcccccagaaagaatctcactctgtcacccaggctggagtgcagtggcatgatctcaggtcactgcaacctctgcctccagggttcaagcaattctcctgcctcagtctcctgagtagctgggactacaggcatgcgccaccatgccaggctaattttttgtattttttagtagagacggggtttcaccatattggctaggctggtctcaaactccagacctcatgatttacccacctcggcctcccaaaatgctgggattacagacatgaaccatcatgcccagctgcaaccctaatttttcattcagtcataataccaatagttatctcatgcacctctgagtgccttcttccccaaaaccagcagtgccatacctgctgtcagcaagggtgtaatataccatagtgataaatatgaccaaaagccataaatgactgtgagatgtatgagaattacaagtcacattagtaagaagagaaaaattttggtcatgtttatgatttgaaatacgttttcctctatcacatttaaaaatatagttacaaaatgcccttgtttttgtcctgattcatcatggtcactgaggagcatcgtctcatatgcctggtatgtgacacgtgtctctccaacaataaaagacttggccttggctgggcatggtggctcacgcctgtaatcccagcactttgggaggccgaggtcaggagttagagaccattctgaccaatatgatcaaaccccgtctctactaaaaatacaaaagttagcagggcgtggtggcatgctcctgtaatcctagctattcaggaggctgacataggagaattgcttgaatataggaagcagaggttgcagtgagccgaggttgcaccattgtactccagcctgggcaacaagagtgaaactctgtcttaaaaaacacaaaaaaagacttggccttagggccgagtgcggtggctcacgcctataatcccagcactttgggaggccgaggcgggcggatcactaggtcaggaaatggagaccatcctggccaacacagtgaaacccagtctctact

SEQ ID NO: 1376 - DNA, 2736 bp, Homo sapiens
aactgtcaatcaggcactgcccagagaagtgtgtgtggttgaaaaagcccgcggcgtctgctccacccacctgcgctcggctctgggttctgtagctgagagacgacctggaagttctgaggcagcctttgtctggctggaacacgcattggcagcgggagctgtcggtaggacctgggacaccgcggaagtcgggaaatggcctcagtggctttagaggatgtggctgtgaacttcacccgagaagagtgggctttgctgggtccttgtcagaagaatctctacaaagatgtgatgcaggaaaccatcaggaacctggattgtgtagtaatgaaatggaaagaccagaacattgaagatcaatatagatatcccaggaaaaatctaagatgtcgtatgttagagagatttgttgaaagtaaagatggaactcaatgtggagaaacatctagccagattcaagatagtattgtgaccaagaacactcttcctggagtaggtccttgtgaaagcagtatgagaggagaaaaagtcatgggtcattcatcccttaattgttacatcagagttggtgctgggcacaaaccacatgagtatcatgaatgtggagagaagccagatacgcataaacaacgtgggaaagccttcagttaccacaactcatttcaaacacatgagaggcttcacactggaaagaaaccatatgattgtaaagaatgtgggaagtccttcagttctttgggaaaccttcaaagacacatggcagtgcagcgtggagatggaccttataaatgtaagttgtgtgggaaagcgtttttttggcccagtttattacatatgcatgaaagaacgcacactggagagaaaccatatgaatgtaagcagtgttctaaagccttttctttttacagttcctatctaagacatgaaagaacacatactggggagaaaccgtatgaatgtaaacagtgttctaaagcctttcctttttacagttcctatctaagacatgaaagaacacatactggggagaaaccatataaatgtaagcagtgttctaaagccttccctgattccagttcttgtctaatacatgaaagaactcacactggagagaaaccctatacatgtaaacaatgtgggaaagccttcagtgtttccggttcccttcaaagacatgaaaccactcacagtgcagagaaaccctatgcatgtcagcaatgtgggaaagcgtttcatcatctgggaagctttcaaagacacatgataaggcacactggaaatggacctcataaatgtaagatatgtgggaaaggctttgattgtcctagttcactgcaaagtcatgaaagaactcacactggagagaaaccctatgaatgcaagcagtgtgggaaagcattatctcatcgctcaagctttcgaagtcatatgataatgcacactggagatggacctcataaatgcaaggtatgtgggaaagcctttgtttatcccagtgtatttcaaagacatgaaaggactcacactgcagagaaaccctataaatgtaaacaatgtggcaaagcctaccgtatttccagttcccttcgaaggcatgaaacaactcatactggagagaaaccctataaatgcaaacttgggaaagcctttattgatttctgttcctttcaaaatcacaaaacaactcacactggagagaagccatatgagtgtaaggaatgtgggaaagcattcagtcgtttcagatacctttctcgacataaaaggactcacacaggagagaaaccttatgagtgtaaaacatgtaggaaagccttcggtcattatgataacttaaaggtacatgaaagaattcactctggagagaagccgtatgaatgtaaggaatgtgggaaagcattctcttggctcacttgctttctacgacatgaaagaattcacatgagagagaaatcctatgaatgtccacaatgtggtaaagccttcactcattcccgttttcttcaaggacatgaaaaaactcatactggagagaacccgtatgaatgtaaggaatgtgggaaagcatttgcttctctcagttccttgcatagacataaaaagactcactggaaaaaaactcacactggagagaacccatatgaatgtaaggaatgtgggaaagcatttgcttctctcagttccttgcatagacataaaaagactcactagcattctctctaaatgtatggaatgtgggaaagcatttattaattttatttcatttcagatacttgtacgaaacacattggagatagaccctgtgaatgtaagcacttggtaaagccttaagtagtttcagtttctttccagtacagtcatcccttgatacctgctgggtattggttccagcactccgtgagccatgtccagtcccttttataaaatgacatgtttgtatgtaacttacccacatcctcttgtatagtctcaattatgtctagattacttaaaatacctcatgcattataaaagctatgcaaatagttgttctattgtattgtttagggaatcatgataaggaaaagagtctatgtattttcagtatagatgcagtaattgtgagcctatcaacatagtgtagtcagccagaacattaaagtttctttgtttcaactctcaaaaaaaaaaaaaaaaaaaaaaaaaaaaaaaaaaaaaaaaaaaaaaaaaaaaaaaaaaaaaaaaaaaaaaaaa

SEQ ID NO: 1377 - DNA, 10264 bp, Homo sapiens
ggagccgccgggaggtaggcgcgggacgggcggctgcggtggcggcgggtggaccgattgtcgctcggcggcgggagtcggtggagtctcgctctttcgcaaggctggagtgcaatggcatgatctcggctcactgcagcctccgcctcctgggttcaagtgattcttctgcctcagcctcccgagtagctgggactacagaaatgctggtaatttcagtcacttgctgatgacttctgatgtcccagcaaatgttggcattgttgactgctgagaagatacttctgaggacccacgtctaaggtggacttggttcgcactcttctggttagtccctgaacaggagtgatgcctccaggcaggtggcatgctgcctatccagctcaggcccagtcttcgagggagcgagggcggcttcagacagtaaagaaggaagaagaggatgaaagctatactccagtgcaggctgccaggccacagactctcaaccgccctggccaggagctgttccgccagctcttcagacagcttcgctaccatgagtcttcagggcccctagaaactctgagccggctccgggaactctgtcgctggtggctgaggcctgacgttctctccaaggcacagatcctagagctgctggtgctggaacagttcctgagcatcctgcctggggagctccgggtttgggtgcagcttcataaccctgagagtggcgaggaggctgtggccttgctggaggagctgcagagggaccttgatgggacatcctggagggacccgggccctgcccagagcccagatgtgcattggatgggtacaggagccctgcgatctgcacagatatggtcccttgcttcacctctcaggagcagctctgctctgggggaccacctggagcctccctatgaaatagaagcacgtgacttcctggctgggcaatccgatactcctgctgcccagatgcctgcccttttcccgagagaggggtgcccgggagaccaggtaacaccaaccaggtccctgacagcccagctccaggagaccatgactttcaaggatgtggaggtgaccttctcccaggacgagtgggggtggctggactctgctcagaggaacctgtacagggatgtgatgctggagaattataggaacatggcttccctggtgggaccattcaccaaacctgctctgatctcctggttggaagcaagggagccatggggcctgaacatgcaggcagctcagcctaaggggaatccagttgctgctcctacaggagatgacctccagagtaaaacaaacaaattcatcttaaatcaggaacctttggaagaagcagaaaccttagctgtgtcatcaggatgtcctgcgacaagtgtttctgagggaattgggctcagagaatcttttcaacagaagagcaggcagaaggatcaatgtgaaaatcccatacaagtaagagttaagaaagaagagaccaatttcagtcacaggacaggaaaagactctgaagtatcaggaagtaatagtcttgacttaaaacatgttacatatttgagagtttctggaagaaaggaatcccttaaacatggctgtggcaaacacttcagaatgagttcacaccactatgactacaagaaatatgggaaggggctcagacacatgattgggggcttcagcctacatcagagaattcatagtggactgaaagggaacaaaaaggacgtgtgtggaaaagacttcagccttagctctcatcaccaacgtgggcagagtcttcacacagtgggagtgtcatttaagtgcagtgactgtggaaggactttcagtcatagctcccatcttgcgtatcatcagagacttcacactcaagagaaagcatttaaatgtagggtgtgtgggaaagccttccggtggagttccaactgtgcgcggcatgagaaaattcacactggagtgaagccttataaatgcgatttatgtgagaaagctttccgacgcctgtcagcctaccgtctgcaccgagaaacccatgctaagaagaaatttcttgaattgaatcagtatagggcagctctcacctacagctcagggtttgatcatcatttgggagaccaaagtggggagaaactctttgactgcagccagtgcaggaaatccttccactgtaagtcatatgttcttgaacatcaaaggattcacacccaggagaagccctataaatgtaccaaatgtaggaaaacctttagatggagatcaaactttactcgtcatatgaggttgcatgaggaggaaaaattctacaaacaagatgaatgtcgtgaaggcttcaggcaatctcctgactgcagtcagccccagggtgctcccgctgtggagaaaacatttctgtgtcagcagtgtgggaaaacttttactagaaagaaaactctcgttgaccaccagagaattcacacaggtgagaaaccttaccagtgtagcgattgtgggaaggactttgcctataggtcagcctttattgttcataagaagaagcatgccatgaaaagaaaacctgagggcgggccatcttttagtcaggacacagtgttccaggttcctcagagcagtcactccaaagaggagccctacaaatgcagccagtgtggcaaggccttccgcaatcactcattcctcctcatccatcagagagttcacactggagagaagccatataagtgcagggagtgtgggaaagccttcagatggagttccaatctctaccgacatcagaggattcactctcttcaaaaacagtatgattgccatgaaagtgaaaagactccaaatgtggagccaaaaatcctcactggtgagaaacgtttttggtgtcaagaatgtgggaaaacctttacacgtaaaagaacccttttagatcataagggaatacacagtggagagaagcgctataaatgtaatctatgtgggaaatcttatgatagaaactatcgccttgttaaccatcagaggatccactctacagagagacctttcaaatgtcagtggtgtgggaaagagttcattgggagacataccctttccagtcaccagaggaaacacaccagagcagcacaggctgaacgtagcccgcctgcacggtcttcctctcaggacacaaagttgagattacagaagctaaaaccaagtgaagagatgcccctcgaagactgcaaagaagcttgcagccagagctccaggctcactggactccaggacataagcattgggaaaaagtgccacaaatgcagcatatgtgggaaaacttttaacaagagttcacaactcattagccacaagagatttcatactcgagagaggcccttcaaatgcagcaagtgtggaaagaccttcaggtggtcttcgaacctggctcggcatatgaaaaaccatattagagattagcctgggacctgacagtgacagtgggggtgggttctcagtcccctgctagagaacccttaattataggcattgtggagtaactttgataaagggcccagccctttctgttttggaagctagtgacagaatcccaaggatttgaaagctcggggagtccccagcctgcctgctaggatgtgacgctggggaagtgcagcaccatgtcctttggagcccttctggagactccggcccctaggagtggcctctgcaccatagcctgcggctcccctattcaggtctccttccacaactctgaagagagagaccactgccctttgtggttggacagaatatctgtggcatcatgggctatggctgctggaaaggggccagtgggatcctagatttgtcttcaagtttggcctgtggccatgcctattctgttgactttaaaagcagcagcatcaagaactcctagccttcccaaatgccccctggggagttctggctggggcttcagccttcctggctggcttttggatatctgctagggggttagagtggtctcagcggcaggtggaggagagcaggatgctgggctcaagcgcttggcgtgtggatctctaccagtaccctgttgccatccccatcccacaggcctgcataggcagcagcggtccatctgtttaacagaaatgtgctgagcactcccatacaccaggcgctggtgtgtttgccagagacccagcagggaccagaacagatgaaaatcctgccatcttggatctttacagatgacaaacaaatgggatacgcagtattctggatggtgatgtgtgtagtggacaaagtgaatcagagaagagcagagggagtgctggattgggagatcagtcgtgattttagatagtctggtcagggagggcctcaactgagaaggtgaaatgtgagcaaagacgtgaaggaagccagggaggtagcaggtagctctctagggagagttgcaggcagaggagattgggtcttgactggtgtcctcaggaaggaagcccctgggatggagtgcagggagccagctggaagggaaggagaggggccagggaggccacaggcccggccatatgagcatcatgggtcattacgggggcttgagctggctcagagggaggcagggagcttttggacaattttgagttgaggagtgatgtggtttgaatctgaattatattttataagggttaaccacagatccaaggactcagtaaaagggtgaaaggcttctcatgcagttagccttgctgccagttcccataaatcagactcctccccactccgtttctgaattttctataggatcctcggcctcagcagatataaacgcttaccattgttgtgttcatgtctctagcccctgcacactgcaggcccctctcagcttcacatacccctctccatgtatgagatctggtgctagcaatcagattcaacccgaaggaacaagtgcatgtgcctgctgctctcaggagaaaaggcagcctgttctgggaggagctccctcactggcccacccacttgtgttgaagcaaaaagcaagaatcaattacttaaaggcaaaggagtgatattgctaaagcatgtgagtaatcattgcttctgattattgaagaggtcagattatgaatgaaaggataaaatgttttaatagtagagcagtgtcctgactataggggcccgttcatggagctggtcatttcttgaaatgagaagaaaccaacctggaagatgtctttttcagtagagtatggaataatcttacctgctctggattgccatgagcaggtgaaaatgaaggctctgatattgtgtggtggtgtcacaggatggtgggggcggggcagaagtctcctgttggtgttctgatgcctgttcagctttgtcctcaggaaggtttggtcatcttggttctgccatcctcttgccttcctacggcagcagctgttcatggcactgaagatgtcccttcactgtcccaaaactggcactagaagtggctgggcaggggggccagagtcataggaagggtcttggagtcatcagatctgggttccaggcatggtgtgccttttcttggcaggattgatcttgagcaagtcaatgaacctctgcatcaatttccttatgtgtgaagttagagtgcttggctgtgctacctgattcctgagattggtgaaagagggcttggtttaccaaggctctccatcaggtggttgacctctaggaccagggccctctcagaggtgcagcttccatgtcagttggtgttgtaaccatggaaaagtccctttccaatcaaacttttagcacccctttccccccatctctgctccctttgccacaggataccttgtaaagttcctgccccagtatagggatatttttactgtcttttttattttttgagacagggttgcccagggtggagtgcagtggcaggatcacagcttactgcagccttgacctcccaggctcaggtcccatctgagcctcccgagtagctggggctacaggtgtgtgccaccctgccagctaattttttatatttttttgtagagacaaaacttttatttttttttcccatgttgctcatgctggtctcaaactcctgggctcaagcaatccacccacctctgcctcccaaagtgctgggattacaggcgtgagccactgtgcctgacctgtcatttttatagaatgaaatgtgcttatttctaaacattctaatcaaattttaaaatgtgcaaagaatgaagtgaaaaactgaatttttttttttttttgatacggagtctcactctgttacccaggctagagtgcagtggcgcgatctccgctcactgcaagctctgcctcctgggctcacaccattctcctgcctcagcctcctcagtagctgggactacaagtgcctgccaccacgcctgggttattttttatatttttagtagagacggggtttcactgtgttagccaggatggtctcgatctccaggatggtctcgatctccaggatggtctcgatctcctgacgtcgtgatccacccgcctcggcctcccaaaatgctgggattacaggtgtgagccactgtgcccggccaaaagaacagaaattattttatcctgaagtaagctgtttatatttgggattatactgaacctatttgtccaataacctgagttttcaaataattttagttctataagtactataattatataaatattaatgaattcagattagctgaaaggaaaaaaagtagaagcctgactacttggtgctaactactaaagattttggcagaatcaatgttggatttggctttcctgtcccttccccatgccagccccccagagtgttctgccttgtgctgcctcccttcacctggagtgccacacccctctctctgccagttcagctcttcattcttcaaggcctgaccttgtctgacccttgtgcctctaaacccgtggccccacctctcttggttcctatgtcaggtgatgtttgtgtttttggttatgcccatctccatagccagaccaagcactctggaagccagggttgggtgcttatttatctgtttgccatgcagaaaatatcttgcacaaaattacctctgttaaggaatctgaagctgaatttagtttggctgagtcagggttgggttttttttaaggggctgtggggtgaaatgttgactggaagccacccacaaacacacacctgctggttaggaacccggctgtgggtggttctgagctgtttggcttcagttgacagtttctgattgccctgagcaccaggtctcatcttgcatctcatcctggcctggagaacattcagtttccttccaacccttcccacctttcccccactcccttggaggaactgaagttggggttgaggagagccagatggctggagtgggtatttgaaggtctttctgtcacctgttcagtgtggtctgccccacccctgctgaccaagactgactgaaatgtaaaataatacagaccatctcacactcagaaagctggcacatttttgaaagcccaagtgtgggtaagtgcgtggaacaacgataattcacactgctttatgagtagaaattgtgagaaatattgtgccaggcaatttgcaaaatcttggaaggttgtgtgcacttaaccacccagcaactactcctggatgcatcctagagaagtgccatgtgaacagagaatgattttaagacttcactgaagtattgtttaggtagcaagattgggaaaagcctgcatttcatcagcagaagaatggataaataaatgggttgtttttggtccttggaaagtgaatatgaaagagttacgtctcaacacagatagatgaaaaattatgctgagaaagttggtgaagctacatacaaggtacccttagtgtaaagttaagcatactgtgtacctgtgggcacgttacttcaacttgtttttcactttttctgtaaaatgggatagtagtggcaatctcacagggtgattgtgggtgggggggtggtcaatgaagtaatgcatgtaaaatgcttagaatagtgtctagcatgtaagccttgtggacatatagaaagtgttattgttttgcacagtaatctattttctgtggattcaaataatatgaaatgagtataaaatcatgtattggaacgatgtgtgcaagtcaccattctgccttcctaaggcaggagacctgatggatttggggagggtacatggggccttcagttgtgttttctttgtttttttctaaaaattgatgcagaggcatcacaatgttaagatttttacagggtagtgtggtgggtactttttaactgtttgcttaaagtgtttcaaagtaaaaatatttcttaagcatagtctctgacatcttatgactttatagaaatccctgccaggtacatgatgttacttagagtgagccacctaatctttcaaggcttccatttcctcacctgcaaaaattgggagtgtcagaggcgtttgaaccagagtgactccatcttgaatagggaactgggtaaaataaggctgagacctactgggctgcattcccaggaggttaggcattccaagtcatgggatgagataggaggtcagcacaagatacagtcataaagaccttgccaataaaacagcatgtggtaaagaagccggtcaaaaccaagatggcaatgaaagtgacctctggttgtcctcactgctgtaattatactgtaattataatgcattagcatgctaacagacactcccaccagtgccatgacagtttacaaacgccatggcaggcctggcacgatggctcatgcctgtaatcccagcactttgggaggccaaggcgggcggattatgaggtcaggagattgagaccagcctggccaacatggtgaaaccctgtctctactaaaaaatacaaaaattagctgggcatggtggcacgtgcctgtaatcccagctacttgagaggctgaggcaggagaatctctagatcccgggagttggaggttgcagtgagccaagatggtgccactgcactccagcctgggtgacagagcaagactctgtctcaaaaaaaaaaaaaaaaaatgccatggcaacatcaggaagtaacactatatggtctaaaaaggagaggaaccctcagttctggtaattgctcacacctttcccgggaaacttatgaataatctaccccttgtttagcatataatcaataaataaccataaaaataggcaaccagcagcccttggggctactcttcctatggagtagccattctgtatttctttactttcttaatattaactactttcactttgtggactcgcccgaattcttttcttgagcaaggtccaagaactctctcttggggactggatcacgaccgctttctggtaacaggagcaatacaaatggctattagtaaacgaacgcttaagtaactctagtacatctatgatgaaataccaggccacagtttttttaaaaatgaggatgttctctatatactgacgcacagtcaccaagacatgcactttataggaaattataagctcctccttgcctaaatctccttaattttgcttaataaataacaagtgaagccagaagctgtaaactcataattttaatgaagaaatgggatccagaagatggagatgtttttcattctactttattagatgaggaaaaggagagtaaatacttgtatgccagctaccacaccttttaaagttaatgttaaccctgctaagaacagcaaggagattttatatcagccaggttttagttgccagaaaccacaccagttattttagcaaagaccttataaagaagtgtactatatttaagtagctaaaaaggcaagaagaaaatgccaaggtgtcttggaggtagcaactgctaagcagctgccaccccaggactgggggagctagaatagagtctccccatgtttgacgtttgtctgctaatagcattcaagctctccccctcagtttgcctggatctggacaagctgataagaaagcccagccacttcctctttgcgtcagaggggaagttcaaactgtgcaaaccctgactgtcaaatgcactgagctctcataaccacaacaaaaaccagagccacttgttcgtcctttcactgaagcccaacagactggcgtgggtgcccgctttgctttccctagaaggcctcatgtgagtagtaaactttttcataacctcaaaaaaaaaaaaaaa

SEQ ID NO: 1378 - DNA, 3903 bp, Homo sapiens
gagagcgcggccttcattcctctcgtggaagtgagtgagtcctgggaccccgcgacctgttttaacttttatggtttggtcgtaggatcagcagggctcgcacttcggtcagcaggaaaagacgctgcggcgagcagcggagggcggagttgaatggctgggcagctgattgccttactgtatccggagctgctgcgttcggggcggttcgggagtcccctggttggaagtggacctgaatggggaggcgtctgaggatctcctgggctctcagcggcccgacccgccttcccccacctcccacagctctgtagcttcctagcggtgtaacgttgggaaaggaggctgttcttggactatgcctgacccgttttttaagaaagagtgcatcactcaacaggtggcgtctggagttatcctctgtggattttccaggatctcagacaagatcgtgcaatctcccagcctcctttccttcccctgccctgacttctgaaagaatgctgcgggagaggaggaaggagagcatcctggcttctggcagcagagccccactgtgacaggacctagcattcaccttcctcttctgttccgagtgcgagaagacttcagggacctctgtttcatggacattatcatattcttctcaagagtacccagcaagaggtttgcaaagaggagttattcagtgaaatcagaatcataccctgagagctacaagaactccatttttcactgtgcagaggctctctgctgaagggtcaagtggaatctggaatccagcccatgtttccccatcatcaagccatgtgaagctgcagactccaagcaacagagagacaagatttagaatactggctctggtatgaaagctggattcaggtactgttcctgcctcttgacctcaccaagcctcagcttcctcgcctgttaaatggatacaattgtcgtcattatcatctgttgagaactccctaaaatgccagctgagcataggcacagaagtttaggtgtttggaccaaggtcacacaactgatacaacagtagcttcttcacagacttggcacttctccagaaggaggaggacaaaatgacgaagtctaaggaggcagtgacattcaaggacgtggctgtggtcttctctgaggaggagctgcaactgctggaccttgcccagaggaagctgtaccgagatgtgatgctggagaacttcaggaatgtggtctcagtggggcatcagtccacaccagatggcctaccacagttagagagagaagaaaagctgtggatgatgaagatggcaacccagagagataactcctcaggagccaagaatctaaaagagatggagactcttcaagaagtaggattaaggtacctgcctcatgaagagcttttctgctcccagatctggcaacagattacaagagagttaatcaagtatcaagattctgtggtaaatattcaaagaacaggctgccagttggaaaaacgagatgatttgcactataaagatgagggattcagtaatcagagttcccatcttcaagttcacagagtccacactggtgaaaaaccctacaaaggagaacattgtgtgaaaagtttcagctggagctctcatcttcaaattaaccaaagggctcatgcaggagagaagccctacaaatgtgaaaaatgtgataatgccttccgtcggttttcaagtcttcaagcccatcagagagtccacagtagagcaaaatcatacacaaatgatgcaagttacaggagttttagtcagaggtcacatcttccccatcatcagagagttcccactggagagaatccatacaaatatgaagagtgtgggaggaatgttgggaaaagctcacattgtcaagctcctctgatagttcatacgggagagaaaccctataaatgtgaggagtgtggggtgggcttcagtcagagatcatatcttcaagttcatctgaaagttcacactggaaagaaaccatataagtgtgaagagtgtgggaagagcttcagttggcgttcacgactgcaggctcatgagcgaatccacactggcgagaaaccatacaaatgcaatgcatgtggcaagagctttagttacagctcacaccttaatattcattgtagaatccacacaggagagaaaccctataagtgtgaggagtgtgggaaaggtttcagtgtgggttcacaccttcaggcccatcagataagccacactggagagaagccatacaaatgtgaggagtgtgggaaaggcttctgccgggcctcaaatctgctggaccatcaaagaggccatactggagagaaaccgtatcagtgtgatgcatgtggtaagggcttcagtcgtagctcagattttaacattcattttagagtccatacaggggaaaaaccctataaatgtgaggagtgtggcaagggcttcagccaggcctcaaatcttctggcccatcaaagaggccacactggagagaaaccctacaaatgtggtacatgtgggaagggcttcagtcggagctcagatcttaatgtacactgtagaatccacacaggagagaaaccctataaatgcgagaggtgtggtaaggccttcagtcagttctccagccttcaggtgcatcagagagttcacactggagagaaaccatatcagtgtgcagagtgtgggaagggcttcagtgtaggttcacagcttcaagcccatcagaggtgccacactggagagaaaccctatcaatgtgaggagtgtgggaagggcttctgtcgggcctccaattttctggcacatcgtggagtccacacaggagaaaaaccataccgatgtgatgtgtgtggtaagcgcttcagacagagatcctaccttcaagcccaccagagggtccacacaggagagagaccatacaaatgtgaggaatgtgggaaagtcttcagctggagctcataccttcaagcccatcaaagagttcacaccggagaaaaaccatacaaatgtgaggagtgtgggaagggcttcagttggagctcaagtcttatcattcatcagcgagtccatgctgatgatgagggtgacaaggactttccttcatcagaggattcacacaggaaaactcgataaaatatgttttactatctcagatgggtgctgaaatattttaataatcagagctatcatagacaaaacatttgttttatagagtcagtagttcagccaagtgattgggagaccacacagcagagaagcctcacaagagtggagacatatggactgcattcagaacattgaccattagctgatacatgcagacaagaggatcaggaaggatgagtctgatctggagtaaatcagaagtactaagatagaaatgctgaattctgttccactagaatataagatccaagagggcagggactttgttgactgccaaatctactctgccttttcagtgcctaatacgttgtaatttttcagtagtatttgaaattactgtcatatttgaaattcagtaatatttgacatttttatttatctctagaagtttctctaaaattgtactcagaagaattctgcaaggcttggaggatatataagttagtcatatggcctgattttcccatttttgcagatctcgtggacaagtgtttatcaaactgaaggttgcagcttgttagtgggttcagaaatcagtttctggctagcaactagaagttttgtatgttaacagtactttattgaggtgtaatctgcatgcagtaacatgcacaagtctcaagttcatggctttctgaattttgacaaatgtaatcatcaccaagatcaatgtatacaatatgtctattaaaccaaaaagttttcttgtgcccatttccagtcaatccca

SEQ ID NO: 1379 - DNA, 2300 bp, Homo sapiens
attgtgttctgactgcgatgtggcgcttgcgatctctcgccgccggcagaggctcctcgaagagcgacacggggctgaccaggcacggtggtcaaagccgcagagggagagcgggagcggtcgtgaggtcgtctggggagaagggcggaggcaaagccgaggagcaggtgtgtggacccttctagcctgaggagtcctgcaggtgtgaagctccacacctgcctccatagcactttgcctgtccctaagagggctcatcggagaagaaagaatggctgtcagccacctgccaaccatggtccaggaatcggtgaccttcaaggatgtggctatactgttcacccaggaggagtgggggcagctgagccccgcccagagggccctgtacagggacgtgatgctggagaactacagcaacctggtctcactgggactcttaggacccaaaccagatacgttttcccagctagaaaaaagggaagtgtggatgccagaggacacccctggaggcttctgtcttgactggatgactatgcctgccagtaagaaatctactgtcaaggcagagattcctgaagaagaattggatcaatggacaataaaggaaagattcagtagcagtagtcactggaagtgtgctagcctgctggagtggcaatgtggaggccaggagatcagtttgcagcgagtggtactcactcaccccaacaccccatcacaggaatatgatgaatccgggagcactatgagctcatctcttcacagtgatcaaagtcagggatttcaacctagcaaaaatgcctttgagtgtagtgagtgtggaaaagtcttctctaagagttcaactcttaataaacatcagaaaattcataatgaaaaaaatgcaaatcagaaaattcatattaaggagaaaagatatgaatgtagagaatgtgggaaagcctttcaccagagtacgcaccttatccatcaccaaagaattcacactggcgagaaaccctatgaatgtaaggaatgtggcaaggccttctcagtgagctcctcacttacgtaccatcagaaaattcatactggagagaagccttttgaatgcaacttatgtggaaaagcttttatccgaaatatacaccttgcccatcatcatagaatacatactggagagaaaccttttaaatgtaacatttgtgaaaaagcctttgtgtgcagggcacaccttaccaaacaccagaatatccacagtggagagaaaccctataaatgcaatgaatgtggaaaagcctttaatcagagtacaagtttccttcagcatcagagaattcacactggagagaaaccctttgaatgtaatgaatgtgggaaggccttcagggtgaactcttcccttactgaacatcagagaattcatactggagagaaaccttataaatgtaatgaatgtgggaaagctttcagggataattcatcctttgcacgacatcggaaaattcacactggagagaaaccttacagatgtggcttgtgtgagaaagcctttcgggaccaatcagcactagcccaacatcagagaattcatactggggaaaaaccttatacatgtaacatatgtgaaaaagccttcagtgaccattcagcccttacccaacataagagaattcatactagggaaaaaccttacaaatgtaaaatctgtgagaaagcctttatccgaagcactcacctgactcaacatcagaggattcacacaggagagaaaccctataaatgtaataaatgtgggaaagcttttaaccagactgcaaacctcattcagcatcagagacatcatattggagagaagtgatatgaatgcagtttgtatggaagacctttgagactgagtagatgaattattgaatgtgagataatccgttctagagaataactatgaaagcttgcatcaagatagtcactttatttactgagggtcaggtttcacagtgtcatggggtttgggcatttaagaatggcaaacactcggctgggcacggtggctcacgtctgtaatctttgggagcactttgggaggccgaggtgggcggatcgcgaggtcaggggatcgggaccatcctggctaacagggtgaagccccatcgctactagaaatgtagaaaattacccgggcatggtggtgggcgcctgtggtcccggctgctcgggaggctgaggcaggagaatggcatgaacccgggaggcggaggttgcagtgagccgagatcgtgccactgcgctccagcctgggcgacagagcaagactcagtctc

SEQ ID NO: 1380 - DNA, 1609 bp, Homo sapiens
ctttcccctgctaccagacacgcggtcacgtggggccatcgcgggctgccggcgcgggaagccgcgcgagaggcggccgaggggtgcgtgagtcggcgccactgcttgcagtgcgcggcttgggagcccgcccctcctgcacggaggagtcggcctgccgccgcggcggcatctggaaccacaatggacactgccagccatagccttgttcttctccagcagctgaacatgcagcgagaatttggttttctgtgtgattgcacagttgcaattggagatgtttacttcaaagcccacagagcagtgcttgctgctttttctaactatttcaagatgatatttattcaccaaacaagtgaatgcataaaaatacaaccaactgacatccaacctgacatattcagctatttgttgcacattatgtacacggggaaagggccaaaacagattgtggatcatagtcgtttggaggaagggattcgatttcttcacgccgactacctttctcacattgcaactgaaatgaatcaagtgttctcaccagagactgtgcagtcctcaaatttatatggcattcagatctcaacaacccaaaaaacagttgtcaaacaaggactggaggtcaaagaagctccttccagtaacagtggaaacagagctgctgtccagggtgaccacccccagttgcagttgtctcttgctattggtctggatgatggcactgcagaccagcagagggcctgtcctgccacccaggccctggaggagcaccagaagcccccagtttccatcaagcaggagagatgtgacccagaatctgtgatctcccagagccacccctcaccctcatcagaggtgacaggccccacttttactgaaaacagtgtcaaaatacacttatgccattactgtggggaacgttttgattcccgtagtaacctaaggcaacatctccatacacatgtgtctggatccctgccattcggtgtccctgcttccattctggaaagtaatgaccttggtgaagtgcatccccttaatgaaaacagcgaggcccttgaatgccgcaggctcagctccttcattgttaaggagaatgaacagcagccagaccacaccaaccggggtaccacagagcctttgcagatcagtcaagtatctttgatctccaaagacacagagccagtagaattaaactgtaatttttctttttcaaggaaaagaaaaatgagctgtaccatctgtggtcataaattccctcgaaagagccaattgttggaacacatgtatacacacaaaggtaaatcttacagatataaccgatgccaaaggtttggtaatgcattggcccagagatttcagccatactgtgacagctggtctgatgtctccctgaaaagttctcgcttgtcacaagaacacttagacttgccttgtgccttagagtcagagctcacacaagaaaatgtggatactatcctagttgagtagcagcttctctttcagaatttttataccaattctgaaaaagaaaatttgcgtggcatttttaattcataaattattttcctcctcaaaaaaaaaaaaaaaaaaaaaaaaaaaaaaaaaa

SEQ ID NO: 1381 - DNA, 1935 bp, Homo sapiens
ggagccccgaggggccggagctcctggcggtgccggatcctgacggcggccttcccccgggtctgtctgccaaaatgtctgaaagatcagatctccttcacttcaagtttgaaaattatggagattcaatgttacaaaaaatgaacaaattaagagaagagaataaattttgtgatgttacagttctcatagatgatattgaggtacagggacataaaattgtgtttgctgcaggttcccccttcttaagagaccaatttttactgaatgattccagagaggtgaaaatctccatattacagagttccgaagtggggagacaattgctcttatcctgttatagtggtgtgctggaattccctgagatggaactggtaaattacttgactgctgcaagttttcttcagatgagccacattgtagaacggtgcacacaggccctgtggaagtttataaagccaaaacaaccaatggatagtaaagagggatgtgaaccacagagtgcttctccccagtcaaaagaacagcagggagatgccagaggctccccaaagcaggactcaccttgtattcatccatctgaagacagtatggatatggaggacagtgatattcagattgttaaggtagaatctattggggatgtatcagaggttagaagtaaaaaagatcagaaccagtttatttcttctgaacccactgctttacattcatcagagccccagcactccctgataaattcaactgtggaaaacagagtaagtgaaatagaacaaaaccatctccacaattatgccctttcttatacaggcagtgataacatcatcatggcctcaaaagatgtctttggccctaatattcgaggtgtagacaaaggcctacagtggcatcaccagtgcccaaagtgtaccagggtgtttcgtcacctggagaactacgccaaccatttaaaaatgcacaaactctttatgtgtctactctgcggcaagactttcactcagaaaggcaaccttcatcgacacatgcgtgtgcatgccggaattaaacctttccagtgtaaaatctgtgggaaaaccttttctcagaagtgttccttacaggatcatcttaaccttcacagtggagataagccccataaatgtaactattgtgatatggtttttgcacataaaccagttttgaggaaacaccttaaacagctgcatggcaaaaacagctttgataatgccaatgagagaaatgtacaagacctcacagtggattttgattcttttgcatgtacaacagtcacagactctaaagggtgtcagccacaacccgatgcaacacaggtcctggatgcaggtaaactggcccaagctgtcctgaacttaagaaatgatagtacttgtgtgaattgagtaggggcttcatgctcacaactcgaactgactgacaatgtggcaatagtcttagtctttttaggagtgattttgctagtttgacttctccaaagcctctgtgtaggtggtagggagtgagtcaaagcactaatagaccaggcaacttaccacttggagtggatttgccttacttttgccctctcccattttctgttttgagttatttatcttgtaaagtctgttttcctttcccaaggaataattccttttgtctacctaacattgacttatgtcttagactgacactgttttaggcttttcactaggcacattccgaaggtaccaacaagttaataacatcacctactctccactaatagatgctatgctaagagaagtgaataatctttctttggtagaaaataggctgagatataaggtgatattgctattgacctgaaaatgtgatagaacttctggttgcctattgattattcctccatgtctgataaatgaatctgcttcctaaaaaaaaaaaaaaaaaaaaaaaaaa

SEQ ID NO: 1382 - DNA, 1123 bp, Homo sapiens
ggagctctaggtcgcctcttcgctactctgtgtcctctgctcctagaggcccaccctctgtggccctgtgtcctgtaggtattgggagatccacagccaagatgccgggaccccttagaagcctagaaatggaatcattgcaatttagagatgtggctgtagaattctctctggaggagtggcattgcctggacactgcacagcagaatttatatagggatgtgatgttagagaactacagacacctggtcttccttggtattattgtctctaagccagacctgatcacctgtctggagcaaggaataaaacctctgactatgaagagacatgagatgattgccaaacccccagttgtgtgttctcattttgcccaagacctttggccagagcagagcataaaagattcttaccaaaaagtgatactgagaaaatttgaaaaatgtggacatggcaatttacactttaaaaaaggctgtgaaagtgtggatgagtgtaagttacacaaaagaggttataatggacttaaccaatgtttgacaactacccagagcaaaatatttcaatgtggtaaatatgtgaaagtctttcatcaattttcaaattcaaagagacataaaagaagacatactgaaaaaaaacctttgaaatatatagaaggtgacaaagcttttaaccagtcctcaacccatactacacataaaaaaattgatactggagagaaaccatacaaatgtgaagaatgtggcaaagccttcaaccggtcctcatgcctgtaatcccagcactttgggaggccaaggtgggaggatcacctgatgtcgggagtttgagatcagactgaccaaaacggagaaacccagtctctactgaaaatataaaattggccatgcatggtggcacatgcctgtaatcccagctactcaggaggcttgaaccctggaggcagaggttgtggtgagtcgagatcattgcactccagcctgggcaataagagtgaaactctgtctccaggaaaaaaaaaaatttatttgtgtataactttaaaagcagatttttggaagcattgtaattacattaaaagtatacttgttcaaaaaaaaaaaaaaaaaaaaaaaaaaaa

SEQ ID NO: 1383 - DNA, 6098 bp, Homo sapiens
agatctcgcttccgccggtgggacggaactggtgccctccgtggacaattgtgttgaagcagaaattgttccggatctcgggtcggacacggaagtcttcctgcagtgtttctggatgcggggacagggatgcgcaggaattccagtctcagtttccagatggagcgacccctcgaggagcaagtccagagcaagtggtcgtctagtcaaggccgcacaggaacaggagggtctgatgtcctccagatgcagaacagtgaacaccatggacaaagcatcaagactcaaactgactccatctcccttgaggatgtggctgtgaacttcaccctggaggagtgggctttgctggatcctggccagaggaatatctacagagatgtgatgcgggcaaccttcaagaacctggcctgtataggggaaaaatggaaagaccaggatattgaagatgaacacaaaaaccagggaagaaatctaagaagtcctatggttgaagcactctgtgaaaataaagaagattgtccatgtggaaaaagcactagccagattcctgatcttaatacgaacctggaaactcctactggattaaaaccatgtgactgcagtgtgtgtggggaagtcttcatgcatcaggtctcccttaataggcacatgagatctcacactgaacagaaaccaaatgagtgtcacgaatatggagagaagccacataaatgcaaagaatgtgggaaaaccttcactcgcagctccagtattcgaacccatgaaagaattcacactggagagaaaccctatgaatgtaaggaatgtggcaaagccttcgcatttctcttttcctttcgaaaccatataagaattcatactggagagacaccctatgaatgtaaggaatgtgggaaggcattcagatatctcactgctcttcggcgccatgaaaaaaatcacactggagagaaaccctacaaatgtaaacagtgtggaaaagcctttatatattaccagccttttctaacccacgaaaggactcacactggagagaaaccttatgaatgtaagcaatgtgggaaagccttcagttgtcccacgtacttacggagtcatgagaaaactcatactggagagaaaccttttgtatgtagggaatgtgggagagccttcttttctcactcaagccttcgaaaacacgtgaaaacccacaccggagttcaaccttatacatgtaagaaatgtggggaagccttcaagtcatctagttcctgtgaagtgcacgaaagaactcattttggagaaaaaccctatgaatgtaaacaatgtggtaaagccttcaattcttcaagttaccttcagttgcacgaaagagttcacactggcgagaaaacttacgaatgtaaagaatgtggtaaagcctttctttattccactcactttcgaatccatgaaagaacccatactagagagaaaccctatgaatgcaaacagtgtggtcgggtcttcatttacttcagtcaccttcgaaggcacgaaagaagtcacactggagtgaaaccatgtgagtgtaagcagtgtggcaaagctttcacttgtttaaattccctgaaagtacacaaaagaattcatactggagaaagaccctttcagtgtagacaatgtggtaaagccttcagttactcaaagtctttgcacgtgcacgaaaggactcatagtagacagaagccctaagaaagtaaagtgtggtaatgctgtcagttgtattagttccttttggatgtatgagagtacttacgctggagagaaattcaaggaatgtaaacggtgtgattaagccttcagttgtcctaattccctttgaagacgtgactcatgcggcaatgaaatatttaacaaatgggggaggaacttgcactctcctgcgggattgcagatatgtgaatggactccatggacagaaaagctacgaatgtatggagtgtaggaaagccttcacttcacgtaatcttttaaagacacctgagaatatatactggagagaaactataaagaaaattctatatccatcccatcttttgtggggtttgttttttgtttttgtttttgttgagatgtaattttgctcttgttgcccaggctggagtgcagtggtgcgatcgcggctcaccgcaacctccgcctcccggattcaagcaattctcctgccgcagcctcccaagaagctgggattacaggcatgcgccaccacgcctggctaattttgtaattttagtagagatggggtttctccatgttggtcaggctggtctcaaactcctgacctcaggtgatctgcctgcctcggcctcccaaagtgctgggattacaggtgtgagccacagcacccaacctttttttccccgccgcaccccaagatggtgtctcactctgttgccccaggctggagtgcagtggtgtgatcctggctcactgtaacctctgggttcaagcaattcttctgcctcagccttccaagtagctgggattacaagtgcccaccaccatgcccagctaatttttatatttttagtagagacagtgtttcaccatgttgaccaggctgatcttaaactcttgacctcaaatgatccacccaccttggcctcccaaattgttcgttttacttttttttttttttttttttgagctggagtcttactctgttgcctaggctggagtgaaagtggcgcaacctctgcctcccaggtcaaagcaatcctgcctcaggccccctagtagctggcattacaggcacatgccaccacgcccaactaatttttatatttttagtagagacggggtttcaccatgttggccaggctggtcttgaactcctgacctcaggtaatccacctgccttggcctcccaaagtgctgggattacaggcgtgagccaccacacccggcccccagttctttttttttttttttgagacggagtccttgcccaggctggagtgcagtggcgcgatctcagctcactgcaagctccgcctcctgggttcacgccattctcctgcctcagcctcccgagtagctgggactacaggcgcccgccaccacgcccggctcattttttgtatttttagtggagacggggtttcaccgtgttagccaggatagtcttgatctcctgacctcgtgatccgccctcctcggcctcccaaagtgctgggattataggcgtgagccaccgcgcccggcctccagttcattttaaaaccatgaaaccacccacactggagagccaccttcttaaatgtaagcaatatgggaacatcttcaatgacatctgcaaccattgtcgagattcttcgtaggaagaattaaaggaatggggaagaaggacttgggccccagcaggccttttgtggcatccagtcagaagttaggaaacaccctctagggcagtgcctgccctcagctctcacacatgactggagagaagtgagaagactcccagaatctgccttttaagtttccatcagtgtcctcgggtcagactgtgggaatgctgtacttctaagacaaaggttcgcatcttacagtttttccccaagtgggatctgcctatgcacatcctaattcacagacattgtcagcattgcattattccagggctgttttgaggtcatctccagctccatttcccatctcaaacctacactttggacacttgtttaaacattcacatctgaatttctctgtggcaaccgcaggtggctctgaggtgagagactgaagaagcagagcctgtatcatgggacacacaccccttgaccacacagcatccactctcctgcggttaccagccctgcaccaaccaccacagtcagaataatctcaaaactgctagtggagtcacagacacactctgccatgtcttagctgtaggacactcagaattcttacctcccctaacttgctttccctgttttctggcacattctaccctgagatattcagcggcatatgcactgatgatgctccggccttctcacgtcagtgcatgtcacatgcatcctgctccaggactggtttcctagcctcccgctaagactagcacttagctcttcttggaaaaggacccaccctgcagcgctccagctctgttgtgtatgggaggtgctggtgtcagggttcacaagccatggaactaccttgcttcacatcacaaggcaaggtgaactcaactcccaataaactgcttgctggagcctccgaattctccgttttctgaattgcataggcacgataggggtcgggtctgtcctttgttggagtcagtccccccttttcttagcaagtcagtgtgttttagaagggaggtggcagcattgagggaaaccaggtcaccatccaccctcgtaacaacagtctccctgggtgggtcccagaagtgatctttgtgtcgctcgggtcggaactctttaggcctctggcctccaccctcccccaacagcagggatgggtcaggtggcagcatccaaaaccacggtgaagatactagggtccagaggccgactggagcaaggtttgctggcagatgaggcctcagtggaagtgacggctactgtggagatgcagtggaggacctggtggctgagccaggagatgcacaccttcgcttctctcaccaggaacattcgcttctctcaccaggaacatttatggtagtatgaggggttggaacattattactcaacccatttcaggtcctttcacattcttgagctgccatgttgtgcttttgtagagagatgattattgtactgtgggaggtcaggaagttcgagattccttcactgtcagaatgggctcaaggagccatcttttgtgataggtattggggaactaaggggtatctctgctacaggaatgggagtgagaacattcactttttgaaggacaagtatatgtgggtctatgatgatgtttttgtaaaacccttttgtgtatgtgtctgtgtgagtcctaatattcagtaagtattttcctctgtgtaactccctctaataggtgtagtcaacaaagctgtgctaatatctctgtccccttgatcctggcattctggaagacacgaaagcaagcaaggatatataaggcactgtggtggttattcccgaggagccagagaaacctggagaagagatcagaacacctggggtccttctatttgggagaatcttttagtatctgggctgttacacctgtgggtttgtgaatttgtgtctgtccacctgtatgtacagtgataacgtgtgtgatttttgtatatttgtctagagggctgtgtgtatatatatttatatatatttttaaatatggaatgcttttaggtttttttttttttttttttttttgagatggattctcactgttgccaggctggagtgcagtggcacaatcttggctcactgcaacctccacttctcaggttcaagcaattctcctgcctcagcctcctgagtagctgggactataggcgcgtgccaccacaaccagctaaatttttttgtatttttagtagagatggggtttcaccatgttgaccaggatggtctcaatctcctgaccttgtgatccacccacctcggtctccccaaagtgctgggattacaggcgtgagccactctgcctggctggttattttgtttgtttgttgtttttttgagacacagtctcgctctgtcaccaagctggactgcagtggcatgatctcggctcactgcaatctctgcctcccaggttcaagcaattctcctgtttcagcctcctgagtagctgggattacaggcgcgtgccaccataccgagctagtttttttatttttagtagagacggggtttcaccatgttggccaggatggtctcgccctcctgaccttgtgatctgcctgcctcggcctctcaaagtgctgggattagaggcttgagccaccaggcccggctggaatgcttgcattttcttgcctgatttccctgggagcaccccccttaacactgaatggagctggtgagagcaaatatccttgtttctgatattagatattaaaaatatggtttttcacc

SEQ ID NO: 1384 - DNA, 2823 bp, Homo sapiens
gttgctggggtccgttgcgttctgcatccagtccttgctgctccgagaggccccaggtgcctccgccacggctcctgtgacgctgtcacctgcgctgtgacctgctccggagtcataaagaggacgccgggacaccaagaagcagggaaatggacccagtggcctttgaggatgtggctgtgaacttcacccaggaggagtgggccttgttgaatcctttccagaagatctctacagagatgtgatgcaggaaaccttcacgaacctcatctgtatagaaattttatgggagagagactctttgagagtgcagaaggtagtcagtgtggagaaactttcacccaggttccggaagacatgctgaacaagaaaactcttcctggagtaaaatcatgtgaaagtggtacatgtggagaaatcttcatgggatattcatcctttaataggaacatcagaactgacactggacaccaaccacataagtgtcagaaatttttagagaagccatataaacataaacaacgtaggaaagccttgagccatagccactgctttcgaacacatgaaaggcctcacactagagagaaaccttttgattgtaaggaatgtgaaaaatctttcatttctcctgcaagcattcgaagatatatggtaacgcacagtggagatggaccttataaatgtaagttttgtgggaaagccttggattgtctcagtttataccttacccatgaacgaactcacactggagagaaacgatatgaatgtaaacaatgtggtaaagccttcagttggcacagttctgttcgaatccatgaaagaactcacactggggagaagccatatgaatgtaaggagtgtgggaaatcattcaatttttccagttcctttcgcagacatgaaaggacacacacaggagagaagccgtacaaatgtaaggaatgtgggaaagccttcaattgtcccagttcttttcacaggcatgaaaggactcacacaggagaaaaaccctatgaatgtaaactatatgggaaagcattatctcgccttataagctttcgaagacacatgagaatgcacactggagagaggcctcataaatgtaagatatgtgggaaagccttttactctcccagttcatttcaaaggcatgaaagaagtcacactggagagaaaccctacaaatgcaagcaatgtgggaaagccttcacttgttccacttcgtttcaatatcatgaaaggactcacactggagagaaacccgatgggtgtaagcaatgtgggaaagccttcagatctgccaagtacattcgaatacatggaaggactcacactggtgagaaaccctatgaatgtaagcaatgtgggaaagcatttcattgtgtcagctcctttcatagacatgaaaggactcacgctggagaaaaaccttatgaatgtaagcattgtgggaaagccttcacttgttccatatatattagaatacatgaaagaattcacactggagagaaaccttaccaatgtaaggaatgtgggaaagccttcattcgttccagttactgtcgaaaacatgaaagaactcacactattaatatatgagagaaatgctattttttaatttttattttaatagagacagggtctcactatcttgtccaggttggtcttgaactcctggcctcaagcatccctcccagcttgaagtgtcaataaaggaaggcaataaaatgtagagatggagttaggtgatgccacgctgggattcactggtggcctatcttacatatgatttcgaaggcagacatgaggaaggccttagtcacattttagagccagccaaattcacatgggctgtgtggccccctgattctagcccattttcctgattctctggcttgtcaatcaagagtatcctccaaatctcttgactttccttttttcagaggtgtaggtttccaaagatgtccccagaagctccacattcaagttctatctacagtttggtttttctttaagtattgtaatgtacataccagagagataatgcagactgtcatgggtggggaatgttctctgatgctcaactcccctagtctgcagattgagttggtaggaggtgtgatttgtttacatgcacctttgttcctgctggtagtgaccttgttcttgattcagcctgacagctactatgctgccatcagaaccaacttgatgagagctctgctgccctgtgcagtgactggtctcatccaggactctcatgtgagaaggaacaccttgctctggtcaggaaatgtccagtgtttcctgttatccacaggagaatgtaatgcctcagttcattttcagttatctttgattatatgtgattgacaatgtgtatttttgagggagcaaagatttctgtacatatttcttaaaaatagtttattcagctgggtgcagtggctcatgcctgtaaccccagcactttgggaggccgaggtgggcggatcacgaggtcaggagtttgagactagcctggccaacacagtgaaaccccatctctactaaaagtaccaaagttagccgggtgtggtggtggatacctgtaatcccagctactcgggaggctgaggcaggagaatctcctgaacctgggaggtggaggttgcagtgagccaagatcacgccactgtactccagcctggacaagagagcaatactctgtctcaaaaaaaaaaaaaaaggtttattcactgtttttcagttgtgtacttgcaaatgtttttctcttttttttgtatactgagaagctctattaaaatatcccttgtcaacatg

SEQ ID NO: 1385 - DNA, 4732 bp, Homo sapiens
gatgtggctgggccattgtttctctctgctgccggagctccaggtctacccttcactgctctgtgtcctcagcgtgtgtggcttcgtgacctgaagatactgggaaatccatagctaagatgccaggaccccctgaaagcctagacatgttatatgttctcattttgctgaagacttttgcccagggccaggcattaaagattcttttcaaaaagtgatactgagagaatatgtaaaatgtggacataaggatttacagttaagaaaaggatgtaaaagtatgaatgagtgtaatgtgcacaaagaaggttataatgaactaaaccagtatttgacaactacccagagcaaaatatttcaatgtgataaatatgtgaaagtctttcataaacttttaaattcaaatagacataacacaaaacatactggaaagaaacctttcaaatgtaaaaaatgtggcaaatcattttgcatgcttttacacctatgtcagcataaaagaattcatattagagagaattcttaccgatgtgaagaatgtggcaaagcctttatctggttttcaacccttactagacacaggagagttcatactggagagaaatcctacaaatatgaatgtggcaaatcttttaaccaggactcaaaccttactacacataagagaattcatactggacagaaaccctacaaatgtgaagaatgtggcacatctttctaccaattctcataccttactaggcataagctaattcatactagagagaaaccctataaatgtgaacaatatggcaaaacttttaaccaatcttcaacccttactggacataagataattcataatggagaaaaaccctataaatgtgaagaatgtggcaaagcctttagtattttctcaacccctactaaacataagataattcacactgaagagaaatcccacagatgtgaagaatattgcaaagcttataaggagtcctcacaccttactacacataaaagaattcatactggagagaaaccctacaaatgtgaagaatgtggcaaagcctttagtattttctcaacccttactaaacataagataattcacactgaagagaaatcccacagatgtgaagaatgtggcaaagcttataaggagtcttcacaccttactacacataaaagaattcatactggagagaaaccctacaaatgtgaagaatgtggcaaaacctttagtgtattctcaattcttactaaacataaaataattcatacagaagagaaaccctacaaatgtgaagaatgtggcaaagcttttaaacgatcttcaacccttactaaacataggataattcatactgaagagaaaccctacaaatgtgaagaatgtggcaaagcttttaaccaatcttcaacccttagtatacataaaataattcatactggagaaaaaccctacaaatgtgaagaatgtggcaaagcttttaaacgatcttcaacccttactatacataaaatgattcacactggagaaaaaccctacaaatgtgaagaatgtggcaaagcttttaatcggtcctcacaccttactacacataagagaattcatactggacacaaaccctacaaatgtaaagaatgtggcaaatcctttagtgtattctcaacccttactaaacacaagataattcatactgataagaaaccctacaaatgtgaagaatgtggcaaagcttttaaccgatcttcaatccttagtatacataagaaaattcatactggagaaaaaccctacaaatgtgaagaatgtggcaaagcttttaagcggtcctcacacctcgctgggcacaagcaaattcatagtgtacaaaaaccctacaaatgtgaagaatgtggcaaagcctttagtatattctcaacccttactaaacataagataattcatactgaagagaaaccctacaaatgtgaaaaatgtggcaaaactttctaccgattctcaaaccttaatacgcataagataattcatactggagagaaaccttgcaaatgtgaagaatgtggcaaagcttttaaccattcctcaaaccttattaaacataagctaattcatactggagacaaaccctacaaatgtgaagcatgtggcaaagcttttaggcggtcttcacatcttagtagacataagataattcatattggaattcatactgaagagactgtacaaaagtgaagaatgtggcaaaggcctttactgctcctattcccttactaaagaatgtggcaaagcttttcaccagtactttacccttaatacacataagataattaatgctggagagaaaccctacaaatgtgaagaatgtggcaaagatttctattgattctcataccttactaaatataagataattcatattggagagaaattctacagatgtgaagaatgtggcaaaggctttaattagttctcatcccttactaaacataagagaattcataccatagagaaatcctacaaatatgaagaatgtgacaaagcttttaaccacttctcaaccctgcctacacgtaagataattcatactggaaggaaaccctacaaatatgaggaatgtctcaaagctttttactgattcttataccttactaaacataaaataattcataaaggagataaattatacaaatgtgaagaatgtggcaaagcttttaacaaatcctcatccattagtaaacataagataattcatactggagagaaaacctacaaatgtgaggaatgtggcaaagcctttagcctgtccctccaatttactgcacataagataatttatactggagagaagccctacaaatgtgaaaaatgtggcaaaccttttaaccaatcctcaacccttactacacattagataattcatgctggagagaaaccctacaaatgtgaaaaatgtggcaaagcttttaaccaattttcaaaccttactaaacataagataactcatactggagaaaaatcttacaaatgtgaagaatgtggcaaagcctttatccagtcctcaactcctagtaaacataattaatgatggagagaaaccatacaactgtgaagaatgtggcaaagcttttaaccagtcctcaaactttattgaacaaaataattcatacaggagagaaaccctacaaatgtgaagaatgtgacaaagcctttaaccagtcctcaatttttactaaacataagaaaattcatactggagagaaaccctatgattgtgaaaaatatggcaaaggctttaactagtcctcagttcttaacacacatacgataattcttactgcagagaaactctacaaaccagtaagatgtgacagtgcttctgacaacatctcaaacttttctaatcataaaagaaatcatattggtgagaaatcctagaaatgtggagaatgtaacaaagtatttaaatggttgtcacacttgattataggtaatattcatattggaaaaatttcctacaagtaagaacaatgtggcaaagtttttaactaatacaccttattgcacagaaaatcatttatatttgagaaaaattgtagaaatatagactgtgaaaaagacgtcaatatctgctcacatcttactaaacaccagagagttcatgcttaataaaagcatgataagtgcaattactgccaaaagatctttcagaaaatattatcctttaaagtgaaggagagtatttatattaaagatgaacattacaaccataaagagggttgaagtacctttacttgtatcagatcttattgtccacattttgtactacagaaaaactctgaagaggtcactcaaactttgttcaacatcagggaatttatattggagagctgtcttgcaaatgtaataaatttgggaaaacaaattttcaaaaactacagcttagaaaacaccagagtttatacgaaaatatattttcaaaggtgtagtaaaaataaaaaaaattttaatccaaatttgtctatgtaaataccagaatttatagtagaaatatatgaggaagcgacacttcgaatattctactaaatgagagttctgagtatagaaaataaaactaaagttggtagaaaaattatttgtatataatgttaagaggagtaaaagattttttgtagaataataactatattcggattatactttgtttcttgaaaaaattacagattttttgaaaagcaaatgatgtaactcaactcattattttctgctgtttcttcattcttattcacttgtgaaagcttgtgatcatttgttgctgcatcagaggtatgagagattcttcttcattagatgggcattatttatgatcttttctatggatgagtaagaatattaaaatgtaagatgcatggtgaaaatctaagtggagaggttctttgtggttaacttatactattgagtgatgcacaaggtaggtgttaagagtaatattcttttgcattatgagaaaactagtatattattcatatattttactaattgtactttttttattatactttaagttttagggtacatgtgcacaatgtgcaggttagttacatatgtatacatgtgccatgctggtgcgctgcacccactaactcgtcatctagcattaggtatatctcccaatgctatccgtcccccctccccccaattgtacttttatataataaaatgcagtacattttaaaaaattttaaa

SEQ ID NO: 1386 - DNA, 2260 bp, Homo sapiens
ccttgtaattcataaatctctgaaaacttaaaagtttgagcaaaagtttgtcatgtttctatgagtaatttataataaaacttgatcagaatttgtgagactaacgtttgtctttatattttccttttttttttttttttttttgagacacagtctcgctctgtcgtccaggctggagtgccgtggcgtaatctcggctcactgcaacctctgcctcctggattcaaacaattcttctgcctcagcctcctgagtagctgggattacaggaccagtgatggtatagaacactgtattagagacatggagctggggctggatgaagattccatcagtaattcaatcaacagacaagtgttatccaatcacgtctttaaatcaatcactgacatggagctggggctggatgaagattccatcagtaattcaatcaacagacaagtgttatccaatcacgtctttaaatcaatcactgatcccagcccctataaaagggagcagccttaggaggcacatcagataaacccagtgtggaaagctagtcacacatcagctcagtgttcggcccgggattacccagtcaaccaaggagcttgcagttttaaagaatccaccaactgttgaaacaaatccctagagacacaaggcaagagactgaatcatcaaagtaaagtctctctgagaattattgctaagaatggctttagatctaagaaccatatttcagtgtgaaccatccgagaataatcttggatcagaaaattcagcgtttcaacaaagccaaggacctgctgttcagagagaagaagggatttctgagttctcaagaatggtgctcaattcatttcaagacagcaataattcatatgcaaggcaggaattgcaaagactttataggatctttcactcatggctgcaaccagaaaagcacagcaaggatgaaattatttctctattagtcctggagcagtttatgattggtggccactgcaatgacaaagccagtgtgaaagagaaatggaaatcaagtggcaaaaacttggagagattcatagaagacctgactgatgacagcataaatccacctgccttagtccacgtccacatgcagggacaggaagctctcttttctgaggatatgcccttaagagatgtcattgttcatctcacaaaacaagtgaatgcccaaaccacaagagaagcaaacatggggacaccctcccagacttcccaagatacttccttagaaacaggacaaggatatgaagatgaacaagatggctggaacagttcttcgaaaactactcgagtaaatgaaaatattactaatcaaggcaatcaaatagtttccctaatcatcatccaggaagagaacggtcctaggcctgaagagggaggtgtttcttctgacaacccatacaactcaaaaagagcagagctagtcactgctagatctcaggaagggtccataaatggaatcactttccaaggtgtccctatggtgatgggagcagggtgtatctctcaaccagagcagtcctcccctgagtctgcccttacccaccagagcaatgagggaaattccacatgtgaggtacatcagaaaggatcccatggagtccaaaaatcatacaaatgtgaagaatgccccaaggtctttaagtatctctgtcacttattagctcaccagagaagacacaggaatgagaggccatttgtttgtcccgagtgtcaaaaaggcttcttccagatatcagacctacgggtgcatcagataattcacacaggaaagaagcctttcacatgcagcatgtgtaaaaagtccttcagccacaaaaccaacctgcggtctcatgagagaatccacacaggagaaaagccttatacatgtcccttttgtaagacaagctaccgccagtcatccacataccaccgccatatgaggactcatgagaaaattaccctgccaagtgttccctccacaccagaagcttcctaagctgctggtctgataatgtgtataaatatgtatgcaagtatgtatattcctatagtatttatctacttaggatataagatataatctcctgattatgctttcaatttattgtcttgcttcattaaaatgtaaggctaaggagagcatggaatttgtcagttttgttcactaaagtattccaagtggttgggaaagtggaacatttccaagaaccaataaatttctgttgaataaatgaatgaatccaaaaaaaaaaaaaaa

SEQ ID NO: 1387 - DNA, 1938 bp, Homo sapiens
cccagaccgagaaggtcggaggcagaagccgggaaggagacttctgaatgaacagtgaatctattactgaggaaaaccagaggaagcctgtgtagataggtatcaattagataccagctactggaagagctttctcagagactgattaaaaaattctccactagatatggctgcaaattgcacatcctcatggagtctaggagaatcctgcaacagacctgggttggagctgccacggtctatggcatcctcagaaactcaacttggaaatcacgacgtggaccctgagatttctcacgtgaacttcaggatgttcagctgcccgaaggagtcggaccccatccaggctctgaggaaactcactgagctgtgccatctgtggctgaggcccgacctccacaccaaagagcagatcctggacatgctggtgatggagcagttcatgatctccatgccccaggagctccaggtcttagtcatgatgaacggtgtgcagagctgcaaagacctggaggacctgctacgaaataacagaagacccaagaaatggtctgtggtcaccttccacggaaaggaatatattgtgcaggactcagatatcgagatggctgaagccccctccagtgtcagagatgatctgaaagacgtgtccagccaacgggcctcctcggtgaaccagatgcgtccaggggaaggccaggcccaccgagagctgcagatcctgcccagggtccctgcattgtccaggaggcagggagaggactttctgctacacaagagtattgacgtaacaggtgacccaaagtctctgagacccaagcagaccttggagaaggatctgaaggaaaacagggaagagaacccaggactgacatccccagagcctcagcttccaaagagtcccacagatctggtgagagcaaaggaggggaaggaccccccaaaaatagcctctgtggaaaatgtggatgctgacacaccttctgcctgcgttgtggagagagaagcttcgactcacagcgggaacagaggagacgctctgaatctgagcagtcccaaaagaagcaaaccagatgcctcctccatttcccaagaagagcctcaaggagaagccacacctgtgggcaacagagaatccccgggacaagctgggatgaattcaattcattccccaggccctgcgagcccagtcagtcacccggatggccaagaagccaaggcactgccgccctttgcatgtgacgtgtgcgagaagaggtttacgtgtaattccaagctagtcatccacaagagatcacacacaggcgagagactctttcaatgtaatctctgtgggaagcgcttcatgcagcttattagcctccaatttcaccagcgaacccacactggcgagaggccctacacgtgtgacgtctgccagaagcagttcacccagaagtcctacttgaagtgtcacaagagaagccacacaggggagaagcccttcgaatgtaaagactgcaagaaagttttcacctacagggggagcctgaaggagcaccagcgcatccactccggagagaaaccctacaaatgttccaagtgtccaagagccttcagtcggctgaaattgttaagacgccaccagaaaacacatccagaagctacttctcagtgattgcataatccggtctatgccttctgcaccaagaagaagtgaatgatatttttcatcaatgttatcagatgacatttgacacatgcaagggcgtctgacacacagagggagtgccctagatatgaattgccaggatgtttgagtaaatatgtgtcctccccactgagctttgttttctgtttcattatgtccattgttttcttataggtttattttggtttgtgttgctgttcttccaataaacgatcatcttattagttttcaaaaaaaaaaaaaaaaaa

SEQ ID NO: 1388 - DNA, 2453 bp, Homo sapiens
ggcccgcgcccggcctccgcggcgccgcctcccagcccagagcccagcgctcaggaaggtgcgggcgggggagaaagcaacaccattgtttttcaggcgcctccatttgcccccgagccgagccgtggctttccggatgatcgggagacgcggtctggacgggccgggaaaggagccgggcgcctgcggagaccccgcctcagcgagtacgcccggccgggcgggctgggaggatgaggacggctgccctggacttccgccgccacaggagggttttcggccggacgccgggagggagctccaggctgtgagctccatttgtaaaggtcttaataacaagaacagtgacttcggctccggagcttcaagatagtggcctgcttggcctgcccatctcggatctctccaggaggacccagccacccaagggtcgtcttctgctgctgacccccatcaaatcccatcatgcccacagccctgtgcccccgagtcttggctccgaaggaaagtgaggagcccaggaaaatgaggagcccacctggagagaaccctagcccccagggggagcttcccagccccgagtcctctcggcgtctcttccgccgtttccgctaccaggaggcggcgggcccccgggaggccctgcagcgcctctgggacctgtgcgggggctggctgcggcctgagaggcacaccaaggagcagattctggagctgctggtgctggagcagttcctggccatcctgccccgggagatccagagctgggtgcgggcgcaggagcctgagagcggagagcaggctgtggccgcggtggaggcactggaacgggagcccgggagaccctggcagtggctcaagcactgtgaagaccctgtggtgattgatgatggggacagccctctggaccaggagcaggagcagctgccggtagagccccacagcgaccttgcaaagaaccaggatgcccagcccataaccctggcacagtgcctggggctcccaagcagaccaccaagccagctcagcggggacccagttctgcaagatgctttccttcttcaggaagagaatgtgcgggacacacagcaggtgaccaccctccagctacccccgagtcgggtttctccattcaaggacatgattttatgcttctctgaagaggattggtcccttctagatcctgcccagactggcttctatggagagttcatcattggggaggattacggggtctcaatgcctccaaacgacctagctgcccagccagatctctcccagggagaggagaatgagccacgcgttccagagttgcaggatctccagggcaaagaagtgccccaggtctcctacttggactctccaagtctccagccattccaggtagaagaaagaaggaaacgtgaggagctgcaggtgccagagttccaggcctgcccacagacggtggtgcctcaaaacacctacccagctggcggcaacccgcgatctctagagaacagcctggatgaagaagtgaccatcgagatcgttctctccagctctggggacgaggactcccagcatggcccgtactgcacagaagagctggggagccccacagagaagcagcgcagcctccccgcctcccaccggagcagcaccgaggccggaggcgaggtgcagacctccaagaagtcctacgtgtgtccgaactgtgggaaaatcttccgctggagggtcaacttcatccggcatctgcggagccgcagggagcaggagaagccgcacgagtgctcggtgtgcggggagctgttcagcgacagcgaggacctggatgggcacctagagagccacgaggcccagaagccttaccggtgtggtgcctgcgggaagagcttccgcctgaactcccacctgctctcccaccggcggatacacctgcagccggacagactccagccggtggagaagagagagcaggcggcatccgaggacgcggacaagggtcccaaagagccgctggaaaacggcaaggccaaactgagcttccagtgctgtgagtgtgggaaggccttccagcggcacgaccacctggctcggcaccgcagccactttcacctgaaggacaaagcccggcccttccagtgccggtactgcgtcaagagcttcacgcagaactatgacctcctccgccacgagcgcctgcacatgaagcgccgttccaagcaggctctgaactcctactgagcctctccgcctggggcggcctcaccctggctggtgctgccccctcaccttggtactgatcagcgcccccacccaggacataccttccccaggatagagagcacacctccctcctgtccttgctctcaggtagtgagcgttcgggtggtgccatgggagcactctccctcccccaggtaatgaaagagtggccaagtgaaaaaaaaaaaaaaaaaaaaaaaaaa

SEQ ID NO: 1389 - DNA, 3466 bp, Homo sapiens
accattccacgcggctcgagcccgcgtgcgggcctctttcaggccgctcctagtggacgcagaggcgggccgaggacggtgccagcccccaggccccaagaggagctggtccccaggacagaggagggagaggagcaagaggctcccctgggccccttccaggccccacctccaggtcacaggcgcgagatggagtccccaagagggtggaccctgcaggtggccccagaggaaggccaggtcctctgcaatgtgaagactgccacgaggggcctctctgagggggctgtgtctggaggctggggggcctgggaaaactccacggaggttccgagggaggcaggggacggccagcggcagcaagccacactgggggcggcggacgaacagggaggccccggcagggagctgggccccgcagacggtgggcgggacggggctgggcccaggagcgagcctgcagaccgggcgttgcgcccttcgcctctcccagaggagccgggctgccggtgcggggagtgcggcaaggcgttcagccagggctcttacttgctgcagcatcggcgcgtgcacacaggcgagaaaccgtacacgtgccccgagtgcggcaaggccttcgcctggagctccaacctcagccagcaccagcgcatccacagcggcgagaagccctacgcttgcagggagtgcggcaaggccttccgcgcgcaatcgcagctcatccaccaccaggagacacacagcggcctgaagcccttccgctgcccggactgcggcaagtccttcggccgaagcaccacgctggtgcagcaccgacgcacgcacacgggcgagaagccctacgagtgcccggagtgcggcaaggccttcagctggaactccaatttcctggagcaccggcgcgtgcacacgggcgcgcggccgcacgcctgccgggactgtggcaaggccttcagccagagctccaacctggccgagcacctgaagatccacgcgggcgcacggccacacgcctgtcccgactgcggcaaggccttcgtgcgtgtggcggggctgcggcagcaccggcgcacgcacagcagcgagaagcccttcccctgcgccgagtgcggaaaggctttccgcgagagctcgcagctcctgcagcaccagcgcacgcacactggtgagcggcccttcgagtgcgccgagtgcggccaggctttcgtcatgggctcctacctggcggagcaccggcgcgtgcacacgggcgagaagcctcatgcgtgcgcccagtgcggcaaggcctccagccagcgctccaacctactgagccaccggcgcacgcactcgggcgccaagcccttcgcctgcgccgactgcggcaaggccttccgcggcagttccggcctggcgcaccaccggctttcgcacacgggagagcgacccttcgcctgcgcagaatgcggcaaggccttccgcggcagctccgagctgcgccagcaccagcgcctgcactctggcgagaggccgttcgtctgcgcccactgcagcaaggccttcgtgcgcaagtcggagctcttaagccaccggcgcacgcacacgggcgagaggccctacgcttgcggcgagtgcgggaagcctttcagccaccgttgcaacctcaacgagcaccagaagcggcacgggggccgcgctgcgccctgacccgaggacgccctgagcgggaggtcgcggacacacggcattgcggggtctcgggcgtgagtgcgctgtctgctggcccagactttttcgggccgccggtgcgggcgccctcctgctgggagtgcaggggcggccttgggtgtggagaaccctggccgcacagtccctttgacgatagtccaccggccacccaggcctgtctggggacatgtaggatgggctcttaccccagggagggcggcaggctccacttcggcgagaggttcgtccatgcagaggtgggcaagaactggggtctccgacaggtgtggctatttctttgagttctctggcactgtcaaaagcagccaacccaccccccagtccacatggtcaccactgctgctaccagctgctcagtgcagtggccactgtgtctcctaaggtgctcgcttcagtcagcacttcatctcaggcaaccacaggtgacagttaaacatgatgaaaccgcatgctatggctttctagtgtctcatattctgttggcaagaagctcagcactgcattcctgaccgaggtcagaaccagatcaatctcagaatctcacctgtgtaggtctgtttcatgggacttttcttttttgggggagggggcagggtttcactctgtcacccaggctggagtgcagtggtgcaatcactgtttattgcagccgcgacttcttaggctcaggtgatcctcccacctcagcctcccaagcagctgggatgacagacttgcgtcactacacctggctaattttaaaattttttgtaaggacagtgtctcaccatgttgcctaggcgggtctcaaaactcctgggctcaagtgatcctcctgcctcagcctcccaaagcgttgggattataggcgtgagccaccgcacctggccagggaaccttctttataccaagtaccacaccagtcagagtcaagtcaggaaatagaaaccacactaggtatttcaaacagaggggatataagttagggactgattgtgcaggttttgcaaggctcagagagcaaaagtggatgttgcagaatctcagagctggatacttgcaggaagctgctaccacccttagggctggagaacccagggaagctaagaggagggtgcaacgaggctggtgttgggactgccaaaggaaacacagaatgacagctccatctctgcagacctcagatttgaccaggcctctggctgcctgggcagcctcattgccaatgggctgaaaggttctgtcactgttcagtggtctgacttctgagttctgtgcacaccctgagctctgctcctctggcctggccaccagtccttgtctgagtgccccaggtctggttatgacttcaggcctcagcacctggttgtctcttctgcaaagaatgcattctcccccagtccacccagaacacacagcctccatccaggtattggctctgagcaggacagagagcatgcagcaggtgctcagcaatatggaaatgggaccaaacagagggagtctccacagctccccgtccctcacagcagaagccagagccgctgcagtgcccagctggtcttcatcacgtctatgagctctgcaatcgctctgcagtcgcctcaactcctggtctcctctgctccttctcactgcacccgcatctcccatgtttgcactggctgttccctctgcctggaatgctccttacccagttatcccactgtcttctttgcatctggcacacagtagatgctcaataaatgcctgtggaatg

SEQ ID NO: 1390 - DNA, 4359 bp, Homo sapiens
agctcacttccggaccgcggatagcactggcgaccctagcgggtgagaggcccttcagggccgcggcgggttgagcgcaccatcacatctaagccatcagcaagtttgttggttttaatctccaaaatacgtcttgattttgtctgactctttgccaccaccctgatctaagcccttatcatctgcttgaatcactaacttgtctccacttgcagtttttaaaagagttgcttccatttgactttttctgtctgctgtaccagcatatgagtttcaggaggggtcattgatgcagtcattctcagtctcctcggagggagtctgaagatgcttaaagagcatccagagatggcggaagctcctcagcagcagttgggtattcctgtggtgaaactggagaaagagttgccatggggcagaggaagggaggaccctagtccagagacttttcggctgaggtttcggcagttccgctaccaggaggcagctggaccccaggaagctcttagggagctccaggagctctgtcgtcggtggctgaggcccgagttgcacaccaaggagcagatcctggagctgctggtgctggagcagttcctcactatcctgccccgcgagttctacgcctggatccgggagcatggcccagagagtggcaaggccctggccgccatggtggaggacctgacagaaagagcactggaggccaaggcggttccatgccacaggcagggagagcaggaggaaacagcactttgcagaggcgcttgggagccaggcatccagctggggccagtggaggtcaagcctgaatgggggatgccccctggggaaggagttcaaggtccagacccaggtaccgaggagcagctcagtcaggaccctggagatgagacacgggccttccaggagcaagcactacctgttctgcaggcgggtcctggcctccccgcagtgaatcccagagaccaagagatggcagctgggttctttactgctggatcgcaggggttggggccatttaaagatatggccctggccttccctgaggaggagtggaggcatgtgaccccagcccagatagactgctttggggagtatgtggaaccgcaggactgcagggtctctccaggcggtgggagcaaggaaaaggaggcaaaacccccacaggaagacctgaaaggggcgctggtggcactgacatcagagaggtttggggaagcctctctccagggccctgggctcggaagggtctgtgagcaggagcctggtggccctgcaggcagtgcgcctgggcttcctcctccccagcacggtgccatccccctgcctgacgaagtcaaaacccacagctccttctggaagcctttccagtgccctgagtgtgggaaaggattcagtcggagctccaatctcgtcaggcaccagcgaacccacgaagagaagtcttatggctgtgtggagtgtgggaagggctttaccctgagagaatacctgatgaagcaccagagaacccacctgggaaagaggccctacgtgtgcagcgagtgctggaaaaccttcagccagagacaccacctggaggtgcaccagcgcagccacactggggagaagccctacaagtgcggggactgctggaagagcttcagccgcaggcagcacctgcaggtgcaccggaggacgcacaccggggagaagccctacacctgcgagtgtggcaagagcttcagcaggaatgccaatctggcggtgcaccggcgtgcccacactggcgagaagccatatgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaactgttataattaaaatgagtctgaaagatgaactctagtattaatgccctatatttgatggcactttatagttcataaaattaatttcaccccattctcattggacccatttcccaagtatttattgaggccctgtaacaaacatgtcaggaactcttctgggtgcttgagacacatccatgaataaaatagggggagaagctgttgacctcgtagagcttatgtctcgtggatgtacctgatcttcagaacccgtggatattcctgcaaatcctctgggcctgtattcattgctttgtcagcatcttgccctgaaatgcatttgtcacctacctcttgttactaaatggtctctgccctccagacccttgtcatccaaggcactaggggtcctggacacccactggggatgatgagctggtagcgacctgttttgcatgagtgccaagtcaggaaaaataaagatatttgtaggcattaaaaaaaaatacatttctttaaaaatgagaagatgcaatatttgtaaactgttgaagcttccttattgtgccatcacttaagggtttcatttctgtttaaagttctggaagctgcataactagcgtggactgactgctgtgtcattgtgctgtgcctttgaaccctggctgagtgagtgagtttgtcctttgttgatagtgtcctataattgcaaaatgtggtttgtcttctgatgcctcttaataccagattcttttactgagatttttttttttcattttccattgtaaataaggtaaatggtaatgactaacacaaagctgtattactcagcccactttgaaacgtggttttatcacctgttcttgttaggcagcatggtgtctaattttggcttagcaaatgacgctccttggtcttcctggctcattagctgtgcccacgaggctgcactgactgggtcgtaaatgtatctgagatgtccacacggggctgctgctgctcctctgtaatactgaggtccacatgcaaaatcagctttttttcccccgtaattatcagagcagctaggcagggctgacagccaggcagactcagtgggaggcttctggcctgagtgtggccttccccagagggtggttttccaaaggcaggtggggactggggaggcctcggggggctgcttgtcattacctgaatcacagatgctcttttgtcatacacagccagcattcctctgggtttcagcaagttggcatatcttaagcttcagaaggagctgggccttgctgactttcctatctggcctcttccctatctcctgtggggccaagagcttaggacagtgtctcagaaaagcctctaagtagggggtttttcccatgggattgtggtagtctgatttttcatatctattcaaatgttaagaaatattttgttttctgtatttttctattctttagaaatttttttataatagataatttcaaacctatataaataaatccttatgtatttatcatttgactttattataaactcataatcaatcttaaaaaaaaaa

SEQ ID NO: 1391 - DNA, 3288 bp, Homo sapiens
accattcttccggtttcagaagttaaggctggtgtcctggccccagtccacctctgggagcgcctgcgccgctccgcggagagtccgtggatctcacagtgaaaaatgtttgctgacccttgacattgacaaactgctgacagctcagatgatccatgattggaaggatgtggtcatcaccaagatgtctttctttctccggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtgggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagccaaaaaaaaaaaaaaaaaaaatccatatccattcattaaaaaaatgagatataaagcaacaactgggctgacctctatagatctgccagtaaagaaggctttctttcattatcagggtgaaggtctttcctgattcttccaagctttgaggtgactcagagctaagaatgaaataggagaccaagttagaattcatgatactggtttatggggaggcagtcatacctgttcagagaaccaggaagactcaatatctatctcagaggaaatatggttacccaggaaagaaatggtctgctagagtgataagactcagaacaggaagcctgcatgtgactgagcaagtcacctacataaccctgcctgtactaaggtgtacacctgtctattgtaagtttgcctaggctgttggtgtacagagaccagaggagagagacacactaggactaacaatgtcctaacaaaatggtacttagtttgttggtctttaggagaaagcattagtaatgaaagaagaaagaattttcacttggttggacattggggctgcttaagaaagttgacatttgtcgtggaatgactttggaaagacttctaaaagaatctttttcaaatccctgaaaatcaggatagcacattttgctactgactgtgacagtgttttattcttttgagagaaatgacatagttttccctttatttcccaaattcctttcatgttcttaactgctacccagaaattgagcttcagaagattgaggatagcctttgattggtatttaaaataatttctaagctgtgaagcttatagcatttttaaagtatggctattaaaaacactaagttgattctggaaaaaaaaaaaaaaaa

SEQ ID NO: 1392 - DNA, 3198 bp, Homo sapiens
gctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgagctcgatgccaagaagagcccgctggcgctgttggcgcaaacatgttcgcagatcgggaagcccgacccctcgccctcctccaaactctcctcggttgcctccaacgggggcggcgcgggcggtgccggcggcggtgctgcgggcgacaaggacaccaaatcgggccccctgaagctgagcgacatcggcgtggaggacaagtcgagtttcaagccgtactccaaacccggctcggataagaaggagccgggaggcggcggtggaggcggtggcggtggcgggggcggcggcgggggtgtttcgtcggagaagtcgggattccgggtaccgagcgccacctgccagccattcacgcccaggacaggcagcccgagctccagcgcctcggcctgctcgccgggaggtatgctgtcctcggccgggggtgccccggagggcaaggacgacaagaaagacaccgacgtgggcggcggtggcaagggcaccgggggcgcctcggccgaagggggacccacggggctggcacacggccggattagctgcggcggcgggattaatgtggatgtgaaccagcatccggatgggggcccgggaggcaaggctctgggctcggactgcggcggttcatcgggctccagctccggctccggccccagcgcgcccacctcctcctcagtgttgggctctgggctggtggctcccgtgtcaccctacaagccgggccagacagtgttccctctgcctcccgcgggtatgacctacccaggcagcctggccggggcctacgccggctacccgccccagttcctgccacacggcgtggcacttgaccccaccaagccgggcagcctggtgggggcgcagctggcggcggccgcggccgggtctctgggctgcagtaagccggccggctccagccctttggccggagcgtctccgccgtccgtgatgacagccagtttgtgccgggacccttactgcctcagctaccactgcgctagccacctggcaggggcggcggccgccagcgcttcttgcgcacatgatccggctgctgcggctgcggcgctgaagtccggatacccgctggtgtaccccacgcacccgctgcacggtgtgcactcctcgctaacggccgccgcggctgctggcgccacaccgccctccctggccggccaccccctctacccctacggctttatgctccctaacgacccactcccccacatctgcaactgggtgtcggccaacgggccgtgcgacaagcgcttcgccacgtccgaagagctgctgagccacttgcggacccatacggcatttcccgggacagacaaactgctgtcgggctaccccagctcgtcgtctctggccagcgctgccgcggccgccatggcttgccacatgcacatccccacctcgggcgcaccgggcagccctgggacgctggcgctgcgcagcccccaccacgcgctgggactcagcagccgctaccacccctactccaagagcccgcttcccacgcctggcgcccccgtgccggtgcccgccgccaccggaccgtactactccccctacgccctctacggacagagactgaccaccgcctcggcgctggggtatcagtgagggcggccgggagggcgagcgagggagaggagggagagggggaggggaggagtccagggagaggcgggatcacggcccaggctgctgacacccgcgcgtggggaggactcgggccacgaaaggaaagaaatgtataccgtatctatctacccgacagcagcgaccgagacccggtgggacactccccttctccccactttcacctccccacccaaactttataaaagttgaaaaaatatcatttgactttttatagaaaaaaaaaggaaaaaataattgagaaagtgttcatctgaggactgcatcggtggacactggtatttatttatgttagctccaagcggaccggtggttcaaaagtgcattatttagtttgagctctgtaggtaaaaaggaggtgggaaaaattttaaaacttgagggtaaaaatgtggaaaacaaaccctcccatcccttgtagattataaataaaagcaaaaccgccacagaactagaggtcttctctttaatgttactttaaaattgctatgattgtattgtacgttatttaatgtctgattgaaacacaaatttacatgcatgtttgttacaaaaaaaatgaaaaaaaaagtcacaatttgtcagctctgatttcaaattgcaattatttttaaggtgtataccatcgaagagaatgggtatttttttgtatgtattctggaagaaaacaacaaaaaaaaaaagaaaaagaaaaaattctattccaaaacctcatttgccttattttgttctttaaaaggaacacttaactatttttaatttttaagtccacccgctgagaaggggacaaggtttacgtcatgtactaaaataatagacaatgtatcgctttaaagattaaaattccgtatatttgatgtattaaaaaaaaaaaaaaaaaaa

SEQ ID NO: 1393 - DNA, 2960 bp, Homo sapiens
agtggaagtgacgccaacggaagcaggaaggcggttccggcaagccaagggggcgttgtcgtgatgattccgcggccagcggatcgctgcgagtggccttgaaggcagctgctgcaggtgaagagtaggcggcggggcagagagcggcctccgagggtcacctgaatggttgagcatggaccctgttgctacccacagctgccatctgctccagcaactgcatgagcagcgaatccaaggcctgctttgtgactgtatgttggtggtaaaaggagtctgctttaaagcgcataagaatgtcctggcagcattcagccagtattttaggagcctctttcagaattcttcaagccagaagaatgatgtttttcacttggatgttaaaaatgtcagtggcatagggcagatcctggacttcatgtacacttctcatctagatcttaaccaggacaatatacaagtaatgctggacacagcacagtgtttgcaagttcaaaatgttctgagtctgtgtcacacatttttaaaatcagccactgtagtacagccacctggcatgccttgtaatagtacattgtctctacaaagcaccctgaccccagatgccacttgtgttatcagtgaaaactacccccctcatttactgcaggaatgttcagcagatgcacagcagaacaaaacgttggatgaatcgcatccgcatgcttcaccatcagttaatcgtcatcactccgcaggtgaaatctcaaaacaagctcctgatacttcagatggcagctgcacagaactgcctttcaaacagccaaattactattacaaactcagaaacttttacagtaagcagtaccataaacacgcagctggtcccagtcaggagagagttgttgagcagccttttgctttcagcacctctacagaccttaccacggtagagagccagccttgtgccgtcagtcattctgaatgcatcctggagtctcccgagcacttaccttccaacttcctggcccagcctgtgaatgactctgccccacaccctgagtcagacgccacatgccaacaacctgtcaagcagatgaggctcaaaaaggccattcatctgaagaagctcaatttcctgaagtcacagaaatacgcagagcaagtatctgaacccaagtcagatgatggtttgacaaagaggttggaatctgctagtaaaaataccctagagaaagctagcagccaaagtgctgaagaaaaagaaagtgaagaagtcgtcagttgtgagaattttaattgcattagtgagacggagaggcctgaagacccggctgccctggaagaccagtcccagacacttcagtcccagagacaatacgcgtgtgaattatgcgggaaaccttttaaacacccaagcaacttggagcttcacaaacggtctcatacaggtgagaaaccttttgaatgtaacatttgtgggaaacatttctctcaggcaggtaacttgcagactcacttacgacggcattctggtgaaaaaccatacatctgcgagatctgtggaaagaggtttgcagcctctggcgacgtccagcgtcacattattattcactcaggagaaaaaccacacttgtgtgacatctgtggtcgagggtttagtaacttcagtaatttgaaggagcacaaaaagacacacacggctgataaagtcttcacctgtgatgagtgtggaaagtcttttaatatgcaaaggaagttagtaaagcacagaattcggcacacgggggagcggccttacagctgctctgcctgcgggaaatgttttgggggatcaggtgacctccgcaggcatgtccgcactcacactggggagaagccgtacacatgtgagatctgtaacaagtgctttacccgctctgcggtgctccggcggcacaagaagatgcactgcaaagctggtgacgagagcccagatgtgctggaggagctcagccaagccatcgagacctccgacctcgagaaatctcagagctcagactctttctcccaagacacgtctgtgacgctgatgccagtgtcggttaaactccctgtccacccagtggaaaattctgtggcagaatttgatagccactctggcggctcctattgtaagttacggtccatgatccaacctcatggagttagtgaccaggagaagctgagtttggatcctggtaaacttgccaagccccagatgcagcagacacagcctcaggcctatgcttactcggatgtggacaccccagccggtggcgaaccactgcaggccgatggcatggccatgatccgttcctctctggctgctttggacaaccacggcggtgaccccctgggcagtcgagcatcttccaccacttataggaactcagagggtcagtttttctccagcatgactctctgggggctagcgatgaagacgctgcagaatgaaaacgagttagaccagtgatgtaccgcgcttctccacggtagaggcgtgttctcagtttagcaggctggtgttaaggctgtaggaggacccagtttccccatgacagtgccttctaactagccagagaataggtagcttccctcctgatgatggctcataatctgaagcatcttgagctgggggtgtgagggggagggcctgctggctcaccgtgaggcagccgcgggagggagcgctgacgtcacagaagcgaaggcttgatgctgtctcagcagcctcagctgtgggggggaagcgcgtgtgcatcgtgtcaactactgtacatgttggtcatgtgaaaggaattatatatgtatagtattacaagtatttttgcatttttacaagattgaaatttgtagcattttgtattatttacacagaatttatttgtatatgaaactcataccataatttaattcgaataaatgaaacttttctatatattaaaaaaaaaaaaaaaaaa

SEQ ID NO: 1394 - DNA, 2148 bp, Homo sapiens
ccatgaatggaagcggcggcggcggcgggagcggcctgagctgggcgccggggccagggccgggggctgcccagggcccgcgccgctgcatgggggcggcccgcgggccctgagaggaagggcagacaggcgggccgagataggaggggcggggtcgggcggccgcaggccggaggcgcgtcgggctggagccggtcacgatgccccgaaggaagcaaagccacccgcagcccgtgaaatgcgagggggtcaaagtggatactgaagactccctcgacgaaggacccggggccctggtattggagagtgatttgctactaggccaggatctggagtttgaggaggaagaggaagaggaggaaggcgacggcaacagtgaccagctcatgggcttcgagagagactcggaaggagactctctgggggccaggcctgggcttccctatgggctgagcgacgatgagtctgggggcggccgggcactaagtgcggagagtgaagttgaggagccagccaggggtccaggggaggccaggggtgagaggccaggcccagcctgccagctgtgtggggggccgacaggtgaggggccgtgttgtggggcaggagggccgggtggggggcccctgctgcccccacggctactgtactcatgccgcctctgcaccttcgtgtcccactactcgagccacctgaagcggcacatgcagacacacagcggagagaagccgttccgctgtggccgctgcccctacgcctcagcccagctcgtcaacctgacacgacatacccgcacccacactggcgagaagccctaccgctgtccccactgcccctttgcctgcagcagcctgggcaacctgaggcggcatcagcgtacccacgcagggccccccactcctccctgcccgacctgtggcttccgctgctgtactccacgaccagcccggcctcccagtcccacagagcaggagggggcggtgccccggcgacctgaagatgctctgctccttccagatttgagcctccatgtgccaccaggtggtgccagtttcctgccagactgtgggcagctgcggggtgaaggggagggcctctgcgggactggatcagaaccactgccagagctgctattcccttggacctgccggggctgtggacaagagctggaggagggtgagggtagtcggctgggagctgccatgtgtgggcgctgcatgcgaggagaggctggagggggtgccagtggggggccccagggccccagtgacaaaggctttgcctgtagcctctgcccctttgccactcactatcccaaccacctggcccggcacatgaagacacacagtggtgagaagcccttccgctgcgcccgctgtccttatgcctctgctcatctggataacctgaaacggcaccagcgcgtccatacaggagagaagccctacaagtgccccctctgcccttatgcctgtggcaatctggccaacctcaagcgtcatggtcgcatccactctggtgacaaaccttttcggtgtagcctttgcaactacagctgcaaccagagcatgaacctcaaacgtcacatgctgcggcacacaggcgagaagcccttccgctgtgccacctgcgcctataccacgggccactgggacaactacaagcgccaccagaaggtgcatggccacggtggggcaggagggcctggtctctctgcctctgagggctgggccccacctcatagcccaccctctgttttgagctctcggggcccaccagccctggggactgctggcagccgggctgtccacacagactcatcctgaactaggtccttcttccccatgttttatacagacggaccagaagccacctttttctcccccgctggccaggggctccacacagactaacgtaggcactataaggaccagcccaaccccatgggcgggggggcccatatggaccaggggaccttgccttgactgaggcacttcacgagctcagtgagaagggccctgtattcacctccactgcccccaggggctgtggacaaaccggctgggggactgcccagcctcccacctgtttatttaacttatttcagtgctttataataaaggaaacactaacaaaaaaaaaaaaaaa

SEQ ID NO: 1395 - DNA, 3204 bp, Homo sapiens
acagagctgggtgtgtccctccgagtgccccccgctagggactgtgcaggccggagctaggcagggacagcggggcgaaccgggctgatagagtcggtccctgctcctgtgaggctctcaccgaatccctgctgtttccgggcagctgaagagcgctgggccctcgcgtcgcgggcgtggctgtggccgtgtctcctggtagtctgagcccactgtgcgtgtggatccacgtgggagctgggttccagagcctggtcctgaggaggagccgagccggggcttccccttctcagaatcctgctcttcctccagagagattcccaggagaagagggaacaaccaattcattcctgaaagccaggcctcgggacctgatgacatttgaagatgtggctgtggaattcagccagtgggagtgggggcagctgaaccctgctcagaaggacctctacagggaggtgatgctggagaacttcaggaacttggccattctgggccttctagtatccaaaccatatgtgatctgccagttggaggaagggggtgagcccttcatggtggagagagaaatctcaacaggagcccactcagactggaagagaaggtctaaatccaaggaatcaatgccaagttggggaatttccaaagaagaattattccaggtagtatcagtggaaaaacacattcaagatgtgctgcagttctcgaagttgaaagcagcctgcggttgtgatggccagttagagatgcagcagataaaacaggagagacacctgaaacaaatgtcaaccattcacaaatctgccaccacccttagcagagattataaatggaatggatttgggagaagcttaggtttaagatcagtccttgttaaccaacacagcattctcatgggagaaggatcttataaatgtgatacagaattcaggcagactttagggggaaacaactctcagagaacccacccagaaaagaaatcttgtaaatgtaatgagtgtgggaagtcctttcacttccagtcagaacttaggcgccatcagcgatgtcacactggagaaaagccgtatgaatgcagtgactgtggaagagcctttggtcatatttcatcccttattaaacatcaaagaactcatactggagaaaagccctatgaatgcagtgaatgtgggagagccttcagccagagttcgtctcttgttctgcactatagatttcacactggagagaaaccctacaaatgtaatgaatgtggacgagcctttggtcacacttcatcccttattaagcatcagaggactcatactggagaaaagccctatgaatgccgggaatgtgggagaaccttcagccagagctcatcactcattgtgcattacagatttcatactggagagaaaccttacaaatgtaataaatgtgggagagccttcagccagagttcatctctcactcaacattacagatttcacactggagagaaaccctacaaatgtaatgagtgtggaagggcctttgctcatactgcatcccttattaaacatcagagaagtcatgctggaaaaaaaaccctataaattcagtgaatatagaagggctttcagctggagtgcagacatcactggaacttaaagaattcatatcagagagagatcctaaaggtgtaatgtatgtgggaagaccacatcttgttccacatcaggcaataattactaaagagaatccctgtcaatgtcaagagggggtgggcttcccctctcttaccaaacatgggagaatccatactagtgagaaaccacgtgaatgtaatgaatgtgggaacgctttgatcagaggatgcatattattcagcatcagacagccgacactggggaggagccttatcaatgcagtgagtgtggcaagccttcagttacatactgattctttaagaaaatcagataacttgtactggagagaaatcctacaagtgtggtaagtatggaaaaatcttcagttgtatctcttcctttactaagcatcaagaacacatactagagagaggccctatgaaagcaggaaatagaggaaggccttcagtcagggctcatcccttattaagcatcagaaaattcatacctgagaaaaacctgtgaatgtgggtaatgtgggagagccttcagccaaacctcattgctttataaaccccttagaactctccctactagctggaaactctggtgacgtgatgaatgtgggaagggctttggtggatgttccaccaaaacacgttagagaatttgtacattagagaatttgtgctagagcaactcttcaaatttagtgaaactgggaaaacccattagtagagttcaagcttcagtattcatctcaaagagaaaccttgggaacatgatgaatgtgaggaaagttcctttccaacttgagatgtataaaactagagctgaaaagaagctgagaaatcaccttgtctggtgattttctgcctggtggggccatttgtataacgacacttgtgcattgcctcctcatgctgttactgacggggcagggtgtcatgcatgggtgcagaggatggaggctgagaaaggtagacagctacccatgatctagcccagtcgtattttagagctaataaaactgatgttcagaaagtgacatgccttggcctatagtcctaactgggctgggcctctttcctgtggttcacagctgtagtatggagattaatagacaggatctttgcagtacaacacctctatgcacttctttctctgtagcacatgttacctttctttgtgaggcaatggagtggtctaggattgagcaaaaagcaatttttgttacatctttatgctaatagatttggaatttttgaaatgaaatgaaaccttgtttaaacattaaaattactaaaataggctgggcgcggtggctcacgcctgtaacctcagcactttgggaggccgaggcggacagatcacgaggtcaggagttcgagaccatcctggctaacacagtgaaaccctgtctctcctaaaaatacaaaaaaattagccaggcatggtggcgggcgcctgtagtcccagctacttggaaggctgagacaggagaatggcgtgaatcggggaggcagagcttgcagtcagccgagatcacgccactgcactccagcctgggagacagagtgagactccgtctcag

SEQ ID NO: 1396 - DNA, 6810 bp, Homo sapiens
aatcaggcgcgcagccagggaggaaggggcggcttccggaatctggcgcggcctttgtctcacttcagccagagcgcggggttagggcttcattgccttgtgtcctctgctccgggagacttcggtgattctgccactcactccgtcgctctgtgacctgctggcattgaatgatttatagctaagactccaggacacccctgaagccgagaaatggaactcttaacattcagggatgtggccatagaattctctccagaagagtggaaatgcctagaccctgcccaacagaatttatatagagatgtgatgttggagaactacagaaacctcgtctccctggctgtgtattcttattacaaccaaggcattttaccagagcaaggcatacaagattcattcaaaaaagcaacactgggaagatatgggagctgtggccttgaaaatatatgcttatggaaaaactgggaaagtataggtgaaggtgaaggacaaaaggaatgttataatctatgtagccaatatttgacaactagtcataacaaacatttaactgtgaaaggagacaaagaatatagaatatttcagaagaagcctcagtttctgtcagctgctcctacagaaccatgtattcctatgaataaatatcaacataaatttttgaaatctgtcttttgtaataaaaatcagataaattttaaccatgactcaaatattagtaaacatcatagtactcattttctagaaaactattacaattgtaatgaatgtgaaaaagtattttaccaatcctcaaagcttattttccctgaaaatatccatattcaaaaaaagccttacaactctaatgaatgtggtgaaacttctgacccattctcaaagcttactcaacatcaaagaatttatattggagagagctcacaaagatgtaataaaaaatgtataatagtctttagtcaatcacatctaaagggacataagataattaacactggagaaaaatcagtgaaatataaagaacgtggcaaagcttttaccaggggcttacatcttggacatcagaaaattcatactggagagaaaccttacaaatgtaaaaaatgtgacaaagcctttaacaagagttcacaccttgctcaacatcagagaatccatactggagagaagcctttcaagtgtaaggaatgtggcaaagcttttaacagaggctcataccttactcaacatcagagaatccatactggagagagagctttcaaatgtgaagaatgtggcaaagcctttaacagggggtcataccttactcaacaccagagaatccataccggagagaaacctttcagatgtaaggaatgtggcaaagcctttaatagaagctcatacgttactcagcatcagagaatgcatactggagagaaacctttcaagtgtaaggaatgtggcaaagcttttaacagagcttcacaccttactcaacatcagagaatccatactggagagaaacacttcaaatgtaaagaatgtggcaaagcctttaacaggggctcacaccttactcgacatcaaagaatccatactggagagaagtctttcaaatgtgaagaatgtggcaaagcttttatctggggctcacaccttactcaacatcagagagtccatactggagagaaattcttcaaatgtaaagaatgtggcaaagcttttaccaggagctcacaccttactcaacatcagagaattcatactggagagaaacctttcaaatgtaaagaatgtggcaaagcttttaacagacgctcaacccttactcaacatcaaataattcataccaggtagaaaccctgcaagtgtaaagaatgtgctaaaaccctaaactggtgctcacaccttactcaacattagaaaatcaatactggatagaaatcccatatgtgtaatgatttttgaaacatcaaaatgaagattaaataaaaattagaagtgtcactttagaaagaactaaggtgctagcacttccgtaaattactctgaatcagtgtgtttattataacaaataattcaaactcaattagataattaaattgtatgtttaaaaagagggacgacattgatggagaggcataattatattcaatgttcacttatttttgtaatcacagtattcatgattgagaaagtattattgatgtaattaaattcaaattaaccttttttttccccactgtggttgattattgctgtctctgacatgagagtcccttctacgttaggtaggcatcattcacatgtctcattcacatgtcatcattcacatgtctcatgacgtcattcacaagtttcccatggaagactaagagcattggcatataggatgtatgatgaaatctaaatggagttgctctttttgtttgacttacaacactgaatataagtcatatatgagttaggtgttcagaatattattgttctgcattaaagtgtgagacagaaacactctgagttttagatatgaatagttttaccaactacccattaaaaggtcttgctagtccattaatattctaatgtatcttcatagcagcaagttagaagtcctgaatgttactgtgataacaataaagaaatcacaaatatcagagagtggtgcaaataacttctctctggtagaacatagattattaattcaatcctctaaatacttaggctcagtttaagaaaagagagaacacatttttttaacataggtcatggtatcagaataagaatgctttttgaatgtttgcagtctgtaattttgatgattgaggaaactggattttgaaatgctttattcagtctgtaaacttaatttttttttaagaataaaatgaaatgtcttttaatttgttaacactgttgcttattgaataatgtcttatcctgacaaaaatgttaacttattccaccttgctcaagattccaggtagtaaatggtaatgatatactatcgggtatgtctagttcatgctgtctttagcatttttttacccttagtggtattaaactccaaatagtttggagaatgttgattccataagttattacttgttactctaacaagttccccaaggtgtgttgagtagttaattagcccttagctatttttaccaaacattaggttattaatttaaaattgtttgtttttaatgtaggtgtttactgctatgaatttctctgaacagtttgctgcatctcatgtttcgatatgtcataacttcattttcatttatctgaaaatattttccagtttcattttttctttaacacattaattaggagtatttttaatttccatatatttgtgagttccccccattttctgcattcatttatttttaatttccttttactaaagtcagggaaaatactttggattattttgatcctgttaattttattgacgttttcctgctgtatggcctagcatatggtctatcctggagaatgatttatgtgtacttctaattttgagtggaaaattctataaatttgagaattctatcagttcatatttgtttacagtgttcaagtgttatgttttcctgttgatcttcccactttttctgcccattatttacattggagtatagaagtttctatacttctgataaactccaaataatggatttgattatttaatctatttatagcctgtaatattatcagtatagttgaatttgcatcattttgctttctatttttatgtctcacgtatttttctttattcttcctttactgctttcttattactttccatataatcttttaatttatataattgttcatgtttttgaagttacttccttgttttctctagcccttatataccttatcagaatctgctttatatttatattaattccaatgagatataaaatattaccactatatagcttttttcccccaatttggattgaatttttaaaatattgtcttaatttagttttattgttttattaaaaaagctaaacttaacaaaattggttgtatattagtttaggtgaggttgttttgtaatgagaaaataatttacaacatatagagaataaattattattattttaaaaagtactctacattttgtatccttaccatttcctttgatagtttaaaattgtaattctctaaataagagatatattcataaatgtgacttgtaaatgttgaaatttatatgtttgctttttctgcattcagtaagggtagtagtttccagcatctgtgcctctttaaagtgaaagacaggggcaggcgtagtggctaatgcctgtaatcccagcacttcgggaggcccaggtgggtggatcacctgaggtcaggagttcgagactagcctagccaacttagtaaaaccctctctctaccaaaaatacaaaaaattagctgggtgtggtggtgggctcctgtaatcccagctacttgggaggctgagacaggaaaatcacttaaacctgagaggtggaggttgcagtgagccaagatcatgtcactgcactgcagcctgggcagcagagtgagactccatctctaaataagtaaattcagcctgggcaacatgtgagactccatctctaaataaataaataaatgaatgaatgaatgataggatggaattaaaatagtttgaaaacacaaattaacaaaatggtgttgacaaagattgttcatttgtggtctaccagggcataaaattctcaaaaaacataatcagtaggaaacctctttattcctgaatattagagaatattatatgtcttaaaattattcatgttgaaaagctctgcctttcatgcatttaggagaaaaagtagagggcaggaggtttatgtagactctggtctgtgcctgatttggggaatggaaagactcgacagaagaggccaggtcagccaagcagggctctgttgcgtgcaagattaactgctggtttgtctttgcagagctccacacagaacatcatcaaagaactgatggacacttcatctccctgggtgaggggcaggtgtaccatgctgtcatggccattcctgcctcgattggggtgtgggtgtagagatggtctctataaccagggcccagacatggctgagaaggccttctgccaggactccaccttgatgactcacaggactttgtgccttggctttccctattgagtgacccacagttttaatccaagggaccctgagtctgtttccttccttcagccccaccatttcaccccagcactgttcaggtgtacaatcggctttcacatatttgtaagaatatctaggaaaattatttatattttactttcacttcatgttatgaccatgagtgtttttgcatttgctagggctcattgttttaattggcccccctttatccctctgagtgcggaaataaatcagccctaaatctggatgagacctgcaggtggactccatcagtgcaggcgtggtggggcagcaggaggagcccgtggtgcccaccttccagagctgccacctcttttacctcctcatgttccttcctgtgcacctagagagagttcacccccacccaacagctcctggacctgctgcccaaaaggtaagtgctccatccctccacagcacaagggggactcagccacctattatctgtgtcttgggaaagtcccttcacatttgtgggcttcagtttgcttctttggaactggggttctaagaagcctaacatgatatgattgtttcaagaactaaatgagataagctatggaaagtacttcagacttggccttgtagaaagcactgctgagggaatagattggttattcatattataaaactatttaaaactctagaaaactatagtaagatataagattataaaaatatcaaaactaagatattgacagtaatagaattaacctactcatctatttgcattttaccagattaattttttcttatgtgtgtgtgttctgtgcaattttattacatgtgtaggttcacctaccagaagattaactcgttttcctcttataaccacatccgcttcccttctccccaccatacccactctgattctgattctttgaaaccattaatttctatttctgcaaatttgtcattccaataatgttatataaatgaaatcataacctgtgcaaccttttgtaattggcccttttccttcagcataattccttggagattcatctaaattggtttatgttttagtttgttccttttgttattgctgtgggttttcatgtgtggatgttaccatgaaatactgtgtgtaacccttcactctttcaagaacatatttgttgttttcagtcagtgtgtggctattatgaataaaagtgctatgtacattcatgtactaggtttcatatgaatacatgttttcattactctggaaaatatttccagcatacaattcctggctcatagggtagttacaagtttaattttaatagaaactagcactctgttatccagagtgactatcattttacattcccatcatcaatgaatttctgttttttcaaatcctcttagccatactgactgatatgtattgatatcacattgttttaatgtacatttttctaaaggataataatgttgaactttatttaatgttctcatatgacatctgcctattatctctgatgaaatgtttattcatgtctgcatgttttctaattgtatttgttttcttgcaagttttgagagttctgtttatattctggttactagctcacataggcaataaataagttttttttccacaaag

SEQ ID NO: 1397 - DNA, 3995 bp, Homo sapiens
agccgattgcagggagaaactgttttcgcagcagtgcgcctcccttttccagccaccggttctcctgaccccgagtgtggggggtgacttcagtctcctgacatccagtgttctctcgagccagtttccagcccacagaaaatgagctcttccggaagtgggcatcttattccaatcccctccctgtgaatgtgtggagaaaaagagatgggaacgaggcagaggaaatagagaaattttgaaagagaaatgaagaatgagagacccattaacagaaggcaaagtagaaggttcacaaattttaagaaagggagaataaagtgaaaaaaatctcagaaggaatccactcaacagacgaggattcacttccaaagagacatattatgcaaggaagcaacttggaagaggaaagaaaagaagtcaggaatggcccttactcagggacccttgaaattcatggatgtggccatagagttctctcaggaagagtggaaatgcctggaccctgcgcagaggactttatacagggacgtgatgttggagaattataggaacctggtctccctgggaatctgtcttcctgacctgagtgttacctccatgttagagcaaaagagagatccctggactctgcagagtgaagagaaaatagcaaacgatccagacggcagggagtgcatcaaaggtgtgaacacagagaggagctctaaattgggaagtaatgcaggaaacaagccttgtaaaaatcaacttggattcacttttcagttacatctgagtgatctacagctatttcaagctgaaaggaaaatttctgggtgtaagcattttgaaaaacccgtcagtgacaattcctcagtttcaccgcttgaaaaaatttcttccagtgtcaaatcccaccttttaaataaatatagaaataattttgatcatgctccattacttccacaagaacagaaagcacacattagggaaaaagcttataaatgtaatgagcacggccaagtctttagagcatctgcaagccttactaaccaagtaatccataacgcagataatccttacaaatgcagtgaatgtggcaaggtctttagttgcagttcaaagcttgtgatacatcgaagaatgcatactggagagaagccttacaaatgtcatgaatgtggcaagctcttcagtagcaattcaaacctttcacaacatcaaagaattcatactggagagaagccttacaaatgtcatgaatgtgacaaggtctttcgaagcagttcaaagcttgcacaacatcaaagaattcatactggagagaagccttacaaatgtcatgaatgtgacaaggtcttcaatcaaattgcacaccttgtacgacatcaaaaaattcatactggagagaaaccttacagttgtaataaatgtggcaaggtctttagtcgccattcatatctagcagaacatcaaacggttcatactggtgagaaaccttacaaatgtgaagaatgtggcaaagcattttcagtgcgttccagcctcataacccatcagttaattcacactggaaggaaaccttacaaatgtaaagaatgtgacaaggtctttgggcgcaagtgtttcctgacctctcatcagagaattcatactagagagagaccttatggatgcagtcagtgtggcaagatctttagtcagaaatcagaccttatacgacatcgaaaaactcatactgatgagaagccttacaaatgtaataaatgtggcacagcgtttagagagttttcagaccttactgcccattttctaatccatagtggagagaaaccttatgaatgtaaagaatgtggcaaagtcttcaggtacaagtcttctctaaccagtcatcatagaattcatactggagagaagccttacaaatgtaacagatgtggcaaggtcttcagtcgcagttcaaacctggtatgccatcagaaaattcatacaggagaaaagccttacaaatgtaatcaatgtggcaaggtctttaatcaagcatcataccttacaagacatcaaataattcatactggagagaggccttacagatgtagtaaatgtggcaaagcatttcgagggtgttcaggccttactgcccatcttgcaatccatactgaaaagaaatctcatgagtgtaaagaatgtggcaagatcttcactcagaagtcttccctcaccaatcaccatagaattcacattggagagaaaccttacaaatgcaccctgtgcagtaaggtcttcagtcacaattctgaccttgcacagcatcagagagttcattcatgagagtccctacaaactgtatggcaaaaccatcatcatgagttctagcattaatcaacatcagtgagtccatactaagtggaaatcatataaatgaaatgtatgtgacacaggctttatcaaggcctgccaaatcactggacatcaccacatcactgtggaggatgaaagcacacagatgaattgtgtgtacttgggctattattcaaggaccattgctatagaacacgataggatttacacaagaagtaactctgtctctggttctctgatactaatctatgatattgcatgatgcagaataatgctaagtcaaaatatgttgaatctcatgacctgatgtatatcaaaggtgcaacggcttgtaaatgaccagttttattcaggctataaagcattcaattatttggggcttatagaaaaggctactttactctttgtgacttcgaaatcttttcatgtgccttccatacaggccattcactgtggtccctgggaaagaatcagtaggatgacagggctgacttcattagctgaggattatttctatccaatttcctgatgaaggacattgccttttgagattaaatattgtctgatttagagagcatggaggtgggcagagtaacataaaactgatgaccgtcatcatactgttgcagttagcacactttctcctgacataagtgcacagagcttcagtgtccaccaactgaccatgaaatagagtatgctgtaatcttaaggcataggttattagtgggaagagagtaataggttgctagtgtctgattatatggtagaaataatgcaaggaaaaaggtagccaccttctccattgaacagcagtacctgctgtttagcaaagactgatgagaagtagacttttttttttttggagatagagtctcactctgttgcccaggctggagtgtagtggtgtgttcttggctcactgcaccctccgcctcctgggctcaagcagtccttctgccttagcctcctaagtagctgagactacagacgtgcgccaccacacccagttcatttttgtatttttagtagagacagtgtttaccatgttggccaggcaggtctccaactcctgacctcaagtgatatgttcacctcagcctcccaaagtgctgggattacaggcatgaaccatggtgcccagcctcatttttgaaatggaatagagaacagttatatcacagttgagagtttaatcaaaatgaccggatcagcatattctttttttagatgagacagagtttcgcccttgtcacccaggctgtagtgcggtggcgcgatctcggctcactgcaacctccgcctcccgggttcaagcaattctcctgcctcagcctcccaagtagctgggattacaggcgtgtaccaccatacccagctaatttttgtatttttagtagagatggggtttcaccacgttggccacactggtctcaaactcctgacctcaggcgatccatctgcctcagcctgaaagtgctaggattacaggcgtgagccaccacacctggccagctcagcatattcttaagtaggattcacatttaattcttggtattataagttgcaaccatttgatttagaatgtatgcagctctcatgtttgtagtaataaagtttcatttttcctaagtaaaaaaaaaaaaaaaaaa

SEQ ID NO: 1398 - DNA, 4182 bp, Homo sapiens
agacgcagagtagattgtgattggctcgggctgcggaacctcggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaagagagcgttttcccaaagaaaataacatagcacagaaggaaaaataaaaagaaattgctgcagattttactttatgtgagaaaatctacaatttcttcgagacactcatataaagatattggtgaatgaactttgctaagtatggattcaggcggtggaagtcttggattgcacacgccagactctagaatggcccataccatgattatgcaagattttgtggctggaatggctggtactgcacatatcgatggagaccatattgttgtttcagttcctgaagctgttttagtttctgatgttgtcacagatgatgggataactcttgatcatggccttgcagctgaagttgtccatggacctgatatcatcacagagactgatgtagtaacagaaggtgtgattgttcctgaagcggtacttgaagctgatgttgccattgaagaggatttagaggaagatgatggtgatcacatcttgacttctgaactaattacagaaaccgttagggtaccagagcaggttttcgtggctgaccttgttactggtcctaatggacacttagaacatgtggtccaagattgtgtttcaggagtcgactctcccacaatggtatcagaggaggttcttgtaactaattcagatacagaaactgtgattcaagcagctggaggtgttcctggttctacagttactataaaaaccgaagatgatgatgatgatgatgtcaagagcacttctgaagactacttaatgatatctttggatgatgttggagaaaaattagagcatatggggaatacaccattaaaaattggcagtgatggttcacaagaagatgctaaagaagatgggtttggttctgaagttataaaagtgtatatatttaaagcggaggctgaagatgatgttgaaataggtggaacagaaattgtcacagagagtgagtacaccagtggacattcagtagctggagtgcttgaccagagccgaatgcagcgggagaagatggtttacatggcagttaaagattcttctcaagaagaagatgatatcagagatgaaagaagagtttcccgaaggtatgaagattgtcaagcatcaggaaatactttggactcagcattagaaagcagaagtagtacagcagcacagtaccttcaaatttgtgacggcattaatacaaataaagtacttaaacaaaaagccaaaaagaggagaaggggagaaaccaggcagtggcaaacagctgttataataggtcctgatggacagcccctcacagtgtacccttgccatatttgcacaaaaaagtttaaatccaggggattcttaaaaagacacatgaagaatcatcctgatcatttaatgagaaaaaaatatcagtgtacagattgtgactttacaactaacaagaaagtgagtttccataaccacttagaaagccataagctcataaacaaagtcgacaaaacccatgaatttacagaatacacacgaagatacagagaggctagtccactgagttccaataaacttattttaagagacaaggagccgaagatgcacaagtgcaaatactgtgactatgaaactgcagaacaaggactgttaaacaggcatttgttggccgttcacagcaagaattttcctcatgtttgtgttgagtgtgggaagggttttcgacatccttctgaactcaagaaacatatgagaacccatactggtgagaagccatatcagtgtcagtattgtattttcaggtgtgcagatcaatcaaatctgaaaactcacattaagtctaaacatggtaacaatttgccatataaatgtgagcattgtccccaagcatttggtgatgagagggagcttcaacgccatctggatttgtttcaaggacataagacacaccagtgtcctcattgtgaccataagagcaccaattcaagtgaccttaagcggcacatcatatctgtccatactaaggattttcctcacaaatgtgaggtctgtgataaaggttttcatcgtccttctgagctcaaaaagcatagtgatatccataagggtaggaagattcatcagtgcaggcactgtgactttaaaacatccgatccatttattcttagtggccatatcctttcagttcatactaaagatcagccattgaaatgtaaaaggtgcaagagaggattcagacaacaaaatgagctaaaaaaacatatgaagacccatactggaaggaagatttaccaatgtgagtattgtgaatacagcactacagatgcatctggctttaaacgacatgtgatatcaatacatacaaaagactatccacacaggtgtgaattctgcaagaagggattccgaagaccatcagaaaaaaatcagcatattatgaggcaccacaaagaggctcttatgtaataagatcaatataaagaaagaagctatttaggagatatgatatgctacttgggagaaaactctcactaactgtctcaccgggtttcaaagcttgatactaaaccatgactttacattctttgtattaaagatcttaaaatatttgaattcacaggggatcccatagccctttgaaaattacttaaagaatttaagaagcactatagaatggttacagaaaaacttcttaagtatctgtgtaatagtattatatgcatacttaaactacagaggggaaaagcaaagacaaatactttatttggctgattatgttagatacaaatgtttctgagaagagaatacataattgagtttagtgatgctttgctatagcaagcaaacccacttttatgcaattttagaaatggggcagggaaacaaaatgtggtcattcatcagtcacttagtcattgagccttttatattgtacctggaaattaaattccagcaatgacaaaagttttgtgtattcattaaaagaaaactaactggaaaacaggttagattaattcagtactattaaaaaagaattcagagctgttaatattttatcacaggataggatacttaaaatatagcattctgtgctgagatctaaggtgaagtctataaagattaaagttcccttttttctgatgttcaagttgattgttgttcagtatggcatatatgacaaaagtatatttgagtcaaatgtggctttctaaaatggatgcaacattagcgttgcaaacaaaatcagcactatatttcttaatgatctaaagattaatttgagagaacacagttttcttaaatattataatgtctagagtttttttaggacagtcttagcaagtatgattgttctagtcttacttgctctaatgtttaaaggtgcaattttatgccattattgaaattgatttttaaaatctatataccatatgattaacatgcattttcaatatgaggcagtgtttatgcagtatttaacagagcaatctgctgccaatagagtttggaggtggatatttagtttacagtgtataaacttaaaatatgcatccctttaacaacgctttgtgttagcatgctgcaaatcaaaatggcacttaatattaaaagctggtttagggaaattttatgaaaatcctgttcataaatgtaatgcatatgatatgtacttttaagttttagttgcttcatgtttacattcagctgttcaacataattaaaatgtaattttacttcatgctatattgtggctttgtgtttcaaataatgttcacctttctgtttttgcaccagataagaatcagttccttgagaataaattttttatctttcttaacttcagaatattaaatttggaatatctactaaaattgtgtgttatgtggctgtaaatgatgtacacgctgtaaaataagatcgctactgttatgtgggattattatttctaaatgttactcattgaaatgagcatacaataaaaagcatttattgcacttaaaaaaaaaaaaaaaaa

SEQ ID NO: 1399 - DNA, 2265 bp, Homo sapiens
cggaagtttgcggggcggggcggacgcgggtggccaaggcccgtttccggcggcgtcgcgcgtttgcgagcctcgggtggtcctcagggagggtctctcggccagaacacgtggatgcccacccaccactgagcctcatggaggtggtaacatttggcgatgtggctgtgcacttctctcgggaggagtggcagtgtctggaccctggccagagggccctctacagggaagtgatgctggagaaccacagcagtgtggctggactagcaggattcctggttttcaagcctgagctgatctctcggctggagcagggagaagagccatgggtcctcgacctgcagggagcagaggggacagaggcaccaaggacctccaagacagattctacgattaggactgaaaatgagcaggcctgtgaggacatggacatcctaaaatcagaatcctatgggacagtggtcagaatctccccacaggactttcctcagaatcctggctttggagacgtttctgattctgaggtctggttagacagtcatctgggcagtcccgggctgaaagtgacaggctttaccttccaaaataactgtttgaatgaggagactgtggttcccaagaccttcaccaaggacgcaccccagggatgtaaggagctgggaagcagcggcctggattgtcagcctcttgaaagtcagggagagagtgcggaagggatgtcccagagatgcgaggagtgtggcaaaggcatcagagccacttcagatatcgctctgcattgggaaattaatacacagaaaattagcagatgtcaagaatgccaaaaaaagttatctgactgcttgcaggggaaacatacaaataactgccatggagagaagccgtacgaatgtgcagagtgtgggaaagtcttcaggctctgctcgcagcttaatcagcatcagagaatccacacgggagagaaaccctttaaatgcactgagtgtggaaaagccttccgcctgagctcaaaacttattcagcatcaaagaatccacactggggagaagccctacagatgtgaggaatgtggaaaagcttttggtcagagctcaagcctcatccaccatcagagaatccacacaggagagaggccctatggttgtcgtgagtgtgggaaagccttcagccagcagtcgcagctggttagacaccagagaactcacactggggagaggccctacccttgcaaggagtgtgggaaggccttcagccagagctccaccctagcccagcatcaaaggatgcatactggggagaaagctcaaattctaaaagcctcagacagtccaagccttgttgcacatcagagaattcacgctgtagagaaaccatttaagtgtgatgagtgtgggaaagcttttaggtggatctctcgcctgagtcagcatcagctgattcacactggagagaagccttataaatgcaacaagtgtacaaaagcctttggttgtagttcacggcttattcgccatcagagaactcacactggagaaaaaccatttaaatgtgatgagtgtggcaaaggctttgttcagggctcacaccttattcagcatcagcgaatccacactggagagaaaccctatgtgtgtaatgactgtggaaaagccttcagtcagagttccagccttatttaccatcagagaatccataaaggagagaagccctacgaatgcctccaatgcggaaaagccttcagtatgagcacacagcttacaatacatcaaagggttcacactggagagaggccctataaatgtaatgaatgtgggaaagccttcagtcaaaactcaacccttttccaacaccagataattcatgcaggggtgaagccctatgagtgcagtgagtgtggaaaagccttcagccggagctcatatcttattgaacaccagagaatacacactagggcccagtggttttacgaatatgggaatgccctggaagggtccacctttgtgagccgtaaaaaggttaatactataaagaaactgcatcagtgtgaagactgtgagaagatatttaggtggcgttcacacctaattatacaccagagaattcacaccggggagaagccttataaatgcaatgactgtggcaaagcttttaatcgtagctcaaggcttacccagcatcaaaaaattcacatgggatagaccacttacatataaatgtgtatatatgtgaataaacctatagccttaacttaaaaaaaaaaaaaaa

SEQ ID NO: 1400 - DNA, 3144 bp, Homo sapiens
gcggtcattgtcctggcagagcggcgagccggtgagtgtggctgcggggtcgcgcccaccctctacctgtgccgggggccggaacctggccccggggagggcgcggcctcggggagacggcgtgcaggcccagcactgttggtcaccgcaggcctgtcttcctattcaccgtgggcagcagagggatggctgctcagctgctgactgatgaggcactgactgggagactagacctgaaatgaaagagttggatccaaagaatgacatttcggaagacaagctctccgttgttggggaggccacggggggacccacgaggaatggtgccaggggtcctggctcagaaggagtgtgggaaccaggcagctggccagagaggccgcggggagatgcaggtgcagagtgggagccattgggaattccccaggggaacaaactcttagggggctcagtacccgcatgtcatgaactgaaggcatttgccaaccaaggctgtgtcctggtcccaccacggctggacgaccccacagaaaagggggcctgtccacccgtaaggcgtggcaagaacttctccagcacttcagacctcagtaagccccccatgccctgcgaggagaagaaaacctacgactgcagcgagtgtggcaaggcctttagccgaagctcgtccctgataaagcaccaaaggatccacacgggagaaaagccgtttgagtgtgacacctgtgggaagcacttcatcgagcgctcgtccctcaccatccaccagcgggtgcacacgggcgagaagccctatgcctgcggggactgcggcaaggccttcagccagcgcatgaacctcactgtgcaccagcgcacgcacacgggcgagaagccgtatgtgtgcgacgtgtgtggcaaggccttccggaagacttcctctctcacccagcacgagcggatccacacgggggagaagccctacgcgtgcggggactgcggcaaggccttcagccagaacatgcacctcatcgtgcaccagcgcacgcacaccggggagaagccgtacgtgtgccccgagtgcgggcgagccttcagccagaacatgcacctgaccgagcaccagcgcacgcacaccggggagaagccgtacgcctgcaaggagtgcggcaaggccttcaacaagagctcctcgctcaccctgcaccagaggaaccacaccggcgagaagccctacgtgtgcggcgagtgcggcaaggccttcagccagagctcctacctcatccagcaccagcgcttccacatcggcgtgaagccgttcgagtgcagcgagtgcggcaaggccttcagcaagaactcctcgctcacgcagcaccagcgcatccacaccggcgagaagccctacgagtgctacatctgcaagaagcacttcacggggcgctcgtccctcatcgtgcaccagatcgtgcacaccggggagaagccctacgtgtgcggcgagtgcggcaaggccttcagccagagcgcctacctcatcgagcaccagcggatccacaccggcgagaagccgtacaggtgcggccagtgcgggaagtccttcatcaagaactcctccctcactgtgcaccagcggatccacacgggcgagaagccctaccgatgcggcgagtgcgggaagaccttcagccgcaacacgaacctgacgcgccacctgcggattcacacctgagcgcctctgtgcagggctctcactggcggtgcccaggacggacgccagatggctgcgcgctttgtcagcagtgctgtgagaagttctcccctggggtggggactcggggtcaggggagctcaggaatgtggggttgtggaggggctggctgatcacacatgccccctccttactgagcctcagaaagcaagcccctcggtgtctgacgtatctggggacacttcaaggttcactgtagctgagccatggccgctggtaacagacatcagggttccagactagccctcttgagtaactgtcctagagctgggacaggtcacgcctgcctccacatctctgtttcttcagcgggaaagtggagctggtggaggggagggaggagacatctccctctttgtcagatacatcctggagtccagatgcagcttgtcaccatctgcattttctccgtgggttgggagcgtgagggccttcctatccctccacccaccgtttccctgcagtgcacgctggcagccaccaagctaggaagtggcaggagtttgccggttgtttgtgaggggaaaaatttttttttcagagttagcaaataacagtaactactgctttgaatgccaaagtttcttagagtggtctgttacgttttttaaaaataaaacttttaattaagggagactatgttattttaaacagtcttctgttttggccagttgtctggtcaaaatcggcttcagtgattgtgggaggggcaagaaggaaaagaaacagcagcaggtttgatattcagaaagaaatatgcatggattcaataagtatatacatctgagcacagattatttttatagtgatttttgcagctaaatgtgaaggcaactgtcttaagtcccttcctgctgctgtaacaaaagaccttagactgggtaatttataaacaatagaaatttgtcactcatggttctggatgctgggaagtccaagatcaaggctctggcagatttggtgtctgatggggtatgttcttcataggtagtgcttgtgtcttgatgtgtgtcttcacgtggttgtaaacggcagacttcctcaggccccttataagggtgctaatcccagtcacaagggccctgacctcatgacctcccaaaggtcctccctcttcatactgttacattggggatcaagtttccaatatgtgaatacagggaagcaccaacagaccatatcagtaacttcgagtgagtttcctaaggccgactgaagctctgtttacacataagagtgttccccaaagtgcactttctctggggccttttaggccatacttttaattttgttatttgatactactggttgctaatgttctggcatttccagttgttccacactccctgacactggtgtacacaaataaataatacagaaaaaaaaaaaaaaaaaaa

SEQ ID NO: 1401 - DNA, 981 bp, Homo sapiens
atgttctttatacataagaaggttcatataggacagacctttggtaaatataatgaatatgagaaagcctgtaataacttagctattattgtccaagggataactcaggtaagacagccaacttgctgtagaaagtctgacttcagtaaacatcagcaaacacacacaggagagaaaccccatgaatgtgttgaatgtgagaaaccctccattagcaaatcagacctcatgatacagcacaagatgcctactgaggaaaaaccttatgcctgtaactgctgtgaaaaattgttcagctataagtccagcctcactatccatcagagaattcacacaggggaaaagccctatggatgcaatgaatgtggaaaaaccgttcgctgtaagtcattcctcactttacatcagagaactcacactggggataagccctacaaatgtattgaatgtggaaaaaccttcactgtaaatcaacttctcactttacatcacagaactcactcaggggaaaagccctatcagtgtagtgaatgtggaaaaacctttagtcagaagtcatacctcacaatacatcatagaactcacacctggcaaaagccctatgcatgtgaccattgtgaaaaagcatttagccataagtcaaagcttactgtccatcagagaacacacacaggggaaaagccctatgaatataatgagtgtagaaaaccctttatcaataagtcaaacctcaggatacatcagagaactcacattagggaaaaaccctatgaatgcaatgaatgtgggaaaacgtttcaccaaaagtcgttcctcactgtccatcaaaggactcacaggcggaaaaaaccctacgaatgcaatgaactggggaaaacctttcactgtaagtcattcctcactgtccatcagaaaactcatactggggaaaaaccatatgcatgtaacaaatgtggaaaaacatatagccacaagtcataa

SEQ ID NO: 1402 - DNA, 3868 bp, Homo sapiens
ttttgtgggagtccggtctgtccacttgccggtccctcagaccgtcggcggtctctgtccgcttcgggacctgtccgctggtcgctccgcgtccgatggctcctggccgcggaaccttaggcctggccctggtctccgagcgcgggttcgccgggaggagcgtgtggcgggggtgtgccggggcgtgagtgcgccgagcatggggctgagcctggtgtggggagtgggtatctgcggagccggcctgaaccccacctcagccgggcgcggggagggggctccgtgcgtgtgatcgtgcagctgtgagcgcgtggccgccccgcggggctccgctgcaggcccctcagccccaggagcagtactcgctcttcagggcctgccctggatcctggaggctacacagctgcccactcctcctggggaggctgccgtggaggccatggagatccctgccccggagcccgagaagacagctctttcctctcaggatcctgctctttccctgaaagagaatctcgaggatatatcgggttggggtcttcccgaagccaggtccaaggaatcggtgagtttcaaggatgtggctgtggacttcacccaggaggagtggggtcaactagactcccctcagagggccttgtaccgggatgtgatgttggagaactaccagaaccttcttgccctaggacctccactgcacaagccagatgtgatctctcatctggaacgaggcgaggagccatggagcatgcagagggaagtccccagagggccctgtccagaatgggagctgaaggcggtgccctctcaacagcagggcatttgcaaagaagaaccggcccaggagcccatcatggagcggcccctcggcggggcgcaggcgtgggggcgccaggcaggtgctctgcagaggagtcaggctgcgccctgggcgcccgcacctgccatggtctgggacgtccctgtagaggaattccccctcaggtgtcccctcttcgcccagcaacgcgttcccgaggggggacccttgctggacacacgcaagaacgtccaggccactgagggcagaaccaaggcccccgcgagactgtgtgcaggggaaaacgcctccacgccaagtgagccagaaaagttcccccaggtgcgccggcagcgcggggcgggcgccggggagggcgagttcgtgtgcggcgagtgcgggaaggcgttccgccagagctcctccctcacgctgcaccggcgctggcacagccgggagaaggcttacaagtgcgatgaatgcggcaaggccttcacctggagcaccaaccttctggagcaccggcgcatccacaccggcgagaagcccttcttctgcggcgagtgcgggaaggccttcagctgccactcgtccctcaacgtgcaccagcgcatccacacgggcgagcggccctacaagtgcagcgcctgcgagaaggccttcagctgcagctcgctgctcagcatgcacctgcgggtgcacaccggcgagaagccctaccggtgcggcgagtgcggcaaggccttcaaccagcgtacacacctcacacgccaccaccgcatccacacgggcgagaagccctaccagtgcggctcctgcggcaaggccttcacctgccactcatccctcaccgtgcatgagaagatccacagcggggacaagccgttcaagtgcagcgactgcgagaaggccttcaacagccgctcgcgcctcaccctccaccagaggacgcacacgggcgagaagcccttcaagtgcgccgactgcgggaagggcttcagctgccacgcgtacctgctcgtgcaccggcgcatccacagcggcgagaagcccttcaagtgcaacgagtgcggcaaagccttcagctcccacgcctacctcatcgtgcaccggcgcatccacacaggcgagaagcccttcgactgcagccagtgttggaaggccttcagctgccactcgtccctcatcgtgcaccagcgcatccacaccggtgagaagccctacaagtgcagcgagtgcggcagagccttcagccagaaccactgtctcattaaacatcagaaaatccactccggggagaagtcgtttaagtgtgagaaatgtggggagatgttcaactggagctcgcacctcactgagcaccagaggctgcacagcgaggggaagcccttggccatccagttcaacaaacacctgctcagcacatactacgtgcctggcagcctgctgggtgcaggggatgctggactgagggacgtggatcccatcgacgcgctggatgtggcaaagctcttgtgcgtggttccccccagagctggcaggaatttctccctggggagcaaacctcgaaactaacatgatgtgctttggtgtcagtagctgctttctgagctactcaacaaggaaagcaccctggtcctccctggctcctagatccagaccaccttcctccaggtgtgggagccttgccttatcacccccatcaggtctgcatgccagggtgcctcctctagttaaagtcagtcacctccccagaagggccacactccaggaggagtgttgagagtcatttgaggtagtcttgccacctgttttccttgatgggcctggaagttgttgacaaggggaaagatctttcttgccaataaaaagaagggatatcgttgggtgccatggctcacacctgtaatcttaacactgtgggaggccaaggcaaggggatcacttgagcccaggagtctaggaccagcctggacaacatggtgagacctcgtctctacaaaaaatgcaaaaattagccagatgtggcggcatgtccctgtggtcccagctactcaggaggctgaggtgggaggatcatttgagcctaggaggtcaaggctgcagtgagccatgattcacagcactgcactgcagcctgggtgacaaagcaagaccctgtgtgaaattaaaaggaggtatatcaactgttgtatcctcggacgggctcctgacacggctttaatcaggagtttcctccataaactattattttcagaataataataaaacaagaattatgactagcatcactttccagtgaacattattatattgctagagaggagaataatcttgggtggtgggcatttggaaaaagtgaatttcctggacttaactcatgtaaatagctctactgcagagctgtgtgtttagtgacagtgcagtcaggggcattcccacagctgtcacagcacggcccagcatcattgtagccagatcctaacatgccaacatcacctcttgccatttagcccctagtgagaaattgggagctaccaggcaggtgcccagtgcattcagggaagatgggcacaacatcaggatgggtgtgtctggaagctcctcttcactgaccagggctgggcagggccaccctgggctggtgaggctgccctgcagggcttctcactatgtagcaccagtcaccagcccaggtcacagaagaagcccctcccagcacccactggagaggggaagctgaagcccagggagacgggctccatggtggtcccacatggagctgttttgcaaaccctggaaaaggcggctctccctgtcccaacactcttcagagacaggaagacagagttaatcttgaatgaatgttatttctacttagtcctaagcaagaataagctgccctcttggtgatcatactttatacggagtgctatcgtttatgaaatgctttcagtatgctttttaaattatgcaggcaaaataaccacacttcagaaaatgtggacttctgaaaaataaaatccccataattcttaataaaactgccttttgcactttgatacatta

SEQ ID NO: 1403 - DNA, 5583 bp, Homo sapiens
attggtctgtggacgccaaacttccgtgctaggactttctgcgtgtggaccgggggcctagtcctgcgtgggtccaacacagacaggagaaagctgcctgcttttgtgcctcccggaggtcctggtagaagcgaaacggggacaggagctgcagcgtcccaagcccagtgaggcgaagctactggagacagctctgccgggtccaaagttgggctcaccggctggaacttgaaaccggagcacgccggactcctgctgaagccatcatctctctctcctggccccgggcgccttggccggcgggcacaactggtttcggggccaaggtggtctggaagcctgactgtggcgtctggcctgggctcccgcgagcggaaaaggttcccctcctgtgagagggaaactatggaagttcctacgcccggagccagaactcctgctgctcccgcccgacccaaggtctagcttggcggcctcccacctgtgcttctgagggttctgcttccaagaggctgctggtgcccgggacaccagcagtttcgccatgggtgtttcgccatgggagtttcgccatgggtgactttggcctgagatgcgctccatggagcagattctggagttgctggtgttggaggagttcctgactatcctgtcccaggacatccacagcagggtgcagaagctgcaacgggcgagctgtgaagaagctgtaactcttttaaagtatatgtatgacttttaaaagagagagcttgtgaaactgagggaataggtgagtgagagagaggttttatctgccatcttcctcagggaggcccagcctcccctttattcatagagttctgggtctggtgggtccagaggactgagacatctcgctgtcttaattccccattcagattttcttgattgccctgagtagaccttacacgggccagtgattttttgttgttgttgttgttgttgtcttctctggaaccttcatcctccagatttccccccagtgcagtgaagagtgtgctattgcttttggtttccacggggaggcagtgtcgctgtcatagtgtccgctctggaggtagatcaaagggggctttcaactcctggctctgctccctactagctgtgcgactttgggcaagtgacttttgcttggctgggcttcactttctgcactggtcaaatgcagaaagggtaatagacccttctggggttgtttggaggattaaagggagagcagtatgtccgtaataatcgcactgctggcacacagctagtgcttgaaactgtgagctgctgttaggttaggggcagcagtctggtctcctctgcagagatgggtctcagttaattgtgaacttaaacagtttggcactgaggctttggggtcattgccccagggccacccaagtaagcttgtctaattgagaggaacaggagcagctggagaatgtgggggaggaaccgaagacctatgggggacatgtgtgtactgaaatgggctttctccccacaccctccacacaagcacatacacacattcactctgggtcatggcatcataaaaaccttgagtttaaaccatccctttctcttgttgggtccaaatggacagactctggttttctattgaagatttacacgcagattcctgtcataatttttcttttctatcgagccctgtcatgatgataagtgatagcaggttggttcctagatcatacaccatggacctagcacagaagtgttttcagaagagccttttccttacaaaacagcatgaaagtcattgagccaatggatactgagatttcaaactggagccaatggatacttagaggagccctgaagtgtagagtagttgctacttcttgttcactaggtctaattagcatgtcatcagtgtaacagactagtgtgttgtcttgtgaaagagaaaggtgataagatccctgtgaactaaactatgatgtagggcttgaaaattgatatacaatacgcctgaggtaggatggcgaaggtgtattcctggtcttaccagctgaaagtaaattgcttctggtggtctttactaacagttattgagaaaaaaagcattttcaaggtcaagaggtacatactaggttccaggggatatgttaatttgctcaagaaatgaaaccacatctggaacagcagctgcaattggagtcatcacctggcttagtttacaatgacccactaccatcttccaagatccatctgccttctgcataggccaaacaggtccacagaactcgaccctggaagagagagtcggggtcaggtcttcgggaggtggagggatcgaatgagggaactgatattccaagactccccacatcttggagcttcactcgccaggcatcccgcgctttcctgacgtcgcttcccctagtggtgcagcagcggagagctttgctacccagagcagcagggaggcgtggccacagaggcagaggcgtagtcgagccgaggaagaggaaagtggcctccggggaagccagagctgactgaagtgctcttgggaagaacaattcattgatttggtaccaacctgatgcaccctgatttgtcaaaggtggtaccaggtgggtgtcagtgtcacatacaagagtaaaactgttcctagagcaaatggcgatgagagagctgaacgcggattcatgctcaagcccccagatgggggctatgtgggagactagtgggtctgtgaaagagaactccagtcagagtaagaaatacagcacaaaaatagagaatcttggtcctgagagcgcttgcaggcacttctggagcttccgttatcatgaagcaaccggaccgcttgagactatcagccaacttcagaaattgtgccatcagtggctgaggccagagatccactcaaaagagcagatcttggaaatgctggtgttagagcagttcctgagcattctgcccaaggagacccagaactgggtgcagaagcatcatccacagaatgtcaaacaggctctggtcctggtggaattcttgcagagggagcctgatggaacaaagaatgaggtcacagcccatgagctgggaaaggaggcagtgctcttgggaggaacagcagtggccccaggcttcaagtggaagccagcagagccccaaccaatgggtgtgttccagaaagaatattggaatacataccgggtactacaagaacagctgggctggaacactcacaaagaaacccagcctgtatatgaaagagctgtgcatgatcaacagatgttagccctttctgagcagaaaagaatcaaacactggaagatggcatctaaactcatcctgcctgagtccctgagtttgttgacatttgaagatgtggctgtgtatttttctgaggaagagtggcaattattgaatcctcttgagaagactctctacaatgatgtaatgcaggatatctatgagactgtcatctctctagggttaaagctaaaaaatgacactggaaatgatcatcctatatctgtttctacatcagaaatacaaacatcaggatgcgaagtatcaaaaaagaccagaatgaaaattgcccagaaaacaatgggcagggaaaatcctggtgatacacacagtgtacagaaatggcatcgagcttttccaaggaagaaaagaaagaaacctgcaacttgtaaacaagagcttccaaaacttatggatcttcatgggaaaggccccacaggggagaaaccttttaagtgtcaggaatgtgggaaaagcttcagagttagctctgatcttattaaacaccacagaattcacactggagagaaaccctataaatgtcaacaatgtgacaggaggtttagatggagttcagatcttaataagcacttcatgacccatcaaggaataaaaccatatagatgctcatggtgtgggaaaagctttagtcataacacaaatctacacacacaccaaagaattcacacaggagagaagccctttaaatgtgatgaatgtggaaaaagattcattcagaactcccaccttattaaacaccagagaactcacacaggtgagcagccttatacgtgtagcttatgcaagagaaactttagtaggcgatcgagccttcttagacaccagaaactccacagaagaagggaagcatgtctagtgtctccaaactgaggaaagttaccatgtagagcttgactttagaagtggtgaaagaatacaaaattatgaggcacccaatgataggaatctgtgattaataaaacatttgggaagggtacatgttacacttcacaaaaaggaatctaagctgtctgttttattcagcattgcatcttctgtgcctagcacaagagttgatacataaggagtactttataaataaaaaaatgaaagtgtagtgatgagattcctttagctatctatctatatgtatatatctggttattcaaagcttccccacccccagtcatctaaatttttcaggtatcaagtgctcaacagacatatgatagtcaaggctcttagtctcattttttactctttgtcaagagaaatggaaaataagagtacttgggccctcttaagggagctcagagagaattactaaattagggacagtttcaatagttatcattctgtctacatgaacaatcaagaccaggactcagggaactttactctgtaacagaaagagaggattcagtgtttgccctgggagaattgtcccattcttgttgcttctctcctgagtacccactaccacaatgtcttctgtcaaggaattacaagtagcaagggaaggtctgaatgtaaggacaggcctagggaccttgcaagcacttgatatctctcctcttgctgactttgtcaacatagacatatagtgaaatgatgagggaggcagtcttggccctcatccaggtatctggtttttttttgtagaaagcacagataagtggtaaatggtctttttctgactttcattatgtggactggatggaggctttcaaactggtgccatactgctgcaggacctaaagggagccccatctttatggctgatcaactacaaccctatatgcctgaatactctgcaagaaggcctggagattttgcaaaactgatttattgagaatggcaaggagagccttgtgaacttttagctttggtgcacagctgataccaggagggaacatcctgaagtgtcagagaaaagtaaggcatatggctcacagtgatgatgccagtcagagccaggccagatggaaattgttttctgatgttactggttttcttttccctattagccaaagtgactatctcttaagagaagataatgtgacgtcaagggaagttggaaggcatggatttatatctatgtcagatcctggtttataatgttggccaaggcttatttatatatgtttatttagtattccataaaattgtacttcgtaatgaaaatgacacattttatcttaaatttagacaataaacaaaactttgttaccaaatcactcaaaaaaaaaaaaaaaaaaaaaaaaaaaaaaaaaaaaaaaaaaaaaa

SEQ ID NO: 1404 - DNA, 2141 bp, Homo sapiens
gcgccttagccagagggcgggcctgcgccaccctcggaaagcgtcacttccacttccggccggcgctctggctctgtacctggacagggctgcggtaggccagcggtgggctggcggttgcgctcctcagatcggcggcctttcgggcggtggcttgcgtttgagcctcagaaagcgaggagcggcctccacggaagccaagctggccgaggttgcagtccatgagctgggaaaggaggcagtgctcttgggagaaacagcagaggcctcaagtttcgggctgaagccaacagagtcccaaccagtgggcgtatcccaagatgaagaattttggaatacatacgagggtctgcaagaacagctcagcaggaatactcataaagagactgagcctgtgtatgagagggctgtgcctactcaacagattctagcttttcctgagcaaacaaacaccaaagactggacagtgacacctgagcacgtcttgcctgagtcccagagcttgttgacatttgaagaagtggccatgtatttttcccaggaagaatgggagttattggatcccactcagaaggccctctacaatgatgtaatgcaggaaaactatgagactgtcatctctctagcattgtttgtgctccccaaacctaaagtgatctcctgtctagagcaaggggaagagccatgggttcaagtatccccggagtttaaggatagtgccggaaaatctcctacagggttaaagctcaaaaacgacactgaaaatcatcagcctgtgtctctttctgacttagaaatacaagcatcagcaggcgtcatatcaaaaaaggccaaagtaaaagttccccagaaaacagcaggcaaagaaaatcattttgatatgcacagagtgggaaaatggcaccaagattttccagtgaagaaaagaaagaaactttcaacctggaaacaagagctgctcaaacttatggatcgtcacaagaaagattgtgcaagagagaagccttttaaatgtcaggaatgtgggaaaaccttcagagttagctctgaccttattaagcaccaaagaattcacactgaagagaaaccctataaatgtcaacagtgtgataagaggtttagatggagttcagatcttaataagcacttaacaacacaccaaggaataaaaccatataaatgttcatggtgtgggaaaagcttcagtcaaaatacaaatttacatacacaccaaagaactcatacaggagaaaagcccttcacatgtcatgaatgtggaaaaaaattcagtcagaactcccaccttattaaacaccggagaacccacacaggtgagcagccatatacttgtagcatatgcaggagaaacttcagcaggcggtcaagccttcttagacaccagaaactccacctgtgaagagaagcttgtccagtgtcctcattctgaagacattcaccaaatggagcttggcactaaaatttatgtaaaagaaaaatcacaaaccttgaaaaattttacatcagaaaatgggataaacatacatttcacagaaaataatcaagacttgctctgcagccactcagtagtcttctgtggtcacagaagtaaacattgttggctttgtattgatctctccagtcatttttgaacacatccaatagaaacattggcagcatggtcttccaaaacaaaaagcagtaacatgcatgtttaattgcataccattctcttcacagtagcaggcttaccaatttccatagtctcatgaggccgaaatgaattacaatgtaaagtgttccaggaaccaaattggattttctttcttttgtcattggacacggtttgcaaagttggacatcacttgagttccttcttaaacttttcggcaacttctcttggatcctgttatcacagttttttactgtgatgaaatcttgttaaccaccactagggaatctccagatgaactattaatgcactgtcttatgcctctcattggtgatgtttggaaaatagaagacatctctaatggaatcatgggggaaacgggttggaatttgtagccatggaatatatattagatgtaaagaattttctgcaataaaagaaactagacttgttaaaaaaaaaaaaaaaaaaa

SEQ ID NO: 1405 - DNA, 2671 bp, Homo sapiens
ctgcgcgcgggcgggcgggctatggcgcaggcgggttgtggggccggcgctggtggcggggcccggtgcatggcggtctgtcggcggagtcgccctcgggggctgtcagatttgtgacccagaaggaaatctctgacctcagctgtggctcttggtgctggccagaagccaacttcatgtctgagtgcacgagcagcagtttgccatggagagcttggggctgcacacggtgacccttagtgatgggacaacagcctacgtccagcaagctgtcaaaggagagaagcttcttgaagggcaggtgatccagctcgaggatgggaccaccgcatacattcaccaggtgacggtacagaaagaagctctctcctttgaggatggtcagcctgtgcagctggaagatggcagcatggcttacatacaccgcacacccagagaaggctatgaccccagcaccctggaagccgtccaactggaagatggctccactgcctacattcaccaccctgtggctgtgccatcggagagcaccatcctggccgtacagacagaggtgggcttggaggacctggcagcagaggatgatgagggcttcagtgcagacgcagtggtggccctggagcagtatgccagcaaggttcttcatgacagccagattccccgtaatggaaaagggcagcaagttggagacagagcattccgctgtggctacaagggctgtgggcgtctctacaccaccgctcatcacttaaaggtgcatgaacgagctcatacaggtgaccgtccatacagatgtgacttccccagctgtggaaaggcctttgccacaggctatggactgaagagccacgttcgtacccacactggtgagaaaccatacaagtgcccagaggagctgtgcagcaaggccttcaagacctcaggagacctgcagaagcatgtccgtacccacactggtgaacgcccgttccagtgcccttttgagggctgtggccgctccttcaccacatctaacatccgcaaggtacatgtgcgcacccacacaggcgagaggccctacacctgcccggagccccactgtggccgcggcttcaccagcgccaccaactataagaatcacgtgcgcatccacacaggggagaagccatacgtttgcacggtgccaggctgcgggaaacgcttcaccgagtactcgagcttgtataagcaccacgtggtgcacacacactgcaagccctacacctgcagcacctgcggcaagacctaccggcagacctccaccttggccatgcacaagcgcagtgcccatggcgagctggaggccacggaggagagtgagcaggccctctatgagcagcagcaacttgaggccgcctctgcagccgaggagagtccgccacccaaacgaccccggatagcttacctttcggaggtgaaggaagagagagatgacatcccagcccaggtggcgatggtgactgaagaagatggggccccccaggtggctctgatcactcaggatggtgcccagcaggtcagcctgtccccggaagacctgcaggccctggggagtgccatcagtatggtcacccagcacggcagcaccaccctcaccatccccagtcctgatgccgacctggccacatctggcacacatacagtcaccatggtcagcgccgatggcacccagacgcagcccgtcacaatcattacctctggggctgtggtggctgaggactcaagtgtagcatctcttcgtcatcaacaggtggcactgttggccacagccaacggaacgcacattgcagtgcagctggaggaacagcagaccttagaggaggccatcaatgtggccactgcggccatgcagcaaggggctgtgaccctggagacaacagtgtcggagagtggctgctgagtccaagagggctgggtcccacaccatgctggaggaagtgccatctgcatggccactcttgcccccaagggcccaggctgtggctgacacatagaaggtggccacataggtctctggggtgagaagacagcaagaaaactgcctaactgaagggaatgggggccctgctcaagaagggggccaggcagctggaatcaggggagtgcatcatcctcgggagctgacaacagccaggctacaccagggcacccgcctctcaaaatcagctgggcgcccactctcctcctaaagaacacccttctggccctcagtctgttccccttctcaggtagagattggggctgctatggggactggccctgtagggttgagccacagacagctcttcagcccagtagcagtggagcaggccctgtcctgccctcccagcaataaccacctccctggaggccagctgagatgcctggctacttggcaccagggacttcctgacaccacagtcaattaattcctcaggggcctgtggctggagaaaaggtgcccagcccccaccactcctcagctgccccccaacctctctatggcagagaggcagggagtggccctgtacatagactgctggggattgggtttgatttgttttgtttttttaaattccattttgataatttttttcctgctctgggtggtggtggcacatggatgaatgagtatttaataaaagttccaaatttcaaaaaaaaaaaaaaaaaa

SEQ ID NO: 1406 - DNA, 2057 bp, Homo sapiens
aagccgagttcccctctgccttgcgcgcttccccgcctaccccgagcggctcaggtgtcctgtcgtgctcacctgcgccggtcgctggaccgcggggcgctaaccctggagagcccaggagcgggcgggacatggactgcgtgatctttgaggaagtggctgtgaacttcaccccagaagagtgggcattgctggatcatgctcagaggagcctctacagagatgtgatgctggagacctgcaggaaccttgcctccttggattgttacatttatgttagaaccagtggatcaagttctcagagggacgtttttgggaatggaatatccaatgatgaagaaattgtaaagttcacaggaagtgattcctggtctatttttggagaaaattggagatttgataacactggagatcagcaccaaatcccacagaggcatctgagaagtcagctggggagactctgtgaaagtaatgaaggtcatcaatgcggagagaccttgagccagactgcgaaccttcttgtgcacaagagttaccctaccgaagctaaaccctctgagtgcactaagtgtggcaaagccttcgagaatcggcagagatctcacactggacagagaccgtgtaaggaatgtgggcaagcctgcagctgcctctcctgccaaagccctcctatgaaaacgcagactgtagagaaaccctgtaattgccaggactcaaggacagcatctgtgacatacgtgaaaagtctcagcagtaaaaagtcttatgaatgtcagaaatgtggaaaagctttcatttgtccctcatctttcaggggacatgtgaatagtcatcatgggcagaaaacccatgcatgtaaagtatgtgggaagacctttatgtattactcctaccttacacggcacgtaagaactcacacaggagagaaaccctatgagtgtaaggagtgtgggaaagccttcagctgtccctcgtactttcgagaacatgtcagaacacacactggagagaaaccgtatgaatgtaagcattgtggaaaatcattcagctgttactcctcctttagagatcacgtgaggacgcacactggagagaaaccctgtcagtgtaaacattgcggaaaagcgttcacttgttactcgtctcttcgagaacatgggagaacgcacagtggagagaaaccctatgaatgtaaggaatgcggcaaagccttcaggtacccctcctctctgcgagcacacatgagaatgcacaccggagagaagccctatgtgtgcaagcagtgtgggaaggccttcggatgtcccacttactttagaagacatgtgaaaacacacagcggggtgaagccctatcaatgtaaagagtgtgggaaagcctacagtttttcctcctcccttcgaatccacgtgaggacgcatactggagagaagccctttgagtgtaagcattgtgggaaagccttcagctgtcactcctcccttcgagagcatgtgcgaacccacagcggagagaaaccgtacgaatgtaatcaatgtgggaaagccttcagccacgctcagtactttcaaaagcatgtgagatcacacagtggggtcaaaccctacgaatgtactgaatgtgggaaagcctacagttgttcctcgtcccttcgtgtgcacgtgagaacgcacactggagagagaccgtatgaatgcaagcagtgtgggaaaaccttcaggtatctcgcatcgcttcaagcacatgtgagaacacatgctggagcgtgaatctacgaatacagtggacctgggagagtgttcaaccgtaaaaccttgttgtaaatgtgagaaacgttatttatgtagagcatgtaggaaaacctggtatagcacttattttgtacctaaaaattcagagtaggagagaaatctcttaattatgattaatatggtattgcctttacatgcctcagccttaatagtgattccttttgtattaatttctagtgtatgtttgtgatataaacatttaataaatatcctgttttgtacgctttcaaaaaaaaaaaaaaaaaa

SEQ ID NO: 1407 - DNA, 2099 bp, Homo sapiens
gtggcgccaatcaggcgcgtccctctggcgctggagccaggacctggcgttgggcggtacttggacagcggttcttgagctctcgcggttgccggtagattgttgccagttgccagttgccagtcgtttttcggaaagctggcagcggctttttcaccgggttctgcttgaggccgagccaaagagtggctgtgactcgggagacggagtggaacacccggctgggcaggcccggacagctcccgcgacccagcaccgcaggatcagaccgtgcctctgcggggagaggctggagaggaagagtccggcctgggagccgtcagagcagccctgcagaacggggtgggggctgctgtagatagacccttacgcccagagaactgctgggaggctgtggcgcgaggcgggactcaaatgctggaggaaggagtactgccttccccaggccctgcccttccccaagaggaaaacacaggagaggaaggaatggctgctggtctcctcacagctgggccccggggatccacattcttcagcagtgtgacggtagcttttgcacaggaaaggtggaggtgcctcgtgtctactccacgggacaggttcaaggaggggataccaggaaagtccaggagccttgtcctactaggacttccagtttcccagcctggcatgaactcccagttggaacaaagggaaggcgcatggatgctggagggcgaagacctgcgaagtccctctccaggctggaagattatatctggatcaccaccagagcaagccctttctgaagcttcattccaagacccatgtgtagagatgccccctggggattcagaccacgggaccagtgaccttgagaagagcttcaatctgagaccagtcctctctccgcaacagagagtgcccgtggaagcgagacctcgcaaatgtgagacacacaccgagagcttcaagaactcggaaatcctgaaacctcacagagcaaaaccatatgcatgtaatgaatgtggcaaagccttcagttactgttcttccctttctcagcatcagaagagccacactggagagaagccctatgagtgcagtgaatgtgggaaggccttcagccagagctcatctctcattcagcaccagaggattcacactggagagaagccttacaagtgcagtgaatgtggaagagccttcagccagaacgccaacctcaccaaacaccagcgaacccacaccggagagaagccctacagatgcagcgagtgtgagaaagccttcagtgactgctcagctcttgttcagcatcagagaattcataccggagagaagccctacgaatgcagcgactgtgggaaggccttccgtcacagtgcaaacctcacgaaccatcagaggactcacaccggggagaagccctacaagtgcagcgagtgtgggaaggccttcagttactgcgcagcgttcattcagcaccagaggattcacaccggggagaagccctacagatgtgccgcgtgtgggaaggccttcagccagagtgcaaacctcacaaaccatcagaggactcacactggggagaaaccctacaagtgcagcgagtgtgggaaggccttcagccagagtaccaatctcataatccaccaaaagacccacaccggggagaagccatataaatgtaatgaatgtgggaaattcttcagtgagagctcagccctcattcggcatcatataatccacaccggagaaaaaccttatgagtgtaatgagtgtggtaaagcgtttaaccagagctcatcccttagtcagcatcagagaatccacacaggcgtgaaaccctacgaatgcagcgagtgtgggaaggccttccggtgcagctctgccttcgttagacatcagagactccacgccggagagtaactaggaacatggtagaagtggagagagtcccggacatgccgactcaggacaggtgggtgaggatctgagaaatgctaaaggcttgaaagcatctgaagacatctaacttagagtctgcagcccagagccacatgcaaaacaccttcaataaacagccactatttcacatgctgtaaaaaaaaaaaaaa

SEQ ID NO: 1408 - DNA, 1944 bp, Homo sapiens
gactttacccaggaggaatgggggcagctggaccctacccagaggatcctctaccgtgacgtgatgctggagacctttggctacctgctctccataggtcctgagcttccgaagcctgaagtcatctcccagctggagcaagggaccgagctatgggtggctgagagaggaaccacccagggctgccatccagcctgggagcctcgatctgaaagccaagcatcacgcaaggaagagggcctgcctgaagaggagccatcccatgtcacgggaagggaaggattcccgacagatgctccttatcccaccacgttagggaaagacagggagtgtcagagccagagtctggcactcaaggagcagaataacttgaagcagttggaatttggcctcaaggaagcaccagttcaagatcaagcctacaaaactctcagactcagggaaaactgcgtcctgagttcaagcccaaatccattcccagagatctctagaggggagtatttgtatacttacgactcacagattacagactcagaacataactccagcttagtcagtcagcagacaggctccccaggaaaacagcccggtgaaaacagtgactgtcacagagattccagtcaggccattccaattacggaactcacaaaaagccaggtgcaggacaaaccctacaaatgtactgactgtgggaagtcgtttaaccataacgcacacctcaccgtgcacaagaggattcatacgggagaaagaccttatatgtgcaaggagtgtgggaaagccttcagccagaactcctccctcgtccagcatgagcgcatccacactggagacaagccctacaagtgtgccgaatgtgggaagtctttctgccatagtacacaccttaccgtccatcggaggattcacactggggagaagccctatgagtgtcaggactgtgggagggccttcaaccagaactcctccctggggcggcacaagaggacacacactggggagaagccatacacctgcagtgtgtgtgggaaatccttctctcggaccacttgccttttcctgcacctgagaactcacaccgaggagaggccctacgagtgtaaccactgcgggaagggcttcaggcacagctcatccctggcccagcaccagcggaagcacgcgggggagaagccctttgagtgccgccagaggctgatctttgagcagacgccagctctcacaaagcatgaatggacagaagccctgggctgtgacccacctttgagtcaagatgagaggactcaccgaagcgacagacccttcaaatgtaatcagtgtgggaagtgtttcattcagagctctcacctcatccggcaccagataactcacaccagagaggagcagccccatgggcgaagccggcggcgtgaacaatcctcgagcaggaactcacacctggttcagcatcaacacccgaactccagaaagagctctgcaggcggacgaaaggcagggcagccggaaagcagagccctggctttgtttgacatccaaaaaatcatgcaagagaaaaaccctgtgcacgttattggggtggaagagccttctgtgggtgcttccatgttatttgacatcagagaatccacataggagagaaactttgctgatgacttttaaccacaagtaaaaaatgtggtaagtccacatagtgtactcatggaaggaggggctgggggtagaaatgtcatgggtgacttctgactttctaaggaaatgatgcttcccaagcacccgaggttggttggtcccaaatctatcaaactcagtgccctctttagcgacatattttgtgacattccttccattacaccacagtgagttcacaggtaatataacctacccacctgtgtaatgtcgaaaaaaatcaatatgcggcccctatttgtaaaggatcattaaaat

SEQ ID NO: 1409 - DNA, 2957 bp, Homo sapiens
gccggagccagcagtggcaacccgctggggtccctttccacactgtggaagctttgttctttcgctctttgcaataaatcttgctacttctcactctttgggtccacactgcttttaccagctgtaacactcaccgcaaacgtctgcagcttcactcctgaagccagcgagaccacgagcccaccgggaggaacgaacaactccagacgcgccgccttaagccttaagagctgtaacactcaccacgaaggtctgcagcttcactcctgagccagcgagaccacgaacccgccagaaggaagaaactccgaacacatccgaacatcagaaggaacaaactctagacgcgccaccttaagagctgtaacactcaccacaagggtccgcggcttcattcttgaagtcagtgagaccaagaacccaccaattccggacacagttggaaatgcagaagggcacttgagtttggctgcagtctcccacacggagaccttctggaggaagatgagccctaaacgcgatgggttggggacaggtgatggtctgcactcacaggttttacaggagcaggtctccacaggagacaatctccatgaatgtgactcccagggaccaagtaaagacactttggttcgtgaggggaagacctacaaatgcaaggaatgtgggagcgtgtttaacaaaaacagcctccttgttcgacatcagcagattcacactggggtgaagccttatgaatgccaggagtgtggaaaagcctttcctgaaaaggtcgacttcgttcgacccatgaggattcacacaggggagaagccctgtaagtgcgtggagtgcgggaaggtcttcaaccgcaggtcgcacctcctgtgctaccgccagattcacactggagagaagccctatgagtgcagcgagtgtggaaagaccttcagctatcactctgtcttcatccagcatcgtgtgacccacactggagaaaaactctttgggtgcaaagaatgtggaaaaaccttttactacaactcttccttaacccggcacatgaagattcacactggagagaagccctgcaagtgcagtgagtgcgggaagaccttcacctaccgctctgttttcttccgacatagtatgacccacactgcaggaaagccctacgagtgcaaagaatgtgggaaaggtttttactacagctattccctcactcgacatacaaggagtcacactggagagaaaccttatgagtgccttgaacatagaaaggactttggctaccactctgcttttgcccaacagagtaagatccactctggaggaaaaaacctttgagtgcaaatgatgtgggaatttgtgggttttctttttttttttttctttgatacatagagagccacactgaggagaagcactctgaattcagtggcagtaggaaagctgtgacctgcagctcatcctcacttggcattgaagaattccttccagagataaactctatgagatatgtgggaaggccttttgcaagtgggcccacatcagtcaacgtcagagaacttaaactgcgaaaagacattttgacaaaaactagtgaagaaaatcttttggccacaggaaatatcttcctcagcatctgagaatttttccaggagggagacctgttggttattgtgcacttaaaagaaccacccacacctctctccatagtttatatcactaagccacttcaggattttttttttttaagtaagaagggaactgtaaaagagaaaaaaagaaattcatgcatagcttctgtcagacttctctgaaagccatgcctatcaaaatttgaattcagttcttcattttgcagatggctgaaaggtacaaaggccttgcctcgttatttgtcctttatatgtattcactcctgtctacaggagaattgtcctctgtaaagattaactctgtaaagatttattgaatgcattctttgttctaaaacattgtactcctgaggaatgtaagtctttgtgagaaatatgaacgcttaagtaatggaatatgtgaaacttgtaagaacgtagaatataaaaatactgccatataaaatcctttcatatctgaggaggtaagtaaccacattgaatgggcatattttgctacatcatttaagactacttaaggctttaatttaacaaaaaacaattcttcatgtggttttgaacacccagtgctcaatatacttgtttgttttgatttattttctcagggacgagagaatgatggtgaagctgtgttgctttcccaggtgagccttgattatttcctctgtgctttctcagcttctttggccttctgtaagaggggcttctccaagagcatgtcactagttttctagaagttaaacaagagctaagacaaacaaaacaaaacacagcttatctaatctaatgagaaactcagaaaaaaatgttttgatgaatacaatgtattaaaatataaaacatgtagatcctttgacatgttaattcaattctagaaatcctcagaaatgtttttatattatgcagagatgtgcgtgcaaagaataatcgctgcagttttgtttttatgtgtgaaacgttgagaacaatctaaatgtttatcagttggaagtaagttatggtacatctgttctatgaaatactgtgaaacaataaggtatctctgtatgtactgatatcaaaacatctctaagatacagtatttagtaaaagagaaagtttcaggaaataaaactacatctagaagtataagcataaaactgttaatagtggttttctgcaggaaatgggatggaccagggttatatgcaatgttcagtttttacttttatacttaagtattgtttatgtttgaaaaataaaaagcatttattgtttttgcaataaatgtttaaaatatttcaataaagatagcatgttagaataaaaaaaaaaaaa

SEQ ID NO: 1410 - DNA, 1092 bp, Homo sapiens
agagatgaaaaactctacatatgtactaaatgtgggaaggccttcatccagaattcagaattaattatgcatgagaaaactcatactagagagaaaccctataaatgcaatgaatgtgggaaatcatttttccaggtgtcatctctactcaggcatcagacaactcatactggagaaaaactctttgaatgcagtgaatgtggtaaaggcttctccctgaactcagccctcaatatacatcagaaaattcacactggagagagacatcacaaatgcagtgagtgtgggaaagcctttacccaaaaatcaacactcaggatgcatcagagaattcatacaggagagaggtcctatatctgtactcaatgtgggcaggccttcatccagaaggcacacttgattgcacatcaaagaattcatactggagagaagccttatgaatgcagtgactgtgggaaatctttcccttctaagtcacaactccagatgcataagagaattcatacaggagagaaaccctatatatgcactgaatgtgggaaggctttcaccaacaggtcaaatctcaatactcaccagaagtctcatactggagaaaagtcttatatatgtgctgaatgtgggaaggccttcaccgacaggtcaaatttcaataaacaccagaccattcacactggagagaaaccctatgtttgtgctgattgtgggagggccttcatccagaagtcagagttgattacacatcagagaattcatactacagagaagccttataaatgtcctgactgtgagaaatccttctccaagaaaccacatctcaaagtacatcaacgaattcacacaggggagaaaccatatatatgtgcagaatgtgggaaagccttcactgataggtcaaatttcaataaacatcagacaattcatactggagataaaccgtataaatgcagcgactgtggaaaggggttcacccagaaatcagttctcagtatgcatcgcaatattcatacatgaaagtaatcctgtttcttgaaaatgagagccttataagctgacaaaagtcaggtctaactatatattataaaatcatcc

SEQ ID NO: 1411 - DNA, 2622 bp, Homo sapiens
agacctggcttctgtactgcgcgcgcacatgcgcgcaaacccggaagcggattatgtggagtgaaagttacaccgtggcggattgacttctaaggactcttggtacatgaggaagaaacccggaaggggaagaggaaagcaaaggcgtcaggaatggttcttcctcaggtattttttctaaatgtgagatcaaggaattaccaccaaaaaaggagagtaatacaggagaaatattccagacagtaatgttggaaagacatgaaagccacgacatacaagatttttgcttcagagaaacccagaaaaatgtacatgactctcagtgtctgtggaaacatgattgaagacattataagcgagtgcgtgtgacctataaggaaagtctcattggtagaagagacatgcatgggagaaaggatgatgcacaaaagcagcctgttaaaaatcagcttggattaaacccgcagtcacatctaccagaactgcagctatttcaagctgaagggaaaatatataaatatgatcacatggaaaaatctgtcaacagtagttccttagtttccccaccccaacgtatttcttctactgtcaaaacccacatttctcatacatatgaatgtaattttgtggattcattattcacacaaaaagagaaagcaaatattgggacagaacactacaaatgtagtgagcgtggcaaggcctttcatcaaggcttacattttactatacatcaaataatccatactaaagagacgcaatttaaatgtgatatatgtggcaagatcttcaataaaaaatcaaaccttgcaagtcatcaaagaattcatactggagagaagccatataaatgtaatgaatgtggcaaggtcttccataatatgtcacaccttgcacagcatcgcaggattcatactggagagaaaccatataaatgtaatgaatgtggcaaggtctttaatcaaatttcacaccttgcacaacatcaaagaattcataccggagagaaaccttataaatgtaatgaatgtggaaaggtcttccatcaaatttcacaccttgcacaacatcggacaattcatactggagaaaaaccttacgaatgtaacaaatgtggcaaggtgttcagtcgcaattcctaccttgtacaacatctgatcattcatactggagagaaaccttacagatgtaatgtatgtggaaaggtcttccatcatatttcacaccttgcacaacatcagagaatccacactggagagaaaccttacaaatgtaatgagtgtggcaaggtcttcagtcacaagtcatccctagtaaatcactggagaattcatactggagagaaaccttacaaatgtaatgagtgtggcaaggtcttcagtcacaagtcatccctagtaaatcactggagaatccacactggagagaaaccttacaaatgtaatgaatgtggcaaggtcttcagtcgcaattcataccttgcccaacatctgataattcatgccggtgagaaaccttataagtgtgatgaatgtgacaaagcattcagtcaaaattcacatcttgtacaacatcacagaatccatactggagagaaaccttacaaatgtgatgaatgtggcaaagtcttcagtcaaaattcataccttgcatatcattggagaattcatactggagaaaaagcttataaatgtaatgaatgtgggaaggtcttcggtctaaactcatccctagcacatcatcggaaaattcacactggagagaaacctttcaaatgtaatgaatgtggcaaagcttttagtatgcgttcaagcctcactaatcatcatgcgatccacactggagagaaacatttcaaatgtaatgaatgtggcaaactcttccgcgacaattcatatcttgtacgtcatcagagatttcatgccggaaagaaatctaacacatgtaattaatgtggcagagtgttcagttagcattaaagccttgtaagacatacaataatttatactggagaaaaactttgcaagtataatgaatgtagcagagcctttagtttttgttcaaggcttaataaccgttagctagaccatagaggacagaaactttactaatgtactgaatgtggcaaggtcttaaggtaaaatctgagaccaggattcttcaaagaattcttgctggtgagaaacctaacaaatgtaatgaatgtggcaaggtcttctggcacaattctcacattgtacaatattgcaaaaattcatgcttgagagaaacaaaaacactgagagtgggaaaccattatgacttcaaacattcatcaacatcagagaatccatactaaagagcatttataataattatatgtgatagagattttccgcaggccaaagtctcactaggcatcaaaaacttttttgatgaaaccatacaaatgtaacgtgcatgcttaagcttttacccaggcatcaaaaccggaacatcacagggtttatactggagagtaactacacaaagataatgtaataagcctttcagtgtaatattcatgattttgtcgtgagagatccactcaataaaaaccaggcaaatgtagtgaatctggaaaaaaaaaaaaaaaaaaaaaaa

SEQ ID NO: 1412 - DNA, 7025 bp, Homo sapiens
actcttggtaatgcttgcaggtggcccgttcttcctctttgtccttcgctgccacgtgagaggggagtgtacgcgtgtgcgcgcgtgcgagtgtgcgcgtgtgcagtccccgactcgtcccggcccgttcggagccgcccgggagcgcacaaaggccgacggtttgggcgcgtgcgcgggacacgggggacgggcggtgtcacgtgatcgcgaggccgcgggcgcgcgggcgcgactcggcggcggcgtcttttatcctggtccctacaaataagcctgctcatgtgagataagaaaggagttcctggaaccaggaattcattctcagtgtagaagacctagctgagacctcactccacagttttggggcagaagcagaagagacgcacagtagaaccgatctcagccttgctgatcatctcgtacagcagcagaaaatgaccatgttacaggagtcattctcatttgacgatttatctgtggacttcacccaaaaggagtggcagctactggatccctctcagaagaatttatacaaggatgtgatgttggagaactatagcagcctagtgtcactggggtatgaagttatgaaaccagatgtcatcttcaaattggagcaaggagaagagccgtgggtaggagatggagaaattccaagttcagattctccagaagtctggaaagtagatggtaacatgatgtggcaccaggataaccaagacaagcttaaaattataaaaagaggtcatgaatgtgatgcatttggaaaaaatttcaatctgaacatgaactttgttcctttaaggaaatcaaacagtgaaggtgacttagatggattgattttaaaacatcatttagatttgcttattccaaaaggagattatggaaaagcagaatcagatgactttaatgtgtttgataatttttttctccattccaagcctgaggatactgatacctggttaaaatactatgactgtgataaatataaagagagctataaaaagtcacagattatcatatatcatagaaatcgtttaggggagaaactctatgaatgcagtgaatgtaggaagcgcttcagtaagaaaccaagtctcattaaacatcagagcagacatataagagacatagcctttggctgtggtaattgtggcaaaacctttccccagaagtctcagtttattacacatcacagaactcatacaggagaaaaaccttataattgtagccagtgtgggaaagccttctcccaaaagtcacagctcacatcccatcagcggacacatacaggagagaaaccttatgagtgtggtgaatgtgggaaagccttctcccggaagtcacatctcatatcgcattggagaacacacacaggagagaaaccctatggatgcaatgaatgtgggagggcctttagtgaaaagtccaatctcattaaccatcagagaattcataccggtgagaagccttttgaatgcagggaatgtgggaaagccttcagcaggaagtcacaactcgttacacatcacagaactcacacaggaacaaaaccctttggatgtagtgattgtagaaaagcattctttgagaagtcagagcttattagacatcagacaattcatactggagagaaaccctatgaatgcagcgagtgtaggaaagcatttagagagaggtcgagtctcattaatcatcagagaacacatacaggagagaaacctcatggatgcattcagtgtgggaaggccttctcccagaagtcacatctcatatcacatcagatgacacacacaggagaaaaaccctttatatgcagtaaatgtgggaaagccttcagcaggaaatcacagctcgttagacatcagagaactcatacgggagaaaaaccgtatgaatgcagtgagtgtgggaaagctttcagtgaaaaattaagtctcactaatcatcaaagaattcatacaggagaaaaaccatatgtatgcagtgaatgtgggaaagccttttgtcagaagtcacatctcatatcacatcagaggacacatacaggggagaaaccctatgaatgcagtgaatgtgggaaggcctttggtgagaagtcaagtcttgcaactcatcagagaactcatactggagaaaaaccgtatgaatgcagggactgtgaaaaagctttctcccagaaatcacagctaaatacccatcagagaattcacactggagagaaaccctatgaatgcagtctttgtaggaaagctttttttgagaagtcggagctaattagacatctgagaactcatacaggagaaaaaccttatgaatgcaatgaatgtagaaaagccttcagggagaagtcaagtctcatcaatcatcagagaatacatacaggagagaagccttttgaatgcagtgagtgtggcaaagctttctctcggaagtcacaccttataccacatcaaaggacacatacgggtgagaaaccctatggatgcagtgaatgtaggaaggccttctctcagaagtcacagctggttaatcatcagagaattcatacaggagagaagccttatcgatgcattgaatgtgggaaagctttctcacagaagtcacagctcatcaatcatcagagaactcatacagtaaaaaaatcctaggaatacagttaatagtagtctttgacagatcatcttggacttcaggaaatgcaattatgataacgtttgtagacagtcacgtcatgttaggtgtctgtactccatgaggatgagaactctaaatgaggtggtgtatggaaagccgatcataattcatagagtagagtgaacctatgactgcagtggatctcaaaaacttttaaaaccatagacaagccttatagagtagaacattcacagcaaagaagaatcctgtgaatgtccaaaagccttccagaagtcaagtctcttaagctattagaaatattcccactggggatgagggaaaaccccatgaatgcgggaaatgaggcaatatttttaagaaatgacagttcattgtacataagaaaatgctcttaggaatgaagttctatgaaagtactaaatatgggacagtgcaacaagtaaccagactattttgtattttggagaattcatattatggagaacctaacaatttaaagacactgggaacacttgcccctcagtatagtactgtcaagggaagccatacactttttgtagacatgggtaccaaaaatacccaattctaagtggttgacagatgttcactttgaagtgtgaagttttaaaaatacgtgaataaattggttattgaaacatctaagacatttcttagtggtatttgtggcttatcttctagtgtcacgtatgttttgtgttttggacttacctataatttaatgtaattgggagtatgaaatgcatatgccttttagtgcctctgatgtctgtgaagacaacactacacaccactggtttttattttttaacaataatataaaaaatggaaactcatgtaacatgactacatgaataagtaccttaagtgataacccgtttcttttaacttatagacatacataaggggtcttttgtttttatggacctttctattcagtaactgaagccaacattgtgtaagtcttctgcatcctcagagtctgagtaacagtttatataaaataaatatgcaaaggcaggaaccacagaataaccatagtaatatataactgaatgagcaaaataaaggtgtgtgaactacattacaacacccaaactaaatgaaataaagtagtgctgtattaaatctttttctcatttagtgaggtgcctccatatagtatatatatatgtatcttaagtgatatgtaacccaaatgtcactattttaatttactgtgataaagtatcatggatattttgtgctgctgttatgctttttgtgttgcataaaatatcttgtaaaaattagatggataaatgaattattaaaaaatcacatttctgaagatgtaaagtattagggaattttgtgctggaaaaacatttttgacattcaaggatgcctattttatcttctagcaaatttctgtggtccctggaaaagtacagatgatcctggacttacagtggggttacctcccaataaacccattgtaagttgaaaacattgtaagtcaaaaatgcatttaatacacccaacttaccaaacatcatagcttagcgtagcctaccttaaacattctcagaacacattctaatgcatcatctattttataaaaaggtgttgaatatctgatgtaattattgaatactgaaggtgaaaaatagtagtgtatggataccattgtaatgttgagaaactgtaagtcacatcctcttaagtcaggaactatctgtataaggaaacaagatttccattttatcatttgaaatgtatttgactttgtttcactagttgcattatccccatggaaaacttcacattgagaacttaccattatatatttccataaaaatgcatgaaccatcccttagctaagtaaggattttgtaatgttctctcaataatgttgcttggcaaagttaatattttttgtatgctgatgaaatttagaaaagtccaatattgagcttgattgcaaacttagaaaaactcaagacttctccttttatgttcaaattgttgtatcagtatggtattttgcacctttaccttaaacaatattttctcctttaattattgattttgcaacattttgggaaagttggaattttaaataaatgaataattttctaaaccagaataccagttcaacagccaaataattctgtctttccatgctgtaattttaaagcatttaattttccaactttttgttcatactcaagtgtatgaacttcctggctgggcacagtggctcatgcctgtaatcccagcactttgggaggctgaggacctcaagtggagacctcaagtggatcacttgaggtcaggagttgaagaccagcatgttcatggccaacatggcaaaaccctgtcttaaattagccgggcatggttgtgcgtgcctgtaatcccagttactcaggaggctgaggcaggagaatcacttgaacctgagaggcagaggttgcagtgagccaagattgtgcagcctgggcgacagagcgagcctctgtcaaaaaaagaaaagaaaaagaacttcctactttttaatatctcaaattcattttactagacgtgggagaccaactaatgcaaatgaacagttacagggtgatgttgtactttgtgatttttgccctattttttctttccatctatcaccattctctttccaatcccagagattgatttattaggtcttggaaattctagattattccattaactattaagcagttaaacctgatacttcctacactagataatggaacttcaacattagcctattgattgcccaagaacaaacatttttttctaaatgtcaggtgttatggggaggattgatgctgacagcagaggtctagttaaaaactgatgcagaggttcaaatacgttgtgcagtaatcactagaactcaccttctaaagtgtcatgagagctctgattctgcaattagagattttttaatgtgtttttgaaattaccttgtaaaccacaaatctgtgtctctgcattgccccttattgtttcctaccacaaattctacatcaagaagaaagttttaaagttagactggatttatttgtgattttatggagcacaataaggtacattgagatagcatactaaaggaggccaaatacaggaagcatcatcttttcttattctcttactgcctggattttcccactgacctggaattgtgcacagttctacaaaggacaattgacattgttttccttttactaagtagtgggttttccttaaggtccagactgaattttgagacctgtatcaggattgccttctgtgtgactttttcttgcaggatctgacatcattacctatgggtccatatatttgtgatactttggtttcgggaacatcacttttagaatgttgacataaaatgcacccacagaatgccgtatttatcaaaagtaactttctagcaaaatctacagcagtaggcatttggaatctgcatttgagacctctgcagtcatttggtcattccagcaatctatgtccaggttgtcaatttcagaggtcttattagtctatacaggtaccaatgagctttcagatgttcaacacctacccctggcctaactgctgataaccaaccataacccttgcagatgcatgcatgttttctgcaccttgctatcatttttcagtccatttttcacatgtatacatagtgattatttttaaatgcaaccctgatttcacatgcctcatgttgaaatatcgtgtggcttattgtggacttaaagtgtaacattctccttatggtatgtaaggacttttgtataaaccaatgcctatctatctatcatttctgaaaactttttcctcctatgcaatattttctggcctctgtgaacaacttgtagttccttgagatttctattatcacttatgtttttgcaaatctgcaattgaaatgcccttgttccttgttaatgcctattgaatctatatgaacctgtacgtgtgtttctcactgtgataatataatcattgcatgttttatctttcccactagaaagcttctagaaagctagtactatcttttttgtctgtgtaatttttgcatcacaagctatatttaaatgtgggtgcagtgagtggctgttttctgccacatggagaaacatggtctgcagtgagagagaagaatgaagccatgatgaaagcaaaatcaagaaagagtcccgattgtgttccagtacctggttcttctggtcttcatgttcaggtccacctctgcccttttcatgtcttgattgttgaattcttctgtgagatactccaaatatcctaataaattctcatgtttgcttcaaaaa

SEQ ID NO: 1413 - DNA, 2319 bp, Homo sapiens
gagctctaggtcttgttttccctgctttgtgttttctgctcgtggacgcccagcctctgtggccctgtggcctgcaggtattgggagatccacagctaagacgccgggaccccctggaagcctagaaatgggaccattgacatttagggatgtggccatagaattctctctgaaggagtggcaatgcctggacactgcacagcggaatttatatagaaatgtgatgttagagaactacagaaacctggtcttcctgggtattactgtttctaagccagacctgatcacttgtctggagcaagggaaagaggcctggagtatgaagagacatgagatcatggtggccaaacccacagttatgtgttctcattttgcccaagacctttggccggagcagaatataaaagattctttccaaaaagtgacactgaaaagatatggaaaatgtagacatgaaaatttaccattaagaaaaggctgtgaaagtatggatgagtgtaagatgcacaaaggaggttgtaatggacttaaccaatgtctcacagctacccagagcaaaatatttcaatgtgataaatatgtaaaagtcgctcataaattttcaaattcaaacagacatgagataagacatactaaaaagaaacctttcaaatgtacaaaatgtggcaaatcatttggcatgatttcatgcctaactgaacatagcagaattcatactagagtaaatttctacaaatgtgaagaatgtggaaaagcctttaactggtcctcaacccttactaaacataagagaattcatacgggagagaaaccttacaaatgtgaagaatgtggtaaagcctttaaccagtcctcaaaccttattaaacataagaaaattcatactggagagaaaccctacaaatgtgaagaatgtggcaaaacttttaaccgattctcaactcttactacccataagataattcatactggagagaaaccctacaaatgtaaagaatgtggtaaagcttttaaccgatcttcaacccttactacccatagaaaaattcatactggagagaaaccttacaaatgtgaagaatgtggcaaagcctttaagcagtcctcaaaccttactacacataagataattcatactggagagaaaccctacaaatgtaaaaaatgtggaaaagcctttaaccagtctgcacaccttaccacacatgaggtaattcatactggagagaaaccctacaaatgtgaaaaatgtggaaaagcctttaatcatttctcacaccttactacacataagataattcatactggagagaaaccttacaaatgtaaagaatgtggtaaagcttttaaacactcttcaacccttactaaacataagataattcatactggagagaagccttacaaatgtaaagaatgtgaaaaagcttttaaccaatcctcaaaacttactgaacataagaaaattcatactggagagaaaccctatgaatgtgaaaaatgtggcaaagcttttaaccagtcctcaaatcttactagacataagaaaagtcatacagaagagaaaccttacaaatgtgaagaatgtggcaaaggttttaaatggccctcaacccttactatccataagataattcatactggagagaaaccatacaaatgtgaagaatgtggcaaagcttttaaccaatcctcaaaacttaccaaacataagaaaattcatactggagagaaaccctacacatgtgaagaatgtggcaaagcctttaaccagtcctcaaaccttactaaacataagagaattcatactggagaaaaaccttacaaatgtgaagaatgtgacaaagcttttaaatggtcctcagtccttactaaacataagataattcataccggagaaaaattacaaatatgaaaattatggcaaagctttaatcaatttacaagtcttactaaacataagaaaatttatactggagagaaactactaacctgaaagatgtgacaataattttgacaacacctcagacttataaaagtaatcatactggtgagaaattctaaaaatgtgaagactatggcaaagtctttaaatggttgtcacactttaggtaagataattcatattggaacaaactacaagtgcaaacaatgtggcaaaacttaatttatgctcacaccttactgcacagaaaagaatttttagttgagaaaaagtatacaaatataaagaatgtggaaaagccgttaatatctgctcacatcttactcagcatcagaaagtacttaataaaagcattataaatggaaaaaaaaaaa

SEQ ID NO: 1414 - DNA, 3393 bp, Homo sapiens
aaccccgcgcgctgattggccgcgtgggcgaggcggaggagagccgtgcgcagcggcgtatgtggggccgtgtgcagacccgcgtgtggcgcaggcaaggaccctcaaaataaacagcctctaccttgcgagccgtcttccccaggcctgcgtccgagtctccgccgctgcgggcccgctccgacgcggaagatctgactgcagccatgagcagcaatgagtgcttcaagtgtggacgatctggccactgggcccgggaatgtcctactggtggaggccgtggtcgtggaatgagaagccgtggcagaggtggttttacctcggatagaggtttccagtttgtttcctcgtctcttccagacatttgttatcgctgtggtgagtctggtcatcttgccaaggattgtgatcttcaggaggatgcctgctataactgcggtagaggtggccacattgccaaggactgcaaggagcccaagagagagcgagagcaatgctgctacaactgtggcaaaccaggccatctggctcgtgactgcgaccatgcagatgagcagaaatgctattcttgtggagaattcggacacattcaaaaagactgcaccaaagtgaagtgctataggtgtggtgaaactggtcatgtagccatcaactgcagcaagacaagtgaagtcaactgttaccgctgtggcgagtcagggcaccttgcacgggaatgcacaattgaggctacagcctaattattttcctttgtcgcccctcctttttctgattgatggttgtattattttctctgaatcctcttcactggccaaaggttggcagatagaggcaactcccaggccagtgagctttacttgccgtgtaaaaggaggaaaggggtggaaaaaaaccgactttctgcatttaactacaaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaattctggaagtgtctatgaacttccataaataactttaattttagtataatgatggtcttggattgtctgacctcagtagctattaaataacatcaagtaacatctgtatcaggccctacatagaacatacagttgagtgggagtaaacaaaaagataaacatgcgtgttaatggctgttcgagagaaatcggaataaaagcctaaacaggaacaacttcatcacagtgttgatgttggacacatagatggtgatggcaaaggtttagaacacattattttcaaagactaaatctaaaacccagagtaaacatcaatgctcagagttagcataatttggagctattcaggaattgcagagaaatgcattttcacagaaatcaagatgttatttttgtatactatatcacttagacaactgtgtttcatttgctgtaatcagtttttaaaagtcagatggaaagagcaactgaagtcctagaaaatagaaatgtaattttaaactattccaataaagctggaggaggaaggggagtttgactaaagttctttttgtttgtttcaaattttcattaatgtatatagtgcaaaataccatattaaagaggggaatgtggaggactgaaagctgacagtttggacttttctttttgtacttaagtcatgtcttcaataatgaaaattgctgttaaaaggatgtatgggatttagatacttttgcaaagctatagaaaattcactttgtaatctgttataataatgcccttgagttctgtgttcagtctgaacaggttttttggtggtggtggttttgttttgttttggagacggagtctcactcttgtcgcccaggctggagtgcaggcttggctcactgcaacctccacctcccgggttcaagcaattctcctgcctcagcctcctgagtagctgggattacaggcacccgccaccaccccccgctaattttttgtatttttatttttattttatttttttatttttttttgagacagagtgtcgctctgttgcccaggctggagtgtagtggtgcgatctcggctcactgcaagctccgcctcctgggttcgtgccattctcctgcctcagcctcctgagtagctggggctacaggtacccgccaccgcgcccagctaattttttttttttgtatttttagtaaagacggggtttcacggtgttagccaggatggtctcaatctcctgacctcgtgatccgcccgccttggcctcccaaagtgctgggatcacaggcgtgagccaccgcgcccggcctattttttgtatttttagtagagactgggtttcatcatgttggtcgggctggtctccaactcctgacctcaggtgatccacctgccccgccccccaaagtgctagtgttacaggtgcgagccaccgtgtctggccgattctgaacagttttaataccattgctatttttgtgtttttcctgggccttttttttttttttttttttttttgagacagtctcgctctgttgcccaggctagagtgcaatggtgcaatctcagctcactgcaacctccaccccccacccccacaccccgttcaagtaattctcctgcctcagcctcccaaatagctgggattacaggtgtccgccaccacacccagctaatttttgttatttttagtagagatggggtttcactgtgttggtcaggctggtctccaactgttgccctcaggtgagccactgtgccccaccttttcctgggtttcataaggatctgaagtggtggattccttgtttttgctagtgtctcatttagagttgagatggaccttaaaactcatctgttttaactcactttttaatagatgagttaaacttaatttacttaaggatgtacagttagagcctggaacttcaaccattattcactccccatgccctgtttccccccacttcgaaattaaatgcggttagcatcatatagttcattttccccctccatgctgctgtgtgattcttgactttgggtatgagtttttcatccttcatgcagggttctgtcagttcatggtatagtgattcagtgttaaaatggtggtgtctcagctgtgctgtgcacattccaaccttgtcaaattaatagtcctgagcaagcaagaaaaagaggtaataacatacccatttctttatgaatataagcttataatattttttcatgtgctatttttactgagcaaattgtatgtctcacatgttaacacaataaatatcttgacaattttattttctaccataaaaaaaaaaaaaaaa

SEQ ID NO: 1415 - DNA, 706 bp, Homo sapiens
gaattccggtgctcctaaatctggtcttagctgcttcgtgtcttcttctccagcctctgtggccctgtgacctgcaggtattgggagatccacagctgagggaccccccggaagcctagaaatgggaccattggaatttagagatgtggccatagaattctctctggaggagtggcattgcctggacactgcacagcagaatttatatagggatgtgatgttagagaactacagacacctggtcttccttggtattgttgtcactaagccagacctgatcacctgtctggagcaaggaaaaaaacccttcactgtgaagagacatgagatgattgccaaatccccagttatgtgttttcattttgcccaagacctttgtccagagcagagcctaaaagattccttccaaaaagtgatagtgacaagatatgaaaaacgtgaatatggcaatttagagttaaaaaaaggttgtgaaagtgtggatgagggtaaagtacacaaaagaggttataatggacttaaccaatgtttgacagctacccagagcaaagtatttcaatgtgatacatatgtgaaagtctctcatatattttcaaattcaaacagacataagataagagatactggaaaaaaacctttcaaatgtatagaatgtggcaaagctttcaaccagtcctcaacccttgctacacataagaaaattcat

SEQ ID NO: 1416 - DNA, 5403 bp, Homo sapiens
ctcgctgccgccggagtttccaggtctcgacttcactgctctgtgtcctctgctccaggaggcccagcctgtgtggccctgtgacctgcaggtattggagagccacagctaagatgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtattgctctctctaagccagacctgattacttatctggagcaaggaaaagagccctggaatatgaagcaacatgagatggtggatgaacccacaggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacatactggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaagcttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaagcatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtggcaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccactactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaaaaaaaaagaaaattcatactagagagaaaccctacaaatataaagaatgtggcaaatcttttaaccggtcttcaacctttactaaacataaggtaattcatactggagtaaaactctacaaatgtgaagaatgtggcaaatcctttttctggtcctcagccctaaccagacataagaaaattcatactggacagcaaccctacaaacaggaaaaatttggcaaagcctttaaccagttttcacaccttactacagataagataactcatattggagagaaatcttacaagtgtgaataatgtggtaaagtctataaaaagtcctgaattcttaacagacataatattattcatactggagagaaactctacaaacctgaaagatgtgccaacgcttttgacaagtcaaacttttctaaacatcaagaaaatcatgctgctgagaaatcctagaaatgtgaagaatgtgacaaagcctctaaatgattgtcacacttgatcgtaggtaagataattcatactggagaaaactaccagtgtgaacaatgtggccaagctttgaactaatgctcacaccttaatgcataggaaagcatttatgcttgagaaaaagtgaacaaatatagacaaaaagccattaatacctgctcacatcgtactcaaattcagagcgttcatactaaataagaagtgtaattactgtcaaacgactgatcagaaaatatgtctttaaagtacagaagagtattttgaaaaagcattacaaatatgaagaggcattatttatgaccttttctatggaaaggtaaggacattaaaaatgtaagatgcatgatgaaaatttaagtagagaggatctttatggttaacttataatatcgagtgatgcatgaggtagatgttcagattaatattctgcattattatgaaagaaaaacattcttaattttagttaaagtttagtatgatttattgtatttttatgaaatatatgtagcatatttttaaattataaattgcatgtgaacttttcaaccaaacagttttaacatgttaaatactatcatgaattcaatgaagtgttattatgccagtaactttaacctattccaccttactcaagggtgtaggtaaaagatggtaaaaatacactatttggtaagataatggactgacatctctagtgattttttttgccagtgagttttaattgccattaagttaaagaatattgttcccataggctaaatttttatttttattttctcatttaaatgtatttgacttaatttttgtggatacctaatatgtgtacatattatgccatatgtggcatattttgatacggacacacaatatataacaatcgcattagactaaatgcggtctccattacctctagcatttattctttgtattacaaataattcaattctacagttttagttatttttaaatgtacaattaaattgttgttgactacaggattatttttatggtcataataaaacttatatacaaacataagtaaaatccataaaaaaaa

SEQ ID NO: 1417 - DNA, 582 bp, Homo sapiens
gaattccgataaaggctcgccgctgtgaccctgttacctgcaagaacttggaggttcacagctaagacgccaggaccccctggaagcctagaaatgggaccactgacatttagggatgtgaaaatagaattctctctagaggaatggcaatgcttggacactgcgccaggaaatttatatagagatgtgatgttagagaactacagaaacctggtcttccttgttatgtgttctcattttgcccaagatgtttggccagagcacagcataaaagattctttccaaaaagtgatactgagaacatatggaaaatatggacatgagaatttacagctaagaaaagaccataaaagtgtggatgcatgtaaggtgtacaaaggaggttataatggacttaaccagtgtttgacaactactgacagcaagatatttcagtgtgataaatatgtgaaagtctttcataaatttccaaatgtaaatagaaataagataagacatactggaaagaaacctttcaaatgtaaaaaccgtggcaaatcattttgcatgctttcacaattaactcaacataagaaaattcat

SEQ ID NO: 1418 - DNA, 843 bp, Homo sapiens
caatttagagatgtggccatagaattctctctggaggagtggcattgcctggacactgcacagcggaatctatataggaatgtgatgttagagaactacagtaacctggtcttccttggtattgttgtctctaagccagacctgatcgcccatctggagcaaggaaaaaaacctttgactatgaagagacatgagatggtagccaacccctcagggccaggtgtggttgtggtgctcatgtgtaatcccaggattttgggaggtcaagccaagaggatccctggagcccaaaagtttgagaaccagcctgggcaacatatggagacccctctctatgaaaaaatttaataatagccaggcatggtggtgtgcagctgtggtcccagctacttgggagattgaagggagtcaaaattgtgccactacactccagcttgggtgacagagtgagaccctatctcaaaaaaaagcctgttcatttcagttatatgttctcattttgcccaagatctttggccagagcataacataaaagattctttccaaaaagtgatactgagaagatatgaaaaacgtggacatggaaatttacagttaataaaaaggtgtgaaagggtagatgagtgtaaggtgcacacaggaggttataatggacttaaccagagtagtacaactacccagagcaaagtatttcaatgtgataaatatgggaaagactttcataaattttcaaattcaaatagacataatataagacatactgaaaaaaaacctttcaaatgcatagaatgtggcaaagcttttaaccagttctcaacccttataacacataagaaaattcat

SEQ ID NO: 1419 - DNA, 5225 bp, Homo sapiens
gcctttggcttcagcgcttcgcccccgcgctgtgccctctgtcggcggcgtggggcagctgtagcagcgttggcggcaggaggcggcggccgcgtcgacgtcgacccagactggagcgacgtttaaagaaggggcagaatcgctggggagtgcggcttcttcttgttgggggactcccagccttccgcgcgtccggaggaggagaagcggcggcgccgggaagcaggcatggagagtagaaaactgatttctgctacagacattcagtactctggcagtctgctgaactccttgaatgagcaacgtggccatggactcttctgtgatgttaccgttattgtggaagaccgaaaattccgggctcacaagaatattctttcagcttctagtacctacttccatcagctcttctctgttgctgggcaagttgttgaactgagctttataagagcagagatctttgcagaaattctcaattatatctatagttctaaaattgttcgtgttagatcagatttgcttgatgagttaattaaatcagggcagttattaggagtgaaatttatagcagagcttggtgtcccattgtcacaggttaaaagcatctcaggtacagcgcaggatggtaatactgagcctttacctcctgattctggtgacaagaaccttgtaatacagaaatcaaaagatgaagcccaagataatggggctactataatgcctattataacagagtctttttcattatctgccgaagattatgaaatgaaaaagatcattgttaccgattctgatgatgatgatgatgatgtcattttttgctccgagattctgcccacaaaggagactttgccgagtaataacacagtggcacaggtccaatctaacccaggccctgttgctatttcagatgttgcacctagtgctagcaataactcgccccctttaacaaatatcacacctactcagaaacttcctactcctgtgaatcaggcaactttgagccaaacacaaggaagtgaaaaattgttggtatcttcagctccaacacatctgactcccaatattattttgttaaatcagacaccactttctacaccaccaaatgtcagttcttcacttccaaatcatatgccctcttcaatcaatttacttgtgcagaatcagcagacaccaaacagtgctattttaacaggaaacaaggccaatgaagaggaggaggaggaaataatagatgatgatgatgacactattagctccagtcctgactcggccgtcagtaatacatctttggtcccacaggctgatacctcccaaaataccagttttgatggatcattaatacagaagatgcagattcctacacttcttcaagaaccactttccaattccttaaaaatttcagatataattactagaaatactaatgatccaggcgtaggatcaaaacatctaatggagggtcagaagatcattactttagatacagctactgaaattgaaggcttatcgactggttgcaaggtttatgcaaatatcggtgaagatacttatgatatagtgatccctgtcaaagatgaccctgatgaaggggaggccagacttgagaatgaaataccaaaaacgtctggcagcgagatggcaaacaaacgtatgaaagtaaaacatgatgatcactatgagttaatagtagatggaagggtctattatatctgtattgtatgcaaaaggtcatatgtctgtctgacaagcttgcggagacattttaacattcattcttgggagaagaagtatccgtgccgttactgtgagaaggtatttcctcttgcagaatatcgcacaaagcatgaaattcatcacacaggggagcgaaggtatcagtgtttggcctgtggcaaatctttcatcaactatcagtttatgtcttcacatataaagtcagttcatagtcaagatccttctggggactcaaagctttatcgtttacatccatgcaggtctttacaaatcagacaatatgcatatctttccgatagatcaagcactattcctgcaatgaaggatgatggtattgggtataaggttgacactggaaaagaacctccagtagggaccactacatctactcagaacaagccaatgacctgggaagatatttttattcagcaggaaaatgattcaatttttaaacaaaatgtaacagatggcagtactgagtttgaatttataataccagagtcttactaaactcctttgaaatactagaaagttttgttttggatgatggggcaggggtttcagaagatctgtaaaacaaattaaggtgcgaacaagttaatttgatctgccacattatctgaaggaagtgtagtgggatttttgttgataatttttagaagcaaattttcctgaaagttttgagtagaggtgagaccccctccccaagtatctgtttatatagttagttttcagctcatttaaaagaggcaaaaattaaaagcttggagagatagtttcctgaatagaatttgaagcagtctgaatgttctttgaaaataactggagttattagcataccctagtacatcttacagctttccccttccatgttagcactttactgctgaattctcaattttcttaacattgagacaataaatgtgtgttttgtcttgtatatggcataaagagtaaataagttttagagttgttctggaaaatgtcagaataagtcagtacttgggttgtgtaatctgctagtccaagcgaacagcaacctcctgctaccctccctctatgaaaatagccatgcagacaagtctctcatctgaagaacaaattagatttagctaattagaattaatcctggctttcattgccatagtctgtaaaagactttggtggctagaccactttataccttcgcagtgtggtctctgggggcaaaaaactaatgaaaacaatctctgtaatggcagataggaggagatgaaaagttctgttgcatggatttttaattctctggctaccacatagtagagaatggaatgaagatttccttttggcttcttaaggttaaaaatattcccatgaacatgaaaattttcaaattttgaatctgaaagccaccaaatgtatctttatgtataaatccttgtaaatgatagattccatgggtgagactttacatattttgggtgggaggctactggcatatatttttaaatgttcatattgcgtagaatctccactaggaagtctttatttgaaatagttgaatcagtgatctagtattttcctttcggcaagatttgttaggtttttaccccttctaaaataagttttattccatctgcaaattgctgcaatattatagtaatcagaaactacataaggaatgttatataggcttgtcagttcccatttttcttgacaacaataaataccacttttaaaaatgacacatatttaaacacttagaaaataaagttaacacttactgaagtgctagtactaaactgtgctagtactaaaagaaaacaggttggaacatacatatagcctagcatttataacagaattgttgaacgtctgtaaatgattttttttttttttgcaaaggaaaaaattgatactggaaaagattgttgtgcatagttattagtcatttgtaaccttgcttaagtatttcttagtccaacatagatattttctttctcctgaccatgtattttaaaatatagtctatttcttgactttgaacttaaagctttaatcataatttctcatgtatacatcgttcttctgatggtaagctggatttgaaggtagtggtttcagtgtttcttaagttggtagctgagggtatcaggcatcagttcatgcaataatacaagaaaaaaaatcctttgcttgccaagaggtagagtgatgtgcatttatctgttttctgttctgtaagtctagaccttcaaaccatttgtaaactaacccctgggaaatttgaaattacctgataacttaagactctgtgatctctggaatcaccatatgtttcttttttgtgtagatattaataacattactctttgactatagtgtgcactctgaaatgtactcagtgaaaatttgttttgagtttcattaatgctatttcaccagttagacataattacttctaccgatgtgaatgatacggatgccggcagagcttccagatctttcagactcaactgctaggtcaattagtttgtcataataaaacttggcagattctacaagtctattatgacaaaccaggaactaattctataatggaaaactatccattctgaataataggtatgtaattatttgctgctgctgctgtgctctgtaaattctgaatatgacatttaaactctgtgcctactaaaggtatcttctggagtttttgggaggagagaaactggaaaattaaattgtatttttgccagaagactcttacttgcatgtgtctcagggtcttcagtttttctataagtttccatatccaaagttcagaattcatgtgaaatacttctttggggcaaaagtccttcattcctggtatttattggattggaaatctgtagcaagatgctgtttaaaattaccatattgtttttttatcttatacttagctctctggctattgaacttccttttcttgtttgaagttagcttcaaatttgctcctatgctaaattacctgtaaatattctggataggaactacttgaaatagtaatttgttaaaagatatgacaaaatgaaaatgcttaaactacagaaatttaaaaatgccataacaatcttgcgagactaactttaaaatatactttaaatgattattatgattttggtggtaacgatcccccacacacaaccactatgaagaaataatgccgcatttttcccccattgtaccaaaaagataaaaaaatggtaaacactgatcaaggtattttgtattgtcaaggcatgcatattctaaagaattaaatgctaacttaacagcactggctttctggctggtcaactatatgaaaccttgttcattcctccgagtactgtaatgttcacacttgtacaatcttccctgtcatgactttaagttctacttttcattaaccatggcctgatattagttcttagagcttcttgtggcaaaaataaaatgatttaattctaaaaaaaaaaaaaaaa

SEQ ID NO: 1420 - DNA, 6202 bp, Homo sapiens
gaattccggcgtcgcggacgcatcccagtctgggcgggacgctcggccgcggcgaggcgggcaagcctggcagggcagagggagccccggctccgaggttgctcttcgcccccgaggatcagtcttggccccaaagcgcgacgcacaaatccacataacctgaggaccatggatgctgatgagggtcaagacatgtcccaagtttcagggaaggaaagcccccctgtaagcgatactccagatgagggcgatgagcccatgccgatccccgaggacctctccaccacctcgggaggacagcaaagctccaagagtgacagagtcgtggccagtaatgttaaagtagagactcagagtgatgaagagaatgggcgtgcctgtgaaatgaatggggaagaatgtgcggaggatttacgaatgcttgatgcctcgggagagaaaatgaatggctcccacagggaccaaggcagctcggctttgtcgggagttggaggcattcgacttcctaacggaaaactaaagtgtgatatctgtgggatcatttgcatcgggcccaatgtgctcatggttcacaaaagaagccacactggagaacggcccttccagtgcaatcagtgcggggcctcattcacccagaagggcaacctgctccggcacatcaagctgcattccggggagaagcccttcaaatgccacctctgcaactacgcctgccgccggagggacgccctcactggccacctgaggacgcactccgttggtaaacctcacaaatgtggatattgtggccgaagctataaacagcgaagctctttagaggaacataaagagcgctgccacaactacttggaaagcatgggccttccgggcacactgtacccagtcattaaagaagaaactaatcacagtgaaatggcagaagacctgtgcaagataggatcagagagatctctcgtgctggacagactagcaagtaacgtcgccaaacgtaagagctctatgcctcagaaatttcttggggacaagggcctgtccgacacgccctacgacagcagcgccagctacgagaaggagaacgaaatgatgaagtcccacgtgatggaccaagccatcaacaacgccatcaactacctgggggccgagtccctgcgcccgctggtgcagacgcccccgggcggttccgaggtggtcccggtcatcagcccgatgtaccagctgcacaagccgctcgcggagggcaccccgcgctccaaccactcggcccaggacagcgccgtggagaacctgctgctgctctccaaggccaagttggtgccctcggagcgcgaggcgtccccgagcaacagctgccaagactccacggacaccgagagcaacaacgaggagcagcgcagcggtctcatctacctgaccaaccacatcgccccgcacgcgcgcaacgggctgtcgctcaaggaggagcaccgcgcctacgacctgctgcgcgccgcctccgagaactcgcaggacgcgctccgcgtggtcagcaccagcggggagcagatgaaggtgtacaagtgcgaacactgccgggtgctcttcctggatcacgtcatgtacaccatccacatgggctgccacggcttccgtgatccttttgagtgcaacatgtgcggctaccacagccaggaccggtacgagttctcgtcgcacataacgcgaggggagcaccgcttccacatgagctaaagccctcccgcgcccccaccccagaccccgagccaccccaggaaaagcacaaggactgccgccttctcgctcccgccagcagcatagactggactggaccagacaatgttgtgtttggatttgtaactgttttttgttttttgtttgagttggttgattggggtttgatttgcttttgaaaagatttttatttttagaggcagggctgcattgggagcatccagaactgctaccttcctagatgtttccccagaccgctggctgagattccctcacctgtcgcttcctagaatccccttctccaaacgattagtctaaattttcagagagaaatagataaaacacgccacagcctgggaaggagcgtgctctaccctgtgctaagcacggggttcgcgcaccaggtgtctttttccagtccccagaagcagagagcacagcccctgctgtgtgggtctgcaggtgagcagacaggacaggtgtgccgccacccaagtgccaagacacagcagggccaacaacctgtgcccaggccagcttcgagctacatgcatctagggcggagaggctgcacttgtgagagaaaatactatttcaagtcatattctgcgtaggaaaatgaattggttggggaaagtcgtgtctgtcagactgccctgggtggagggagacgccgggctagagcctttgggatcgtcctggattcactggctttgcggaggctgctcagatggcctgagcctcccgaggcttgctgccccgtaggaggagactgtcttcccgtgggcatatctggggagccctgttccccgctttttcactcccatacctttaatggcccccaaaatctgtcactacaatttaaacaccagtcccgaaatttggatcttctttctttttgaatctctcaaacggcaacattcctcagaaaccaaagctttatttcaaatctcttccttccctggctggttccatctagtaccagaggcctcttttcctgaagaaatccaatcctagccctcattttaattatgtacatctgtttgtagccacaagcctgaatttctcagtgttggtaagtttctttacctaccctcactatatattattctcgttttaaaacccataaaggagtgatttagaacagtcattaattttcaactcaatgaaatatgtgaagcccagcatctctgttgctaacacacagagctcacctgtttgaaaccaagctttcaaacatgttgaagctctttactgtaaaggcaagccagcatgtgtgtccacacatacataggatggctggctctgcacctgtaggatattggaatgcacagggcaattgagggactgagccagaccttcggagagtaatgccaccagatcccctaggaaagaggaggcaaatggcactgcaggtgagaaccccgcccatccgtgctatgacatggaggcactgaagcccgaggaaggtgtgtggagattctaatcccaacaagcaagggtctccttcaagattaatgctatcaatcattaaggtcattactctcaaccacctaggcaatgaagaatataccatttcaaatatttacagtacttgtcttcaccaacactgtcccaaggtgaaatgaagcaacagagaggaaattgtacataagtacctcagcatttaatccaaacaggggttcttagtctcagcactatgacattttgggctgactacttatttgttaggcgggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaattctaaaccaatcaaatgtctgggaagccctccaagaaaaaaaatagaaaagcacttgaagaatattcccaatattcccggtcagcagtatcaaggctgacttgtgttcatgtggagtcattataaattctataaatcaattattccccttcggtcttaaaaatatatttcctcataaacatttgagttttgttgaaaagatggagtttacaaagataccattcttgagtcatggatttctctgctcacagaagggtgtggcatttggaaacgggaataaacaaaattgctgcaccaatgcactgagtgaaggaagagagacagaggatcaagggctttagacagcactccttcaatatgcaatcacagagaaagatgcgccttatccaagttaatatctctaaggtgagagccttcttagagtcagtttgttgcaaatttcacctactctgttcttttccatccatccccctgagtcagttggttgaagggagttattttttcaagtggaattcaaacaaagctcaaaccagaactgtaaatagtgattgcaggaattcttttctaaactgctttgccctttcctctcactgccttttatagccaatataaatgtctctttgcacaccttttgttgtggttttatattgtaacaccatttttctttgaaactattgtatttaaagtaaggtttcatattatgtcagcaagtaattaacttatgtttaaaaggtggccatatcatgtaccaaaagttgctgaagtttctcttctagctggtaaagtaggagtttgcatgacttcacactttttttgcgtagtttcttctgttgtatgatggcgtgagtgtgtgtcttgggtaccgctgtgtactactgtgtgcctagattccatgcactctcgttgtgtttgaagtaaatattggagaccggagggtaacaggttggcctgttgattacagctagtaatcgctgtgtcttgttccgccccctccctgacaccccagcttcccaggatgtggaaagcctggatctcagctccttgccccatatcccttctgtaatttgtacctaaagagtgtgattatcctaattcaagagtcactaaaactcatcacattatcattgcatatcagcaaagggtaaagtcctagcaccaattgcttcacataccagcatgttccatttccaatttagaattagccacataataaaatcttagaatcttccttgagaaagagctgcctgagatgtagttttgttatatggttccccaccgaccatttttgtgcttttttcttgttttgttttgttttgactgcactgtgagttttgtagtgtcctcttcttgccaaaacaaacgcgagatgaactggacttatgtagacaaatcgtgatgccagtgtatccttcctttcttcagttccagcaataatgaatggtcaacttttttaaaatctagatctctctcattcatttcaatgtatttttactttaagatgaaccaaaattattagacttatttaagatgtacaggcatcagaaaaaagaagcacataatgcttttggtgcgatggcactcactgtgaacatgtgtaaccacatattaatatgcaatattgtttccaatactttctaatacagttttttataatgttgtgtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacattttgaaatgcttcttctgtagtgatagaacaaataaatgcaacgaatactctgtctgccctatcccgtgaagtccacactggcgtaagagaaggcccagcagagcaggaatctgcctagactttctcccaatgagatcccaatatgagagggagaagagatgggcctcaggacagctgcaataccacttgggaacacatgtggtgtcttgatgtggccagcgcagcagttcagcacaacgtacctcccatctacaacagtgctggacgtgggaattctaagtcccagtcttgagggtgggtggagatggagggcaacaagagatacatttccagttctccactgcagcatgcttcagtcattctgtgagtggccgggcccagggccctcacaatttcactaccttgtcttttacatagtcataagaattatcctcaacatagccttttgacgctgtaaatcttgagtattcatttacccttttctgatctcctggaaacagctgcctgcctgcattgcacttctcttcccgaggagtggggtaaatttaaaagtcaagttatagtttggatgttagtatagaattttgaaattgggaattaaaaatcaggactggggactgggagaccaaaaatttctgatcccatttctgatggatgtgtcacaccttttctgtcaaaataaaatgtcttggaggttatgactccttggtgaaa

SEQ ID NO: 1421 - DNA, 9443 bp, Homo sapiens
gggcttggcttggagggggcaagggagggaaagagagaagggggaaacacaaaaaacttctttctttctccctccgtttatcttcagcccgacattgtcacctcctctttgaggggttagaagaagctgagatctcccgacagagctggaaatgcattgcactttgactatggaaacagaggctattgatggctatataacgtgtgacaatgagctttcacccgaaagggagcactccaatatggcaattgacctcacctcaagcacacccaatggacagcatgcctcaccaagtcacatgacaagcacaaattcagtaaagctagaaatgcagagtgatgaagagtgtgacaggaaacccctgagccgtgaagatgagatcaggggccatgatgagggtagcagcctagaagaacccctaattgagagcagcgaggtggctgacaacaggaaagtccaggagcttcaaggcgagggaggaatccggcttccgaatggtaaactgaaatgtgacgtctgtggcatggtttgcattgggcccaatgtgcttatggtacataaaaggagtcacactggtgaacgccccttccactgtaaccagtgtggagcttcttttactcagaagggcaaccttctgagacacataaagttacactctggagagaagccgttcaaatgtcctttctgtagctacgcctgtagaagaagggacgccctcacaggacacctcaggacccattctgtgggtaaacctcacaagtgcaactactgtggacgaagctacaagcagcgcagttcactggaggagcacaaggaacgctgccacaactatctccagaatgtcagcatggaggctgctgggcaggtcatgagtcaccatgtacctcctatggaagattgtaaggaacaagagcctattatggacaacaatatttctctggtgccttttgagagacctgctgtcatagagaagctcacggggaatatgggaaaacgtaaaagctccactccacaaaagtttgtgggggaaaagctcatgcgattcagctacccagatattcactttgatatgaacttaacatatgagaaggaggctgagctgatgcagtctcatatgatggaccaagccatcaacaatgcaatcacctaccttggagctgaggcccttcaccctctgatgcagcacccgccaagcacaatcgctgaagtggccccagttataagctcagcttattctcaggtctatcatccaaataggatagaaagacccattagcagggaaactgctgatagtcatgaaaacaacatggatggccccatctctctcatcagaccaaagagtcgaccccaggaaagagaggcctctcccagcaatagctgcctggattccactgactcagaaagcagccatgatgaccaccagtcctaccaaggacaccctgccttaaatcccaagaggaaacaaagcccagcttacatgaaggaggatgtcaaagctttggatactaccaaggctcctaagggctctctgaaggacatctacaaggtcttcaatggagaaggagaacagattagggccttcaagtgtgagcactgccgagtccttttcctagaccatgtcatgtacaccattcacatgggttgccatggctaccgggacccactggaatgcaacatctgtggctacagaagccaggaccgttatgagttttcatcacacattgttcgaggggagcacacattccactaggccttttcattccaaaggggacccctatgaagtaaagaactgcacatgaagaaatactgcacttacaatcccacctttcctcaaatgttgacataccttttattttttttaatattattactgttgataattcttattttgtggaggcagtgtcatttgctctgcctaattacgataaggaagaaacagaagagagaaggggcgggaatattgtttctttatcacctggcttgtttattttgtgggaatttaagagcagtccatttctaccaaggcatatcatgctttgaaaaatcacttgattcataaagattcacctaagagattctgatttgccactgatattcagaattatgatggaagacaggaaagttcagagttttctgggtaggactttggtggtttaaaaatggtataagtaactttattcttgaaagaagaatgtgtttcaaactgtaaaccaattttttgttcttcagagatcatggaacacaaacacattgttattttcagtgataactcctaagaggagctgagttgttgtgggttctatgtttacttcccctatggaatttataattcagtatgttttacactgtaccatatagcaaaacttttaaactacaggtagttaagggccacctacaatacatctgaggtcctgtgatcttatttttctaaacgtaagcactgtttttccatagttttgatgactggcattttatagacaccctggcagccttacttttaacacctttaaggaatagtatttttatgtagttttcagaataacatatggtctaagagtggataaaaggcagtcaataatttctgggagggacttctactttcataaatttgtttgagaggttttcttttaaagttgtaatgtgatggcagcatagtatatgtatttgtttctaaaagtatgcttacgattgtcactttatcagcatttaatcagtgttaaccagtcagcagaaaaatataattatgctaacagtagggggagaaaacccacttagaaatcccttttctggtatttctcttttcactagtttttttcaagatgtgacctcccggtgttctgtccatagttcattcatcctttactcttcgagtagaaggtcttaaaagtcttcctgtcggctgtttctttcaaaatctcctcagagcaattgctaatttggcctgaatctggtaacttgaaccctgtaaggttacagaactagggctatttattttagcatttcttcagtagtatttactactcttgttgcaaagaaaagggaatgggacttctttgtaacctgtaccttggacaacagataaaagaaacaaaaaaataagaaagtttacttttacccttcttggagtctagaatgtgacagaacccccaaaggaaagtcctgcacatttttctgtttccaaaacatttaattgtgtaagtccttgtcagaaatgaatctcaatcccttagtatagaattccccttacatggtataggttgccatatttcatgtgcagattttaatttcatttatgtgggcgctctgttttttctttgcagtccagccacattagaggggaggaaccgagtgatattgattcaagtcattttagggggacatacttggaaggcagaacttgctgcttctgtttggggaggacagacctgactgtgactggattatctgataaccatttgtgaatactgaaattctgttaggcagtaactgataactgctctaaaggatcattaaataggatgctgaaattatgtatcttaatacagtgtggtatgagaattaccaagtcaagagaattgtggacataagcaagtttggccccaatactgctcttaactcattttccagcttactatttgctatttaaatggtaggcaccagctaagcacttctaagcactaacacagctagaactaggcaaaaatggttagaactcagctctcttctactagtccctgtcataattatttttgggaaaatgtccaaactgccccctttaaatctaagggaatgcaccaaaacagagatatatagaatgtcaaccatttcatttttttttttctgcatgccttggtacatagtgaacatacaacctatttaaagataaagcatgtttttgagactcgctcacccccccccacccaaccactcccaaataataattgggatgccattttttttccttttggatgaggtaaataattttaaggttcacaattttgtcttttactgcaatttaaggaaacatttggatgtcagtcaatatgttcataattttggctgtgtgcgaatttctgctggcattatctatgaattttcttcctacttatttttttttcagtatatgaacaatcatgtatctacctgccccaggatgaaactaaatttaggtggaccctaaaccttatgaagacagtgctgaggcactttccttttctgatttcatctttttgggaatctgttttattgaaggtagttagtagttgagagtgcatttgctacaagcatatacttgtatcttcctagcttcatgaggaacagaaagaggtggatatggctcagggtgtggcagggacaattgaggacaaagtcaattcaaatttgtgggtcagaaagaatttttgtggacgtagtgtttttggagaaactctggatggttatatgtgcatgccttttcttcaaaaggaaatacgcaaggttgtagcatctaaaaataaacataagagtcagacaccaaataaatcaagttttacataacagttgtatgcccagtttgtttaggtgagatttcacattacagaaagtatttgaggagcatgaaaatgggttatcttctgtattttccagtttggcaaaagttcagaatttcatcacattgctttgccctaattttgcccagaattttatcttagcctctctctgacagtgatgaatcatgctcaaaagccattctaattggacctttttaagacagggaaagggatcagtaggcggattggaagaaatttcaagtcattgaaatattccattgagatttcctaaagggacaaaattgggaaaataagaaactacgacttagatttggctacgtagtagaaagtatctcccctacatacatacaggcaattgtatgtatgaatcatagggtatatgtgtgtgtatactacacacacattcttttaaagagaattcatggaaaaaaaagcagttggagtgatcagatgtattgcaaaaacatacagagaatttaaatgacagttaataccaagaaattagttgggtttactttatcaggtcgtaataggaatcactaaagaagttactagtgtgtctttaggaccagtggcaactcttaaactaaaactttgggtccttattatctacttacagaacaaagtgaaacaaacaatgattaagctgattggatatacattcaaagatatttaatgtaaagttttttggaatacgaagaaaattcagaaaataaatattatcaacagttacttattggcaaatagagaaagacaagaatagtttagtgagcccggtattttgtttttatagtttttatctcagttgtacaactcacaaaaccatgaagtctttggtattttataaatgtttaacaaaatttacatcagattaaggcatttagatgaaaattattatgttctcactatcttccaaattttatttcatcctatctccaaaatgatttcttagggtacaaaaagagcagacggggctgtaaaaatacaagcaaaaaactgtgtgcccctagtttcaggcagaacttaaactgtcagaggtactagctacatgatttgttttttaactttggattgttcacgtccaaaaatggataaattacatttgtgtttatcatcagttgcattttatgtattattttaataaatactatctgaatgaagactattctaaaccagaaaattccccaaatccaaaagaaaaaaaaagtgggaagaggtgaaattgaagtttgtgtatatgaaagttatcttagacatatttttaattctccagtttctgcaaaataattaaaatatacagtaactggtctcctaaatcctgaatttaatgtattaaatacttatgttctttatattggtgcctttttaaaatgcattgagagtgttggttagctgttgcagctgtacaacacttttaatatgcatttttaaaaatcacttaaaattgagtactatataattcatctctgcatttttagtgcaaatctttagagcaatttctaatagagaaattttcagctcagctgttaaaaggaaaaggaaactttgaaactagactttactacctttttagtttcatagtatttctgaatatgattacaagattatgcaggtaaaatatagagtgaaactttacctgtgaattgaattataatttgtgtttttgttttgtttttaaggaagaataagttctgtatcaaacaagaatttattagataattttttggtcaataaaatacagtattcatttggattttcatctccagactagtattgttctagtcttggaatctgtattttctaatctgttagaaaatagagattgaaaattgatggaataatgtgaaaaagcaggtaattaattctccttgaacaaagcaaaactgaacagtcatatcacattgctattctccaaagcataatctcaaatggtttcatatcatggttgtgtattacttgcaatgggtgtgttaggatatgacagctttttaaaaaaatgagctgctggttatacaaagcaaatggcatatgaccaagaagctgtgatatgctagtgtttctttttatcatagtgtattactaggccaaataatgacaccttgaatatttttacatttattgcagaaaccttaaactttggaatttccataaggtttttatgtaatattctatttctagctttttagttttatcttgctgtactgtaagtttgaggatatttttcacctgcactcttaggaataagttcataattctgtttatggggctttcctcccataacactgcatttgtatattttctgtataaaatatgtgttgtgtattaacctttatcccatacagagagtggtacatgaatgactagttttctaagatgtcctttttattgtgaataaaatataaaagttaaaggccctctgctaagtcacataaagtacagcatataagttcatataggtacaaataaatgagtttgcagtgaattgggccttcaaattacctcaagtgacagatagtaagaaaagcttcttgagcaggtggaggtcactgaatcccctactatgcacttaccaagattttacttactttaatttactggaaattgattttttaaaaaatgactacactgtaacaagggaagggatctgggtttttttgttgttttattcttgttttttttaagtagttcaaattctgaaactgtgatttaaaaattttttacagtcaagcattctgattttgaacataactcccttccctttctgtgtaacaaaggtctctctgttatctcttaaattttgttacatctccctcagcctctttctttgtccgtctcccttctgtcattgtctatggatgtttacctctctgttctcctaaaagtttgaagattaggtcaactcttatttctagttcattggtaatttaatcttaatttttttttcgtgatttttgttggttgtataatctgctgacgtatttttatactcaagtgtagttttctattaaaaagaaaagtggttggattaaaaatagtaagctatgtaaccctcatgttactttcactttcaaatattgggtacctaaaacattacttcagagattatgtaatcctattatagtatgtttgctttcctttattgttggattttacattctgatttggctttcctccaaaaaatgtatatcatgaaagactagacagttatttgcaagtgtttagaaaggtgttaaaaatgtaaagcaaagagtcttaactttctcctaattgggagaaaaatgctttaacattactataataatattccaggtttggagggggtctccaggccccatatttgctgttaatagttggaccttttagaccatgtgttatttgcaatcccagaatgattgcttctgctattagttaaaaagatactattcttttctttctgtacaagtgcaatactccccttgaagtcttaaaaactatggtgatttttttttcttttctgacctattcttcctttagctaatgacaaaaagaaactcataaaagtcatagtatgttaaaggacacaacaagcaaagagaaaaacactccacaatcaaaagattacagaatgtggaaaccactagtctgatctcatggtatctttatttaagctaaatttccatggaaattagtaatcttttgcttgaaaaatgtgtcctaaagttgaactttttacagattgaatcttcttagaccctcgcccaatgctctaaattaagaacctaatacttaatatttttattttacttctccccttttagaaataaacttttaaataaaagcaaagcacttagctgagttttaaacacttacatatcacctattggagaaattttttttaaaaatatttggagcagtcctgttttcatacaaatttaagtaagaggtatttttcttatacatatttatatgtagtgtgctaattttctttttttatacctgtgtccctgtagtaaaactgctgtaatataaatacatgttttgttaaaagataacatttctttggcatttcttttaaaggcagttactgcatttctgcatttgtacagtatgtgtcttggccattttagatattctttctttaacaataccaaaggtaattagactattttaaagactaattgcttgacagtttctagggtattttgtgttttagaagcaaaaaaagaaaaaaaaataggtcaaaccagtaaacctcattttttttcaaactaataatttggggaaataaaaactattgtttaaaaaagaaatatatatatatatatataaatatatatgtaaagttaaaattccataccttgtatgtcaggtttgctaagtgtaatgtagtttttttaaggctcaaataccatacctcagaaaatgaggtttactatggaaatactgaaacagtctttgcagctgtgtgacaagtcactctactacatactgatttggagacctccgctaaatagttttatcactgcagactaaaatgtgggacttgtatcttctttgtttttaatgcacacacatacatgttctgtgcatgtatgtggttactgtgtatatgtgtatgagtgttgtatatgcatgtgtgagtgtgtgtctgtatgtgtgtacaactaaagaagctgcagaaactttgtaatactttgtgaaaaggattatattataaaggtttgtactgtctgagtgcacagctactggaataaatttagggaatctcaggaacaagcatataatttgtccaagatttatttcttctcagaagtgtaagtgcagtttttaattctgtatattatttaatattttaccaataaaataaacttctgacataaaaagtttgctataaaaaaaaaaaaaaaaaaaaaa

SEQ ID NO: 1422 - DNA, 2437 bp, Homo sapiens
gcaggagcacgtggagaggccgagtagccacagcggcagctccagcccggcccggcagcgacatggaagatatacaaacaaatgcggaactgaaaagcactcaggagcagtctgtgcccgcagaaagtgcagcggttttgaatgactacagtttaaccaaatctcatgaaatggaaaatgtggacagtggagaaggcccagccaatgaagatgaagacataggagatgattcaatgaaagtgaaagatgaatacagtgaaagagatgagaatgttttaaagtcagaacccatgggaaatgcagaagagcctgaaatcccttacagctattcaagagaatataatgaatatgaaaacattaagttggagagacatgttgtctcattcgatagtagcaggccaaccagtggaaagatgaactgcgatgtgtgtggattatcctgcatcagcttcaatgtcttaatggttcataagcgaagccatactggtgaacgcccattccagtgtaatcagtgtggggcatcttttactcagaaaggtaacctcctccgccacattaaactgcacacaggggaaaaaccttttaagtgtcacctctgcaactatgcatgccaaagaagagatgcgctcacggggcatcttaggacacattctgtggagaaaccctacaaatgtgagttttgtggaaggagttacaagcagagaagttcccttgaggagcacaaggagcgctgccgtacatttcttcagagcactgacccaggggacactgcaagtgcggaggcaagacacatcaaagcagagatgggaagtgaaagagctctcgtactggacagattagcaagcaatgtggcaaaacgaaaaagctcaatgcctcagaaattcattggtgagaagcgccactgctttgatgtcaactataattcaagttacatgtatgagaaagagagtgagctcatacagacccgcatgatggaccaagccatcaataacgccatcagctatcttggcgccgaagccctgcgccccttggtccagacaccgcctgctcccacctcggagatggttccagttatcagcagcatgtatcccatagccctcacccgggctgagatgtcaaacggtgcccctcaagagctggaaaagaaaagcatccaccttccagagaagagcgtgccttctgagagaggcctctctcccaacaatagtggccacgactccacggacactgacagcaaccatgaagaacgccagaatcacatctatcagcaaaatcacatggtcctgtctcgggcccgcaatgggatgccacttctgaaggaggttccccgctcttacgaactcctcaagcccccgcccatctgcccaagagactccgtcaaagtgatcaacaaggaaggggaggtgatggatgtgtatcggtgtgaccactgccgcgtcctcttcctggactatgtgatgttcacgattcacatgggctgccacggcttccgtgaccctttcgagtgtaacatgtgtggatatcgaagccatgatcggtatgagttctcgtctcacatagccagaggagaacacagagccctgctgaagtgaatatctggtctcagggattgctcctatgtattcagcatcgtttctaaaaaccaatgacctcgcctaacagattgctctcaaaacatactcagttccaaacttcttttcataccatttttagctgtgttcacaggggtagccagggaaacactgtcttccttcagaaattattcgcaggtctagcatattattacttttgtgaaacctttgttttcccatcagggacttgaattttatggaatttaaaagccaaaaaggtatttggtcattatcttctacagcagtggaatgagtggtcccggagatgtgctatatgaaacattctttctgagatatatcaaccacacgtggaaaagcctttcagtcatacatgcaaatccacaaagaggaagagctgaccagctgaccttgctgggaagcctcacccttctgcccttcacaggctgaagggttaagatctaatctccctaatctaaatgacagtctaagagtaagtaaaagaacagccataaaataagtatctgttacgagtaactgaagaccccattctccaagcatcagatccatttcctatcacaacatttttaaaaaatgtcatctgatggcacttctgcttctgtcctttaccttcccatctccagtgaaaagctgagctgctttgggctaaaccagttgtctatagaagaaaatctatgccagaagaactcatggttttaaatatagaccatcatcgaaactccagaaatttatccactgtggatgatgacatcgctttcctttggtcaaggttggcagagcaagggtataaagggggaaattgtttggcagcaccaacagaaaacaaa

SEQ ID NO: 1423 - DNA, 5506 bp, Homo sapiens
gaagctgtccgtgtcctgggccccatgacctctggggccttggcttccccagctggcagaggattgggccttccctagggccccccctttctccctcccacccgcaggcccatccatctctctctctctctcttgcacacactcttgcctctctcaggcatttgttgtgcagttcctctttgtctgctgggcacgaggggcaacagcatctgcctttccctccctgtgcacacacccaccacccacccccttcactgtcttggaaaagggatgctgtagcctagcatctcccccactatatacacatatacattctctccagccccctccccaagcacatccaagcgtgctctcccctctccttctctccctctctctctctctctctctcacacacacacacacacacacactcaacacacatacaccctgggctgagctgctcttgctggctgcagccgtgggcctctgctcaccgtgccgctgctgctgcctgcgaaatgacggcggttcccctcacttccaggaatccacgcttcctggaaggtgagtggctgggctcacccctgcctgccactgagacgcagacatgcatacaccacccgcactccctcgccgtttccaaggcggcggccgcgttcgcaccccagggtctcaccggcaagggaaggataatctggagagggatccctcaggagggtgtgttccggatttcttgcctcaggcccaagactccaaccattttataatggaatctttattttgtgaaagtagcggggactcatctctggagaaggagttcctcggggccccagtggggccctcggtgagcacccccaacagccagcactcttctcctagccgctcactcagtgccaactccatcaaggtggagatgtacagcgatgaggagtcaagcagactgctggggccagatgagcggctcctggaaaaggacgacagcgtgattgtggaagattcattgtctgagcccctgggctactgtgatgggagtgggccagagcctcactcccctgggggcatccggctgcccaatggcaagctcaagtgtgacgtctgcggcatggtctgtattggacccaacgtgctcatggtgcacaagcgcagtcacactggtgaaaggcccttccattgcaaccagtgtggtgcctccttcacccagaaggggaacctgctgcgccacatcaagctgcactctggggagaagccctttaaatgtcccttctgcaactatgcctgccgccggcgtgatgcactcactggtcacctccgcacacactcagtctcctctcccacagtgggcaagccctacaagtgtaactactgtggccggagctacaaacagcagagtaccctggaggagcacaaggagcggtgccataactacctacagagtctcagcactgaagcccaagctttggctggccaaccaggtgacgaaatacgtgacctggagatggtgccagactccatgctgcactcatcctctgagcggccaactttcatcgatcgtctggccaatagcctcaccaaacgcaagcgttccacaccccagaagtttgtaggcgaaaagcagatgcgcttcagcctctcagacctcccctatgatgtgaactcgggtggctatgaaaaggatgtggagttggtggcacaccacagcctagagcctggctttggaagttccctggcctttgtgggtgcagagcatctgcgtcccctccgccttccacccaccaattgcatctcagaactcacgcctgtcatcagctctgtctacacccagatgcagcccctccctggtcgactggagcttccaggatcccgagaagcaggtgagggacctgaggacctggctgatggaggtcccctcctctaccggccccgaggccccctgactgaccctggggcatcccccagcaatggctgccaggactccacagacacagaaagcaaccacgaagatcgggttgcgggggtggtatccctccctcagggtcccccaccccagccacctcccaccattgtggtgggccggcacagtcctgcctacgccaaagaggaccccaagccacaggaggggttattgcggggcaccccaggcccctccaaggaagtgcttcgggtggtgggcgagagtggtgagcctgtgaaggccttcaagtgtgagcactgccgtatcctcttcctggaccacgtcatgttcactatccacatgggctgccatggcttcagagacccttttgagtgcaacatctgtggttatcacagccaggaccggtacgaattctcttcccacattgtccggggggagcataaggtgggctagcaacctctccctctctcctcagtccaccactccactgccctgactacaggcattgatccctgtccccaccatttcccaaggagttttgctttgtagccctcactactggccacctgacctcacacctgaccctgacccctcctcacctattctcttcctctatcctgaccgatgtaagcattgtgatgaaacagatcttttgcttatgtttttcctttttatcttctctcatcccagcatactgagttatttattaattagttgatttatttttgcctttttaaattttaacttatatcagtcacttgccactcccccaccctcctgtccacaactcctttccactttaggccaatttttctctcttagatcttccagcagccccaggggtaggaagctcctcttagtactaagagacttcaagcttcttgctttaagtcctcaccctttacattatctaattcttcagttttgatgctgatacctgcccccggccctaccttagctctgtggcattatatctcctctctgggactcttcaacctggtactccatacctcttgtgccctctcactttaggcagcttgcactattcttgaatgaatgaagaattatttcctcatttggaagtaggagggactgaagaaattctccccaggcactgtgggactgagagtcctattcccctagtaataggtcatattcccctagtaatatgagttctcaaagcctacattcaggatctccctctaggatgtgatagatctggtccctctccttgaactacccctccacacgctctagtcccttcaacctaccggtctattaagtggtggcttttctctccttggagtgccccaattttatattctcaggggccaaggctaggtctgcaaccctctgtctctgacagattgggagccacaggtgcctaattgggaaccagggcatgggaaaggagtgggtcaaaattcttctctttctcctccacctctcaaacttcttcactatagtgaccttcctaggctctcaggggctccttcagtccccatcctatgagaaactagtgggttgctgcctgatgacaaggggttgtttcagcccctcagtcatgctgccttctgctgctccctcccagcaggattcaccctctcattcccgggctcctgggccctgttcttaggatcagtggcagggagaaacgggtatctcttttctctcttctaattttcagtataaccaaaaattatcccagcatgagcacgggcacgtgcccttcaccccattccacccttgttccagcaagactgggatgggtacaactgaactggggtcttcctttactacccccttctacactcagctcccagacacagggtaggaggggggactgctggctactgcagagacccttggctatttgagtaacctaggattagtgagaaggggcagaaggagatacaactccactgcaagtggaggtttctttctacaagagttttctgcccaaggccacagccatcccactctctgcttccttgagattcaaaccaaaggctgtttttctatgtttaaagaaaaaaaaaagtaaaaaccaaacacaacacctcacaagttgtaactcttggtccttctctctctccttttctcttcccttccttccccttccatctttctttccacatgtcctttccttattggctcttttacctcctacttttctcactccctatcagggatattttggggggggatggtaaagggtgggctaaggaacagaccctgggattagggccttaagggctctgagaggagtctaccttgccttcttatgggaagggagaccctaaaaaactttctcctctttgtcctcctttttctcccccactctgaggtttccccaagagaaccagattggcagggagaagcattgtggggcaattgttcctccttgacaatgtagcaataaatagatgctgccaagggcagaaaatggggaggttagctcagagcagagtagtctctagagaaaggaagaatcctcaacggcaccctggggtgctagctcctttttagaatgtcagcagagctgagattaatatctgggcttttcctgaactattctggttattgagcccttcctgttagacctaccgcctcccacctcttctgtgtctgctgtgtatttggtgacacttcataaggactagtcccttctggggtatcagagccttagggtgcccccatccccttccccagtcaactgtggcacctgtaacctcccggaacatgaaggactatgctctgaggctatactctgtgcccatgagagcagagactggaagggcaagaccaggtgctaaggaggggagagggggcatcctgtctctctccagaccatcactgcactttaaccagggtcttaggtacaaaatcctacttttcagagccttccagctctggaacctcaaacatcctcatgctctctcccagctccttttgcataaaaaaaaaagtaaagaaaaagaaaaaaaaatacacacacactgaaacccacatggagaaaagaggtgtttccttttatattgctattcaaaatcaataccaccaacaaaatatttctaagtagacacttttccagacctttgtttttttgtgtcagtgtccaagctgcagataggattttgtaatacttctggcagcttctttccttgtgtacataatatatatatatacatatatatatatatttttaatcagaagttatgaagaacaaaaagaaaaaataaacacagaagcaagtgcaataccacctctcttctccctctctcctagggtttcctttgtagcctatgtttggtgtctcttttgacctttaccccttcacctcctcctctcttcttctgattcccctcccccccttttttaaagagtttttctcctttctcaaggggagttaaactagcttttgagacttattgcaaagcattttgtatatgtaatatattgtaagtaaatatttgtgtaacggagatatactactgtaagttttgtactgtactggctgaaagtctgttataaataaacatgagtaatttaacaccaaaaaaaaaaaaaaaaaaaaaaaaaaaaaaaaaaaaaaaaaaaaaaaaaaaaaaa

SEQ ID NO: 1424 - DNA, 5132 bp, Homo sapiens
agccattttgtcagtcgccagcggatcccgcgcgctggagaagtgcagttccccctggttaccaactcgcccgcttttccttcggactaagggagccgtcgaagagcgctcgccaaaggcgcagccgtttctccctacggtgccgccgctcctcctgcagccgcccgtaggtagcgggccgttttcctcacctgtccctgacaggcgccctcagggagccgcggtccgcgatgtcaagcgaggaaagctaccgggccatcctgcgttacctgacgaacgagcgcgagccgtatgcgccgggcaccgagggcaatgtcaagcgtaaaatccgaaaagctgccgcctgctacgtggtgcgcggcgggactctgtattaccagcggcggcagcggcaccgcaagaccttcgcggagctggaggtggtgctgcagccggagcgacgccgggacctcatcgaggcggcgcacctgggtcccggcggcactcaccacacccggcatcagacctggcactacttgtccaagacgtactggtggcgaggtatattgaagcaagtcaaagattacattaaacagtgtagcaaatgccaggagaaactagatcgatcccgtccaatatcagatgtttcagaaatgttggaagaattgggactagaccttgaatctggagaagaaagtaatgaatcggaagatgacctgagcaactttacttcatctccaactacagcatccaagcctgcaaaaaagaagccagtatccaaacatgaacttgtgtttgttgacaccaaaggagtggtaaaacgttcttctccaaaacattgtcaggctgtcttaaaacagctgaacgaacagagactttccaaccagttctgtgatgttactttgttaattgaaggagaagagtacaaagctcataaatctgttttgtcagcaaatagcgagtattttcgagatctttttattgagaaaggagctgtttccagtcatgaggctgtggtggatctttctggtttttgtaaggccagcttccttcctttactggaatttgcctatacttctgtactaagttttgatttctgtagcatggctgatgtagccatcttagctcgtcatcttttcatgtcagaagtcttagagatttgtgaaagtgtacataagctaatggaagagaagcagctaacagtatataagaagggcgaagtacaaacagttgcatccacccaggacttacgagtacagaatggaggtacagcacctcctgttgctagcagtgagggaaccacaacaagtttacctactgaacttggggattgtgaaattgtactactggtaaatggagaattgccagaagctgagcagaatggagaggtaggacgacagcctgagccccaggtttcttcagaggctgaatctgccctgtcatcagtaggatgtatagctgattcccatcctgaaatggagtctgttgatttaataacaaaaaacaaccagacagaactagaaacttcaaacaacagagaaaataacacagtttctaatatacaccctaaactttcaaaagagaatgtaattagtagctcgccagaggatagtggtatgggaaatgatatatcagctgaggatatttgtgccgaagacattccaaaacataggcagaaagttgaccaacctttaaaagatcaggaaaatctagttgcatcaacagcaaagacagactttggccctgatgatgatacttatagaagcaggcttcgacaacgttctgttaatgaaggggcatatattcgactacacaagggaatggagaaaaagctgcagaaacggaaagccgttcccaagtcagcagttcaacaggtggctcagaagttagttcaaagaggaaaaaagatgaaacagccaaaaagagatgctaaagagaacacagaagaagcatctcataaatgtggggaatgtggaatggtttttcagagacgatacgcccttataatgcacaaactgaaacatgaaagagctagagattacaaatgtccattgtgtaaaaaacagtttcagtacagtgcctctttgcgagcacatcttattcgtcataccagaaaagatgcaccctcttcatcctcgtccaattccacgtctaatgaagcatcgggaacatcatctgagaagggcagaaccaagcgggaatttatatgttccatatgtggaagaacattacctaaattatattctctccgaatacatatgttaaagcacacaggtgtaaagccacatgcatgccaggtctgtggaaagacttttatctataagcatggtctaaaattacatcagagtcttcatcaatcacagaagcagttccagtgtgaactgtgtgttaagtcatttgttaccaaacggagtcttcaagaacatatgagtattcacacaggagagtccaagtacctttgctcagtttgtggaaagtcttttcataggggctctggactcagcaagcacttcaagaaacaccaaccaaagcctgaggttcgaggctatcattgtactcaatgtgaaaaaagtttctttgaagctagagatcttcgccagcacatgaacaaacatcttggtgtgaagccattccagtgccaattttgtgataagtgctatagttggaagaaagattggtattcccatgtgaagtctcattctgtcactgagccttataggtgtaatatatgtggcaaagaattttatgaaaaagctttgttcagaaggcatgtaaagaaagctacccatgggaagaaaggaagagcaaagcaaaacctggaacgggtgtgtgaaaaatgtggaagaaaattcactcagctaagagagtataggagacacatgaacaaccatgaaggagttaagccatttgagtgcttaacatgtggagtagcttgggctgatgcccgatctctaaaacgccatgtcagaacacatactggtgaacggccctatgtctgtcctgtatgtagcgaagcctacatagatgctcgaacactccgtaaacatatgactaaattccacagagactatgtgccttgcaaaattatgctggaaaaagacacccttcagtttcataaccaaggaactcaagtggcacatgctgttagcatcttaacagcaggcatgcaggaacaagaaagcagtggtcctcaagaacttgagactgtggtagtgacaggagaaactatggaagctctggaagctgttgcagctactgaagagtatccatcggtatctacactttctgaccaaagtattatgcaagtggttaattatgtattagcacaacagcaaggacagaagctatctgaagttgcagaagctattcaaactgttaaagtagaggtagcacatatttcaggaggagaatgagtatgttaatgaagataaaaagaagtgacatctcttgtacactgaactcacagaacatttgtttacaattctgtgtgactgtctgcttggagtttacatatcaaagttctgggctgtttggtaacgtaacgtttccaaacattttgtctggccaatgggttctatagaaaagtccgtttagtgtagagaaattgaaaacagatctattaggttggtgcaattgcttttgcaccaacctaatatttgatggcagtggtttatcatgatataccttttatgaattaatgtttataaatgactgtactgaatttaaaaccgtacagtttcatttgcattttgacattactttattatacattttgcatttaaaaggctgcaccagttggcttttcttctgttttattctcaaaatatagagattctgtgatttatttgccctgtttatggattaaaaagaaaattctaatataaagcatttcaataggatgcataggtatattacgttttttaaatgctttagatctgtgattcttgacttactatttattttatccccttttaagtcagggatgctttattctattttaaagcacttatgagttacatgttgtaatcaagtttgcacaatatatttatctatatgaggaacccataaatgaatagctaatttttaaaatgccattaaaatgcatgaaatgcttattaaaaccttactatactatttcttcaaggcaagtaaattgaccatgagaaaagaacacagttattaaacactgttgacaggaaaattctccttgataacataggacaattaatggaaaaaaaaattctcattatttgcaaagaatgaacaagttaatgaacaaacaaactagatttggtatgttttcagcttttgtatcatgtttaattgtttaatttggttgaaaaactgcagttgagaaatcagatagcaatatagacattcacagcagctctgtggataccatgtaattgtcaggtaatttcagaatgttgaaaattattcagtgcagccctcatagtatcatacttgaagaaattgattacagttccactaaattgttgaagataaattatttttaaaggttatgaaaactaagttatattaattcatatgtttgatttttaaatcccacctcctcaagctatccaattttctgactttgaaaataaccatgagagatgccacatttctctctgggaaactaccactcaaagaataattgttaaaaattaagcttttaggtattagaagctgttataaagtataaaattaagatataagcagatcacatgtaaatcattcctaaagcacaagaaaagaatgtgccttgatgtacatatattactaagttgcctctcccagtttactttaaaaatggctttaaggataaagaataaatgtgatagctgtgcatgcattatatatttgcatttgcaaatttcccattgttttaacagctgtgtggctgactttcaattttaagacgtgaattgacatacagcccataactttataatggctgctcatttatcttatctttcagttagtggaaaaacatttcaacctgactaaaatttggaattgtgtcttttatgttccatcctctgttgttactagatttagtttaaaaattgtgtatgaccattaatgtatgtcataaacatgtaaataaaagatgttgaatcttgttgaaaagcatgaaaaaaaaaaaaaaa

SEQ ID NO: 1425 - DNA, 4633 bp, Homo sapiens
gccctccattgtctccacggcggcgaggagcgccggcgagcgcagcccgggaccgagcggggcggcgcggctggcggggccggcggcggctgaagcgagagcgcgacgcgacgcgaccgcggcttcccgagctgcgcctggccgcccagcgccgcggcccgcccgaggcctggaggggtccgggccgccgtccatggtcgcggcgtcctgaggcgggggacgcgcccggcgcccccggccctcctccgcctcctcccgcggggcgggcggcctcctccggcgcctccccgcgcccgcccgccgctcgccgccgcctccctccctccttccctgcggctcccccggctttcggagcccgggggcggcctgtggcgcgcggagcccgcgccggactgcgcctctttggaccttgaggggaaacatgcgtttgccttggatcgtttgaaattctgagtttgggatccccgcccgcccgcctgcctcttccgccccgcgggttttttccttttttccttttgctttttttccttttctccctccgggtctcctttttgactccctccccctttatgctcgcccagccctccccctgctgctgagaagtgggggagggtctcggcctccaggttcccgccccaccggggcccgggcgagcatggggggcaagcagagcacggcggcccgctcccggggccccttcccgggggtctccaccgatgacagcgccgtgccgccgccgggaggggcgccccatttcgggcactaccggacgggcggcggggccatggggctgcgcagccgctcggtcagctcggtggcaggcatgggcatggaccccagcacggccgggggggtgccctttggcctctacacccccgcctcccggggcaccggcgactccgagagggcgcccggcggcggagggtctgcgtccgactccacctatgcccatggcaatggttaccaggagacgggcggcggtcaccatagagacgggatgctgtacctgggctcccgagcctcgctggcggatgctctacctctgcacatcgcacccaggtggttcagctcgcatagtggtttcaagtgccccatttgctccaagtctgtggcttctgacgagatggaaatgcactttataatgtgtttgagcaaacctcgcctctcctacaacgatgatgtgctgactaaagacgcgggtgagtgtgtgatctgcctggaggagctgctgcagggggacacgatagccaggctgccctgcctgtgcatctatcacaaaagctgcatagactcgtggtttgaagtgaacagatcttgtccggaacaccctgcggactgacctgcgggcttgcttgctgactcctctcaaagggacagagcgcccctgctccagggaggaggctcaccggaccctggggcagagctgagcttgggacaccagcgggaacagggcaccccttctgcactgacttccagatcatggttctcccttcctccctgaggacaccaaattggatgagagcaagtttgagagaagaatgaatcaactgctatccttcccctcacccctcagcccaggagggaaagggcattttctttttcatctttgaaaggcattgtgggtctgtctttaaagtgtttacaaaaaaaaattatataaaaaaaaagtctagtgtcgactggtgttttccctcgtgatgtttacagcttgctgtttgctgcccagccataacccactcagtgacagacgaacacagctaaggcctcgctgccagccttctgacggcgggcgagcacacggtctcttcccctgccccaactggccctctccaccaccaacttctctactttgggtttgtttggttttttccctctatttttctggctggttttttgctcttttctccccttgagaccctaatatcttgacttcattgccaaaaaacaacccattgagaactttcttcctactgatcccatctcttttcccttctttcctcctggttccggtcagttcagaggatttaacaatcacaagtgtcctgcaaaaatgcctgaacattattcttaggccctcgtggattttttttttcagaaaacttaaacaaaaaaagacttactaagaaatatgtacagctacccctgttttcaggcactatgtttgagaacattttagccattgatgttcacacgtggcatcagcccatgcaagataggtttctgtatttatatattaaaatacaaaaaaaaacttataaaatgtttaaaaaaatgttcaaagcttgggagaaaagctttcttcattagtcaaggtgttttgatatggtattaaaatgtctaataaaagatggcactgcgtgattttattttaatgaagtgttatacaatcaagaaatgggggcaagggcctgccccccactccctcacctacctccttagcattccttcaggctgctactcggggctccaggtgtgtgaattggtcctcagatagtcaggcctgggtggagggagtggcaagtcaggcgtgcctcctacaagcttcctaacctcttaagcatcatggaaccagtcagccctctgtggagtcattgtgctggacctctgaaaagatctgcaggggccaagatgttgcagccaccggaggctgcaaggatgtgggttcttccaggtgtgggcccagcccccctccttccagcctttgctccccatcccacgttccactcgccctgcctgttgttcagtttgcgtctcagtgctgactcacgggcatgcttcattgaggcccaggaagaggccctggtttggggctgtgccagctcagagcccttgaaccagaaccaactgctcaggctcacaaaagttggcaaaatgcgggctgggcaggcagctcggggcagggagcagcagtgcaggcctggcctgtgtccccgtgcccagcgggctcccggagcagcattccagagcctcctgcagagccagcgaaggaaagctctagagggagacgactccaccgcctctctgctctgacccttctcaggcccgcctgatgtgctggaccatccccctgctgccacggcccctggctccgcagtcaccctccatcagatgcttccagaagcacctactctgtgcaagggcattcacaacaggccagtgggcaaacgtgagccagggccagcggagaaacactaaagaagactcggtggttcagagcctgggtctcagcgcgggacccgtctggggtgaagaccttggggctgttgtgagtcggtggcaggaacgtgggctctagactgtgcattcaggctctcctacttggcagaatgatcttggggaaacgacttcatctgaacttcagatatttcacatgtgaagcggggacaaaaccatgcagctcagaggtccctgtgggggctgggggagctgccctgcaggtcttggcacatgcacagcaggctccccatagctttgtcaccacaaagggcactgttctattcacagcacctcctgcttctgcctggcaactgtgtctccctgtgctatatttaattccaccagcaaagctggcgaggcagggcccagccctgaaggagatctccttgcctgacccctggacctggaaatggaggcttcatgtgcccgccttggcggcttaagcctgctgctttggcagtgccatgggtgagccgagcagctgtgaggtgggtggggcagggctgtagcccacgccgggtgctattccaggctctaggggctggtgctcatccccacccccagcgacttccgtcctacctggcatgctgcagccctctgccggctgtggtgtcctctgaatttggacccaggttgcctgctcttgttgtgggggtgggattggggctgtctgtgtttcccaggtggagctcatgtttgtgatcctctatctggacagctctccagaatcctgtgttgcccctgttctgcctttctgggatgggagagaaggtgagggagccggcgagcaggttctaccctctctgctaagggcctagcacactttgatgaggttcctggacgtgagaccctcacaaagaccaaccattcctctaatagccatttaacggtactgcagttcatgggaaaatgtcctcattcttaggagatagatgctggattatataggtgaatgccttcaagaaatgtgtaatttaattccaaatagttccccccaaaatacacaaagcaaataaggccaaaatgttcattgttgaatctgcagtggctggtatttcagtgaacagtgtacttgttctttcaacttttctgtatgtttggaatttttcttaataaaagattgtgggaaatggtcatttgctgagcgcctcctagttgccaggcactggagggcgcatcaaagaagagtcctacccaggagggagagcgcagctgctgcaggattctcgcctggaagagtgggtggctggctggctggctggaaggggaggggcgagagggctgtctcggtgatgagcacacgcgtgctggggtggtttggggagagggctgagatttgtcaccagtgagcccttggcacggtctctgctccccaccagggcagcacgggacagaaacgtcacggaggagtagcctc

SEQ ID NO: 1426 - DNA, 1666 bp, Homo sapiens
cccctgggtggctgcggctggaccttcaccacctcttacaagctcaagaggcacctgcagtcgcacgataaactgcggcccttcggctgccctgcggagggctgtggcaagagcttcaccaccgtgtacaacctcaaggcgcacatgaagggccatgagcaggagaactcgttcaaatgtgaggtgtgcgaggagagcttccccacgcaggccaaactcggcgcccaccagcgcagccacttcgaacccgagaggccttaccagtgcgcgttttctggctgcaagaagacatttatcacagtgagtgctctgttttcccataaccgcgcccatttcagggaacaggaactgttttcctgctctttccctggctgcagcaagcaatatgacaaggcttgtaggctgaaaattcacctgcggagtcacaccggcgagagacctttcctttgtgactttgatggctgtggctggaacttcaccagcatgtccaaactcttaaggcacaaaaggaagcacgacgatgaccggaggttcatgtgccctgtggaaggctgtgggaaatctttcacgagggccgaacatctgaaaggccacagcattacccacctgggcacaaagcctttcgtgtgtcctgtggcaggctgctgtgccaggttctctgctcgcagtagcctctacattcactccaagaaacacctgcaggatgtggacacttggaaaagccgttgcccgatctcctcttgtaataaactcttcacatccaagcacagcatgaagacgcacatggttaaaaggcataaggtgggccaggatctcttagctcagctagaagcagcaaattctcttacacccagcagtgaacttaccagccagagacagaatgatctcagtgatgcagagatagtgtctctcttctctgatgtacctgacagtacttctgctgcattgctggacacagcattggtgaactctggaatcttgactattgatgtggcttctgtgagctcgactctggcagggcacctccctgctaataataataattccgtagggcaggctgtggaccctccgtccttgatggccaccagcgaccctcctcaaagtctggatacctctctcttttttggaacggcggccactggttttcagcagagctccttaaatatggatgaggtctcaagtgtaagtgtggggccattgggatctctggactctttggccatgaaaaactccagtccagagcctcaggctttgacacccagcagtaagctaacagtggacacagatactctgactccttcgagcaccctttgtgaaaacagtgtctcagaactactgacaccagccaaaagcggagtggagcgtacatcctaactctgacttctttggacaggagggagaaacccagtttggattccccaatgcagcaggaaaccatggttctcagaaagaaagaaatcttatcactgtgactggcagctcatttttggtatgaagcaactctattcattccttgccatgtggctaacttttattacagtcaattttgaggatattctggactaaatatttaagtgcagtcatttctttttggtttgcaaaaagagcacagccctggactatgagtttggagatctaaattctgatcttgagtctggaactgaca

SEQ ID NO: 1427 - DNA, 1209 bp, Homo sapiens
cccctgggtggctgcggctggaccttcaccacctcttacaagctcaagaggcacctgcagtcgcacgacaaactgcggccctttggctgcccggcagagggctgtggcaagagcttcaccacagtgtacaacctcaaggcgcacatgaagggccatgagcaggagaactcattcaaatgcgaggtgtgcgaggagagcttccccacgcaggccaaactcagcgcccaccagcgcagccacttcgaacctgagaggccttaccagtgcgcgttttctggctgcaagaagacatttatcacagtgagtgctctgttttcccataaccgcgcccatttcagggaacaggaactgttttcctgctcttttcctggctgcagcaaacaatatgacaaggcttgtaggctgaaaattcacctgcggagtcacaccggcgagagacctttcctttgtgactttgatggctgtggctggaacttcactagcatgtccaaactcttaaggcacaaaagaaagcacgacgatgaccggaggttcatgtgccctgtggaaggctgtgggaaatctttcacgagggcggaacatctgaaaggccacagcataacccacctgggcacaaagcctttcgtgtgtcctgtggcaggctgctgtgccaggttctctgctcgcagtagcctctacattcactccaagaaacacctgcaggatgtggacacttggaaaagccgttgcccgatctcctcttgtaataaactcttcacatccaagcacagcatgaagacgcacatggttaaaaggcataaggtgggccaggatctcttagctcagctagaagcagcaaattctctcacacccagcagtgaacttaccagccagagacagaatgatctcagtgatgcagagatagtgtctctcttctctgatgtacctgacagtacttctgctgcattgctggacacagcattggtgaactctggaatcttgactattgatgtggcttctgtgagctcgactctggcagggcacctccctgctaataataataattccgtagggcaggctgtggaccctccgtccttgatggccaccagcgaccctcctcaaagtctggatacctctctcttttttggaacggcggccactggttttcagcagagctccttaaatatggatgaggtctcaagtgtaagtgtggggccattgggatctctg

SEQ ID NO: 1428 - DNA, 2325 bp, Homo sapiens
cccgccccctctcttctccctccctcctccttccgtgtgtccctccccgcccggctggaggctgctccggaccgggacgcagagtctgcggacccggcgccgaggcggccacccgagacgcggcgcgcacgctccggcctgcgcagcccggcccggccatggcggccccccgcccgtctcccgcgatctccgtttcggtctcggctccggctttttacgccccgcagaagaagttcggccctgtggtggccccaaagcccaaagtgaatcccttccggcccggggacagcgagcctcccccggcacccggggcccagcgcgcacagatgggccgggtgggcgagattcccccgccgcccccggaagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacagcccagggagaaggtgagcagtattgatttggagatcgactctctgtcctcactgctggatgacatgaccaagaatgatcctttcaaagcccgggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagttttctccagtgactcctaagtttactcctgtggcttccaagttcagtcctggagccccaggtggatctgggtcacaaccaaatcaaaaattggggcaccccgaagctctttctgctggcacaggctcccctcaacctcccagcttcacctatgcccagcagagggagaagccccgagtgcaggagaagcagcaccccgtgcccccaccggctcagaaccaaaaccaggtgcgctcccctggggccccagggcccctgactctgaaggaggtggaggagctggagcagctgacccagcagctaatgcaggacatggagcatcctcagaggcagaatgtggctgtcaacgaactctgcggccgatgccatcaacccctggcccgggcgcagccagccgtccgcgctctagggcagctgttccacatcgcctgcttcacctgccaccagtgtgcgcagcagctccagggccagcagttctacagtctggagggggcgccgtactgcgagggctgttacactgacaccctggagaagtgtaacacctgcggggagcccatcactgaccgcatgctgagggccacgggcaaggcctatcacccgcactgcttcacctgtgtggtctgcgcccgccccctggagggcacctccttcatcgtggaccaggccaaccggccccactgtgtccccgactaccacaagcagtacgccccgaggtgctccgtctgctctgagcccatcatgcctgagcctggccgagatgagactgtgcgagtggtcgccctggacaagaacttccacatgaagtgttacaagtgtgaggactgcgggaagcccctgtcgattgaggcagatgacaatggctgcttccccctggacggtcacgtgctctgtcggaagtgccacactgctagagcccagacctgagtgaggacaggccctcttcagaccgcagtccatgccccattgtggaccacccacactgagaccacctgcccccacctcagttattgttttgatgtctagcccctcccatttccaacccctccctagcatcccaggtgccctgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctgggagaccctccaggacattcccaccctcccccatgctgccaagttgtagctatagctacaaataaaaaaaaaccttgttttccagaaaaaaaaaaaaaaaaaaaaa

SEQ ID NO: 1429 - DNA, 23 bp, Artificial Sequence
  Description of Artificial Sequence: Synthetic primer
gtgagcaagggcgaggagctgtt

SEQ ID NO: 1430 - DNA, 28 bp, Artificial Sequence
  Description of Artificial Sequence: Synthetic primer
ttacttgtacagctcgtccatgccgaga

SEQ ID NO: 1431 - DNA, 23 bp, Artificial Sequence
  Description of Artificial Sequence: Synthetic primer
gtgagcaagggcgaggagctgtt

SEQ ID NO: 1432 - DNA, 31 bp, Artificial Sequence
  Description of Artificial Sequence: Synthetic primer
ctacacattgatcctagcagaagcacaggct

SEQ ID NO: 1433 - DNA, 21 bp, Artificial Sequence
  Description of Artificial Sequence: Synthetic primer
gctgtcagcgacgcgctgctc

SEQ ID NO: 1434 - DNA, 32 bp, Artificial Sequence
  Description of Artificial Sequence: Synthetic primer
ttaaaaatgcctcttcatgtgtaaggcgaggt

SEQ ID NO: 1435 - DNA, 27 bp, Artificial Sequence
  Description of Artificial Sequence: Synthetic primer
cccctcaacgttagcttcaccaacagg

SEQ ID NO: 1436 - DNA, 28 bp, Artificial Sequence
  Description of Artificial Sequence: Synthetic primer
ttacgcacaagagttccgtagctgttca

SEQ ID NO: 1437 - DNA, 24 bp, Artificial Sequence
  Description of Artificial Sequence: Synthetic primer
gcgggacacctggcttcggatttc

SEQ ID NO: 1438 - DNA, 28 bp, Artificial Sequence
  Description of Artificial Sequence: Synthetic primer
tcagtttgaatgcatgggagagcccaga

SEQ ID NO: 1439 - DNA, 28 bp, Artificial Sequence
  Description of Artificial Sequence: Synthetic primer
tacaacatgatggagacggagctgaagc

SEQ ID NO: 1440 - DNA, 25 bp, Artificial Sequence
  Description of Artificial Sequence: Synthetic primer
tcacatgtgtgagaggggcagtgtg

SEQ ID NO: 1441 - DNA, 18 bp, Artificial Sequence
  Description of Artificial Sequence: Synthetic primer
ggctccgtgtccaaccag

SEQ ID NO: 1442 - DNA, 18 bp, Artificial Sequence
  Description of Artificial Sequence: Synthetic primer
tcaattctgtgcctccgg

SEQ ID NO: 1443 - DNA, 22 bp, Artificial Sequence
  Description of Artificial Sequence: Synthetic primer
gagcttctatcgccgccactcc

SEQ ID NO: 1444 - DNA, 26 bp, Artificial Sequence
  Description of Artificial Sequence: Synthetic primer
tcaaagcacctgataaatcgcattgg

SEQ ID NO: 1445 - DNA, 42 bp, Artificial Sequence
  Description of Artificial Sequence: Synthetic oligonucleotide
tcctcgcccttgctcaccatggtggctcttatatttcttctt

SEQ ID NO: 1446 - DNA, 38 bp, Artificial Sequence
  Description of Artificial Sequence: Synthetic oligonucleotide
cccgcagaaggcagcttacttgtacagctcgtccatgc

SEQ ID NO: 1447 - DNA, 42 bp, Artificial Sequence; identical to SEQ ID NO: 1445
  Description of Artificial Sequence: Synthetic oligonucleotide

SEQ ID NO: 1448 - DNA, 36 bp, Artificial Sequence
  Description of Artificial Sequence: Synthetic oligonucleotide
cccgcagaaggcagcctacacattgatcctagcaga

SEQ ID NO: 1449 - DNA, 41 bp, Artificial Sequence
  Description of Artificial Sequence: Synthetic oligonucleotide
gcgcgtcgctgacagccatggtggctcttatatttcttctt

SEQ ID NO: 1450 - DNA, 39 bp, Artificial Sequence
  Description of Artificial Sequence: Synthetic oligonucleotide
cccgcagaaggcagcttaaaaatgcctcttcatgtgtaa

SEQ ID NO: 1451 - DNA, 45 bp, Artificial Sequence
  Description of Artificial Sequence: Synthetic oligonucleotide
gtgaagctaacgttgaggggcatggtggctcttatatttcttctt

SEQ ID NO: 1452 - DNA, 36 bp, Artificial Sequence
  Description of Artificial Sequence: Synthetic oligonucleotide
cccgcagaaggcagcttacgcacaagagttccgtag

SEQ ID NO: 1453 - DNA, 41 bp, Artificial Sequence
  Description of Artificial Sequence: Synthetic oligonucleotide
aagccaggtgtcccgccatggtggctcttatatttcttctt

SEQ ID NO: 1454 - DNA, 35 bp, Artificial Sequence
  Description of Artificial Sequence: Synthetic oligonucleotide
cccgcagaaggcagctcagtttgaatgcatgggag

SEQ ID NO: 1455 - DNA, 46 bp, Artificial Sequence
  Description of Artificial Sequence: Synthetic oligonucleotide
ctccgtctccatcatgttgtacatggtggctcttatatttcttctt

SEQ ID NO: 1456 - DNA, 34 bp, Artificial Sequence
  Description of Artificial Sequence: Synthetic oligonucleotide
cccgcagaaggcagctcacatgtgtgagaggggc

SEQ ID NO: 1457 - DNA, 43 bp, Artificial Sequence
  Description of Artificial Sequence: Synthetic oligonucleotide
ctggttggacacggagcccatggtggctcttatatttcttctt

SEQ ID NO: 1458 - DNA, 33 bp, Artificial Sequence
  Description of Artificial Sequence: Synthetic oligonucleotide
cccgcagaaggcagctcaattctgtgcctccgg

SEQ ID NO: 1459 - DNA, 43 bp, Artificial Sequence
  Description of Artificial Sequence: Synthetic oligonucleotide
tggcggcgatagaagctccatggtggctcttatatttcttctt

SEQ ID NO: 1460 - DNA, 41 bp, Artificial Sequence
  Description of Artificial Sequence: Synthetic oligonucleotide
cccgcagaaggcagctcaaagcacctgataaatcgcattgg

SEQ ID NO: 1461 - DNA, 87 bp, Artificial Sequence
  Description of Artificial Sequence: Synthetic oligonucleotide
ttggaccctcgtacagaagctaatacgactcactatagggaaataagagagaaaagaagagtaagaagaaatataagagccaccatg

SEQ ID NO: 1462 - DNA, 119 bp, Artificial Sequence
  Description of Artificial Sequence: Synthetic polynucleotide
gctgccttctgcggggcttgccttctggccatgcccttcttctctcccttgcacctgtacctcttggtctttgaataaagcctgagtaggaagtgagggtctagaactagtgtcgacgc

SEQ ID NO: 1463 - DNA, 27 bp, Artificial Sequence
  Description of Artificial Sequence: Synthetic primer
ttggaccctcgtacagaagctaatacg

SEQ ID NO: 1464 - DNA, 26 bp, Artificial Sequence
  Description of Artificial Sequence: Synthetic primer
gcgtcgacactagttctagaccctca

SEQ ID NO: 1465 - DNA, 27 bp, Artificial Sequence
  Description of Artificial Sequence: Synthetic primer
ttggaccctcgtacagaagctaatacg

SEQ ID NO: 1466 - DNA, 149 bp, Artificial Sequence
  Description of Artificial Sequence: Synthetic primer
ttttttttttttttttttttttttttttttttttttttttttttttttttttttttttttttttttttttttttttttttttttttttttttttttttttttttttttttttttttttttcttcctactcaggctttattcaaagacca

SEQ ID NO: 1467 - DNA, 18 bp, Artificial Sequence
  Description of Artificial Sequence: Synthetic primer
gaaggctggggctcattt

SEQ ID NO: 1468 - DNA, 20 bp, Artificial Sequence
  Description of Artificial Sequence: Synthetic primer
caggaggcattgctgatgat

SEQ ID NO: 1469 - DNA, 20 bp, Artificial Sequence
  Description of Artificial Sequence: Synthetic primer
acccacagcctggataacag

SEQ ID NO: 1470 - DNA, 20 bp, Artificial Sequence
  Description of Artificial Sequence: Synthetic primer
actggttgccatcaaactcc

SEQ ID NO: 1471 - DNA, 20 bp, Artificial Sequence
  Description of Artificial Sequence: Synthetic primer
cattacctgaaggccaagga

SEQ ID NO: 1472 - DNA, 20 bp, Artificial Sequence
  Description of Artificial Sequence: Synthetic primer
cagcatctgctggttgaaga

SEQ ID NO: 1473 - DNA, 20 bp, Artificial Sequence
  Description of Artificial Sequence: Synthetic primer
aaaagcccacatttgaggtg

SEQ ID NO: 1474 - DNA, 20 bp, Artificial Sequence
  Description of Artificial Sequence: Synthetic primer
gaaattcctgaaaccgacca

SEQ ID NO: 1475 - DNA, 20 bp, Artificial Sequence
  Description of Artificial Sequence: Synthetic primer
cgatcccaggaggtatcaga

SEQ ID NO: 1476 - DNA, 20 bp, Artificial Sequence
  Description of Artificial Sequence: Synthetic primer
tccagtcctcttctgcctgt

SEQ ID NO: 1477 - DNA, 20 bp, Artificial Sequence
  Description of Artificial Sequence: Synthetic primer
tcgctggtatcactcgtctg

SEQ ID NO: 1478 - DNA, 20 bp, Artificial Sequence
  Description of Artificial Sequence: Synthetic primer
gattctgaagaccgccagag

SEQ ID NO: 1479 - DNA, 20 bp, Artificial Sequence
  Description of Artificial Sequence: Synthetic primer
gttgtccccatgctgttctt

SEQ ID NO: 1480 - DNA, 20 bp, Artificial Sequence
  Description of Artificial Sequence: Synthetic primer
gcaagtcttacatggcagca

SEQ ID NO: 1481 - RNA, 13 nt, Artificial Sequence
  Description of Artificial Sequence: Synthetic consensus sequence
gccgccrccaugg

SEQ ID NO: 1482 - protein, 4 aa, Homo sapiens
YRPW

SEQ ID NO: 1483 - DNA, 4533 bp, Homo sapiens
ccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagggctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcca

SEQ ID NO: 1484 - DNA, 4608 bp, Homo sapiens
ccctgtgtctaggtcgtttgggaaacgccttggagagtcaagaataaatttgcaggtcaaacaatggatgactggaaaagtcggcttgtaatcaagagcatgcttccccatttcgccatggtgggaaatcgtcaggagcccagaaagctccaggaatcgggaaagaagccctcgtggatggaggaagaagatttatcttttctctacaagagcagcccaggaagaaagcatcagggaactgttaagaggagacaagaagaagaccacttccagtttccagacatggctgatgggggctaccctaataaaattaagaggccttgccttgaagatgtcacccttgcaatgggcccaggtgctcatcctagtactgcttgtgcagaactgcaggtccctccattgacaataaatcctagccctgcggctatgggagtggctggccagtcattactgctggagaataaccctatgaatggcaacatcatgggctcaccatttgtagtaccacagactacagaagtgggactgaaagggcccactgttccttactatgagaaaatcaacagcgtgccggctgtagaccaggagcttcaagagctgctagaggagctcaccaaaattcaagacccttctccaaatgagctagatcttgagaagatactggggacgaagccagaagagccactggttttagatcatccccaggcaaccctaagcacaactcccaagccttcggttcagatgtcacacttggagagcctggcttccagcaaggagtttgcttctagttgcagccaagttactggcatgtcacttcagatcccatcctcctccacagggatcagctattcgattccttccaccagtaagcagatagtgtcaccgagttcttcaatggcacagtccaagagccaggtccaggccatgctccctgtcgctctgccccccttaccagtgcctcagtggcatcacgcccaccagctgaaggcgttggcagccagcaagcaggggtctgctacaaagcagcaagggcccacccccagttggtctggtctgcctcctccaggactctctccaccttaccgcccagtgccatcaccacacccaccaccgctgccactgccaccaccaccacccccattcagcccccagagcctcatggtgtcctgcatgtcgtccaataccttgtcgggtagcactctccgaggctctcccaatgccttactgtcaagcatgacgtccagcagcaatgctgccctggggcccgccatgccctatgctcctgagaagctccccagccctgctctcactcaacagccgcagttcggccctcagagctccattcttgccaacctcatgtcctctaccatcaaaacccctcaaggacacctgatgtctgctctgcctgccagcaaccctgggccgtccccaccctatcgcccagagaagctctctagcccaggcttgccacagcagtccttcaccccacagtgttccctgatccgaagcctcactcccaccagtaatcttctaagccagcaacagcagcagcagcagcagcagcagcaagcaaatgtgatctttaagcccataagcagcaactcatccaaaaccctgagcatgatcatgcagcaggggatggcaagctccagcccaggagccacggagccatttacttttggcaacaccaagcccttgtcccattttgtttctgagccgggtccccagaagatgccctccatgcctaccacctctaggcagccttccctgctccactacctgcagcagccgacaccaacgcaggcctcctcagccactgcctcctccacggccactgccaccttgcagctgcagcagcagcagcagcaacagcagcagcagcctgaccattcttcattccttctgcagcagatgatgcagcaaccccagcgttttcagcgatcagtggcctcagattccatgcctgctctgcccagacagggctgttgccatctgtttgcatggacttctgcagctagctcggtgaagccccagcatcaacacgggaactctttcactagcaggcaagatcctcagcctggagacgtgtcaccgtctaacattactcatgtagacaaagcctgcaagcttggggaagccaggcacccccaggtcagcctcgggcgacagcccccgtcctgccaggccctggggagtgagtccttcctgcccggcagctcctttgctcatgagctggcccgagtcacctcctcgtacagcacctcagaggcagcgccctggggcagctgggatccgaaggcctggaggcaggtgcccgctccactactgcctagctgcgacgccacagcaagaggaacagagatcaggtcttatggcaatgacccctgaacggcagaatgcatatatctcccaacagatgagtccatttgaagccgtccaagaacaagtcacctccaagtgtagccggatcaaggcaagccccccatctagcaagcacttgatgccacccagaactgggcttcttcagaacaatctgagtccaggaatgatcccactcaccaggcaccagagctgcgagggcatgggagtgatctcaccaactctggggaagcggcaaggaattttcacctccagcccccagtgtcccatcctctcacactcaggccagactcccctgggcagacttgactctgtctgccagcatatgcagagccccaaggccaccccaccagaagtgcccctgcctgggttctgtcccagctccctgggcacccagtccttgagtccccaccagctcagacggcctagtgtgccaagaatgcccactgcgttcaacaatgctgcatgggtcacagcggcagcagctgtgaccacagcagtttcggggaaaacacccctcagccaagtggataatagcgttcagcagcactcaccttctggccaggcctgccttcagaggccatctgattgggaggcacaagtgcccgctgcgatgggaacacaagtgcccctggccaacaaccccagcttcagcctgctgggcagccagagcctcaggcagagcccggtacagggcccggtgcctgtagcaaacaccaccaagttcctccagcagggtatggccagctttagtcccctgagccccatacagggcatcgagccaccaagctatgtggctgctgctgccaccgctgctgctgcttctgccgttgctgccagccagttcccaggtccgttcgacagaacggatattccccctgagctgccacctgccgactttttgcgccagccccaacccccactaaatgatctgatttcgtcacctgactgcaatgaggtagatttcattgaagctctcttgaaaggctcctgtgtgagcccagatgaagactgggtgtgcaacttgaggctgatcgacgacattttggaacagcatgctgctgctcaaaatgccacagcccagaattctgggcaagtcacccaggatgctggggcactttaaatctgagcaggatgcccatagaaacccccatggtgacatcactctaggaagtggtgtcgatccatacccgcagttgtctcccgttacaatttgagtggtgttgtcagcccatgcttatccctctctctacctgtgacaaaatggaaagctggtgatttttcaagctacgtgtacatatttgaaaattttgtaaatggttttcctaaacattaatgacagaagtatttatacttcattttgtgactttgtaaataaagcgacggcttttgtttcagtagagttgtgtttactatgcattgttttgtgtttattatacaatgttacaaatatgcagaccgtgttgtttgctccagtgataccttgttaagctaggtggctgagtcgcttatggttttaatgcaatgagcaatgtggatatgaccaagagttgttgtgcaagttgacaaatgccaaatagaaaaccacttggccatttatttctatgttcactaaaaatcctattgccttgtgtgattcttaatctcttttgcgaacctttcagtctccgctagctctttcctaatgagctttacagcagaagctgttttatcgttaagtgccccacagagacactttaccaggaggctgggagagttctccagatttgggagaggcgcagagacagtgtgtgagccgagccctgtctcagcaatccacctggaggagctagagtatcctcctccctttaccattcagaccgagagaaaaagcccagcttgtgtgcaccctcgtggggttaaggcgagctgttcctggtttaaagcctttcagtatttgttttgatgtaaggctctgtggtttgggggggaacatctgtaaacattattagttgatttggggtttgtctttgatggtttctatctgcaattatcgtcatgtatatttaagtgtctgttatagaaaacccacacccactgtcctgtaaacttttctcagtgtccagactttctgtaatcacattttaattgccacctcgtatttcacctctacatttgaaatctggcgtctgtttcaagccagtgtgttttttcttcgttctgtaataaacagccaggagaaaagtgcca

SEQ ID NO: 1485 - DNA, 2772 bp, Homo sapiens
ggcctgctgggttagtgctggcagccccctgaggccaaggacagcagcatgacagtcaccaggactcaccacttcaaggaggggtccctcagagcacctgccatacccctgcacagtgctgcggctgagttggcttcaaaccatccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccggctgccaggggtgcttagcagtggctgcgagttgccagagtctctgcaggccccatcgagggaagaagctgccaagtggagccaggtccggaaagatctgtgctctttgaaggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacaatttggatcaaaaggagaaatgataagtgacaaaagcagcacaaggaatttccctgtgtggatgctgagctgtgatggcgggcactgggtacccaagtgaaggttcccgaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggctaaaaaaaaaaaaaaaaaaaaaaaaaaaaaa

SEQ ID NO: 1486 - DNA, 4335 bp, Homo sapiens
ttcttaaccctttccagctttcccaccctctttggctttagccatggccttctgatctgtgtttctcaggggacctgcaggccccagatatagccccatgctgtcctcctaccccagagcacactgttcaggctacttccactggtactgaaatccagtatttcacttactctttttctttccaatatcctcatgacattcaatatttcacttactctaggtcctccctgcctaaggcccaagtcaactttctgtccagtgggatttgtaatccaatacctcctagccctagcagaatcccatgtggataatcagaaatgtgactggaaaaaggacagagctctatggctgtgggtcccagtccccactgctggcagtaagtccccagcagtgagctgtgtaagcaccttacattctgcgcttggttgaaaacagcaaggcaagcatccacttgagaaatgtcaacccctaggaaatcccagcctcaagtctttctcatcccttgggaagtgcaaattggatagagaagaaaccaattaaaaacaaaacaaacaaatcatacttagatattctggcttttctcaccagggctggattaaagcatgtacttcaaaataataacaacttaagtcaataaataaatgtaaggaagtccaaatgttcacctgaagacaactgtggtcattttttggcaatcccaggttctcttttctacctgtttgctcaatcgtggtctccctctccctctcttgttggggcccatgcccctgctttactgttgccagaggcttgtacttgtttgccttttaggtaggagcagttacttccactcccctcacctgccataaagcatctttataaacaaagcaagtagaagaaacacatcctggtatccaccacattcggcttttgttgattctgttcacttgggagcacctgctgctagggaataagaaggttgaggctgaagagtgaggactcttcagctcccctctggcaggacccgggagaggaaagagccctcagctggtccatcctccccactcctggtcagccttctgttctgagatcaaagtggtggggtcacattctcgagaactgtgctcagccccctcatctcacaccctttccctctccctgtgtgcctgcccccctcttacataaccatgctggtgattggcaccgtcataaatcaatactttgctcactttcacatcaagtaacactatccagggaggtggtttcaacaaaggaggaagtataaggagatctaggttcaaattaatgttgcccctagtggtaaaggacagagaccctcagactgatgaaatgcactcagaattacttagacaaagcggatatttgccactctcttccccttttcctgtgtttttgtagtgaagagacctgaaagaaaaaagtagggagaacataatgagaacaaatacggtaatctcttcatttgctagttcaagtgctggacttgggacttaggaggggcaatggagccgcttagtgcctacatctgacttggactgaaatataggtgagagacaagattgtctcatatccggggaaatcataacctatgactaggacgggaagaggaagcactgcctttacttcagtgggaatctcggcctcagcctgcaagccaagtgttcacagtgagaaaagcaagagaataagctaatactcctgtcctgaacaaggcagcggctccttggtaaagctactccttgatcgatcctttgcaccggattgttcaaagtggaccccaggggagaagtcggagcaaagaacttaccaccaagcagtccaagaggcccagaagcaaacctggaggtgagacccaaagaaagctggaaccatgctgactttgtacactgtgaggacacagagtctgttcctggaaagcccagtgtcaacgcagatgaggaagtcggaggtccccaaatctgccgtgtatgtggggacaaggccactggctatcacttcaatgtcatgacatgtgaaggatgcaagggctttttcaggagggccatgaaacgcaacgcccggctgaggtgccccttccggaagggcgcctgcgagatcacccggaagacccggcgacagtgccaggcctgccgcctgcgcaagtgcctggagagcggcatgaagaaggagatgatcatgtccgacgaggccgtggaggagaggcgggccttgatcaagcggaagaaaagtgaacggacagggactcagccactgggagtgcaggggctgacagaggagcagcggatgatgatcagggagctgatggacgctcagatgaaaacctttgacactaccttctcccatttcaagaatttccgggtctctctgcagctgcggggggaggatggcagtgtctggaactacaaacccccagccgacagtggcgggaaagagatcttctccctgctgccccacatggctgacatgtcaacctacatgttcaaaggcatcatcagctttgccaaagtcatctcctacttcagggacttgcccatcgaggaccagatctccctgctgaagggggccgctttcgagctgtgtcaactgagattcaacacagtgttcaacgcggagactggaacctgggagtgtggccggctgtcctactgcttggaagacactgcaggtggcttccagcaacttctactggagcccatgctgaaattccactacatgctgaagaagctgcagctgcatgaggaggagtatgtgctgatgcaggccatctccctcttctccccagaccgcccaggtgtgctgcagcaccgcgtggtggaccagctgcaggagcaattcgccattactctgaagtcctacattgaatgcaatcggccccagcctgctcataggttcttgttcctgaagatcatggctatgctcaccgagctccgcagcatcaatgctcagcacacccagcggctgctgcgcatccaggacatacacccctttgctacgcccctcatgcaggagttgttcggcatcacaggtagctgagcggctgcccttgggtgacacctccgagaggcagccagacccagagccctctgagccgccactcccgggccaagacagatggacactgccaagagccgacaatgccctgctggcctgtctccctagggaattcctgctatgacagctggctagcattcctcaggaaggacatgggtgccccccacccccagttcagtctgtagggagtgaagccacagactcttacgtggagagtgcactgacctgtaggtcaggaccatcagagaggcaaggttgccctttccttttaaaaggccctgtggtctggggagaaatccctcagatcccactaaagtgtcaaggtgtggaagggaccaagcgaccaaggatgggccatctggggtctatgcccacatacccacgtttgttcgcttcctgagtcttttcattgctacctctaatagtcctgtctcccacttcccactcgttcccctcctcttccgagctgctttgtgggctccaggcctgtactcatcggcaggcgcatgagtatctgtgggagtcctctagagagatgagaagccaggaggcctgcaccaaatgtcagaagcttggcatgacctcattccggccacatcattctgtgtctctgcatccatttgaacacattattaagcaccgataataggtagcctgctgtggggtatacagcattgactcagatatagatcctgagctcacagagtttatagttaaaaaaacaaacagaaacacaaacaatttggatcaaaaggagaaatgataagtgacaaaagcagcacaaggaatttccctgtgtggatgctgagctgtgatggcgggcactgggtacccaagtgaaggttcccgaggacatgagtctgtaggagcaagggcacaaactgcagctgtgagtgcgtgtgtgtgatttggtgtaggtaggtctgtttgccacttgatggggcctgggtttgttcctggggctggaatgctgggtatgctctgtgacaaggctacgctgacaatcagttaaacacaccggagaagaaccatttacatgcaccttatatttctgtgtacacatctattctcaaagctaaagggtatgaaagtgcctgccttgtttatagccacttgtgagtaaaaatttttttgcattttcacaaattatactttatataaggcattccacacctaagaactagttttgggaaatgtagccctgggtttaatgtcaaatcaaggcaaaaggaattaaataatgtacttttggctaaaaaaaaaaaaaaaaaaaaaaaaaaaaaa

SEQ ID NO: 1487 - DNA, 3393 bp, Homo sapiens
cagtgctagcgggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaaaaaaaaaaaaaaaaaaaaa

SEQ ID NO: 1488 - DNA, 3396 bp, Homo sapiens
cagtgctagcgggcgccgagcgggagccgcgcgggagcagcgcagctacggcggcggcagcggcggcgcggttgcgattccgagccgttgagacgcctctgcggcagctggtggcgcaggtggcttgcgtggacgcgggtagaggcgaccggccagcaaccgcagcgtcggcgcccgcggccccggcagcaggcgcgtcgggacgccccgaggcatcctcccccgcccgcgggcccggtagctgggcccgcgtccgccgcccgcatccccgcgccgccgcatctcctcgccgcctcccgggcttcggacccccggtctcgcccccgaaacatgactcgcgatttcaaacctggagacctcatcttcgccaagatgaaaggttatccccattggccagctcgagtagacgaagttcctgatggagctgtaaagccacccacaaacaaactacccattttcttttttggaactcatgagactgcttttttaggaccaaaggatatatttccttactcagaaaataaggaaaagtatggcaaaccaaataaaagaaaaggttttaatgaaggtttatgggagatagataacaatccaaaagtgaaattttcaagtcaacaggcagcaactaaacaatcaaatgcatcatctgatgttgaagttgaagaaaaggaaactagtgtttcaaaggaagataccgaccatgaagaaaaagccagcaatgaggatgtgactaaagcagttgacataactactccaaaagctgccagaagggggagaaagagaaaggcagaaaaacaagtagaaactgaggaggcaggagtagtgacaacagcaacagcatctgttaatctaaaagtgagtcctaaaagaggacgacctgcagctacagaagtcaagattccaaaaccaagaggcagacccaaaatggtaaaacagccctgtccttcagagagtgacatcattactgaagaggacaaaagtaagaaaaaggggcaagaggaaaaacaacctaaaaagcagcctaagaaggatgaagagggccagaaggaagaagataagccaagaaaagagccggataaaaaagaggggaagaaagaagttgaatcaaaaaggaaaaatttagctaaaacaggggttacttcaacctccgattctgaagaagaaggagatgatcaagaaggtgaaaagaagagaaaaggtgggaggaactttcagactgctcacagaaggaatatgctgaaaggccaacatgagaaagaagcagcagatcgaaaacgcaagcaagaggaacaaatggaaactgagcagcagaataaagatgaaggaaagaagccagaagttaagaaagtggagaagaagcgagaaacatcaatggattctcgacttcaaaggatacatgctgagattaaaaattcactcaaaattgataatcttgatgtgaacagatgcattgaggccttggatgaacttgcttcacttcaggtcacaatgcaacaagctcagaaacacacagagatgattactacactgaaaaaaatacggcgattcaaagttagtcaggtaatcatggaaaagtctacaatgttgtataacaagtttaagaacatgttcttggttggtgaaggagattccgtgatcacccaagtgctgaataaatctcttgctgaacaaagacagcatgaggaagcgaataaaaccaaagatcaagggaagaaagggccaaacaaaaagctagagaaggaacaaacagggtcaaagactctaaatggaggatctgatgctcaagatggtaatcagccacaacataacggggagagcaatgaagacagcaaagacaaccatgaagccagcacgaagaaaaagccatccagtgaagagagagagactgaaatatctctgaaggattctacactagataactaggttgacatacctggaatatagagaacacttgagaagtttgtaatggttttcatttgaaatagactgctgaaagttttaaatttttataagcataggtttgatgttgaaaacttgttttgagggagaaaatccctttgttttaaagtaaagtaaacattatcgctaagtgtacttgtgcagtattaacagctacattatacagtaaatgtgggataaaatccatttagaaaatgttaaactgcttttccagacatggttgtagcatattttcaattagtgtgtgtatgttaatgtgtaattgatagtagaacaaagttacatttttaaaactgctacttgtataaaccttgcctcttttcccaaatactgtgggttttgtgcatagtttttacaaaccttggatttaccagactgtcttttcactgtttgtgggttttgtagaagttacacatttttatggtagataaaatgttacttctatacaagtactcactccctttttatcaaaagttaattttaatctcacagtctacattgtgctacattatccagcttctttggaacaatgtgtgctctgtatggttttttttggtatgacaactaattaagcaactgacatggaactgagaattctacaaactataaaacattaatttttgaaggtaatttagttttgtggctgggcattcagtgaagtcttaggacttctttgcagacaactgactgggtatatataggaatgaatctggctttagggttaaatcatttaaggtccttttataggcaggcactagtaactaaaactgaaaactaagtaagtttatttttgaggaatgttgttaaaaatgtctttaggaagtcactaaaacttaattggaagaaaaaatcatgatgcttatacaataaatatgaataaatgttatataaggaaactcacctatttgaaatcatggctatattgtttttattttctagattccaaaaatacaaacactagttgttccagcattgtactttgataagtctgtacattgacgtgtatggactaaatccagggtaaaatcaatgttacaaaatttaagggtatgttaactaaaggatagcatttctaagatattttgaatattagggtcatttggcacttctcagcaagtaggatacttctcatgttttgaaattatatgaatatggaaaaaaatggcttaagaccagcgtctctgtatgacattgtgtggttgaccctctgagataactgttttcatctacagaattgcatttttgcttttaaagaggtcttataatggaactaggaatcaccgttttgagagaacctgcatatataccagtcattatctgtttggtccttatacagttttaacttacttagatttattctagttaagccataagttcaacgtgtaaacttgttttcattaaagaatttttctatcaaaaaaaaaaaaaaaaaaaaaa

SEQ ID NO: 1489 - DNA, 2740 bp, Homo sapiens
ccccagtgctagctgccgaagcacccagataagagctggacggaggctaaagcggcagccccagcttcgcgccccgcccagtccctttcccctgctggggatcccccctcttccccgcccaccccttacccgcatgcagcccagcgccctatgctagccctccccctccccccctgctggagcggggcgccgccgggggaggagggggaatcggctgcgggtccttggtgtttccagcacccagtttcccttcaagccgggtcgcgatgtacgactgtatggaaacgtttgccccgggtccgcgacggctgtacggggcggccgggcccggggccggcttgctgcgcagagccaccggcggctcctgtttcgccggacttgaatcttttgcctggccgcaacccgccagcctgcaatcggtggagacacagagcaccagctcagaggagatggtgcccagctcgccctcgccccctccgcctcctcgggtctacaagccatgcttcgtgtgcaatgacaagtcctctggctaccactatggggtcagctcttgtgaaggctgcaagggcttctttcgccgaagcatccagaagaacatggtgtacacgtgtcaccgcgacaaaaactgtatcatcaacaaggtgaccaggaatcgctgccagtactgccggctacagaagtgcttcgaagtgggcatgtccaaggaagctgtgcgaaatgaccggaacaagaagaagaaagaggtgaaggaagaagggtcacctgacagctatgagctgagccctcagttagaagagctcatcaccaaggtcagcaaagcccatcaggagactttcccctcgctctgccagctgggcaagtataccacgaactccagtgcagaccaccgcgtgcagctggatctggggctgtgggacaagttcagtgagctggctaccaagtgcatcatcaagatcgtggagtttgccaagcggttgcctggctttacagggctcagcattgctgaccagatcactctgctcaaagctgcctgcctagatatcctgatgctgcgtatctgcacaaggtacaccccagagcaggacaccatgaccttctccgacgggctgaccctgaaccggacccagatgcacaatgccggcttcgggcccctcacagaccttgtctttgcctttgctgggcagctcctgcccctggagatggatgacaccgagacagggctgctcagcgccatctgcctcatctgcggagaccgcatggacctggaggagcccgaaaaagtggacaagctgcaggagccactgctggaagccctgaggctgtacgcccggcgccggcggcccagccagccctacatgttcccaaggatgctaatgaaaatcaccgacctccggggcatcagcactaagggagctgaaagggccattactctgaagatggagattccaggcccgatgcctcccttaatccgagagatgctggagaaccctgaaatgtttgaggatgactcctcgcagcctggtccccaccccaatgcctctagcgaggatgaggttcctgggggccagggcaaagggggcctgaagtccccagcctgaccagggcccctgacctccccgctgtgggggttggggcttcaggcagcagactgaccatctcccagaccgccagtgactgggggaggacctgctctgccctctccccaccccttccaatgagctccttgtttttgccaaagtttctaggggtgcctctgtgttcatccccttcctgatctaaccggctccctcgccagtcccgggggcctgccctgctcccaccaggagagagggcaaagggatgagcctgggtttggactctaaaatctcagcactgccccatgggtcctagacttcccagggcaagaggaagaccctgccattccacagccccttcctctgccaggtgcttggctctctgagagcaaacaggaacactagagaccaaaaaggggacaaaggagaagggctgagcccaccttcttgctcctacccttggtgcctaatgctgtgtgatgcacctgcagggtgtgtgctagcctctgtgccccgtccttgtgccaggtcaaggtgggggcaggctgggccctgcatttctggggcaggaacagagggtgaaagggacagatagatgcaggtccattctgcacctcttggctcgggtgcagagttcaccctgtgccctccgttataagtccctcccccagccctgtcatgtgccttgggctcctcctgccctccatctcagccattggggcagggaccctcctacactacagaggggccaggggatccctctctccctagtgccttccaccctttactccccagagcagcttggcccagggaggggggatgctgcttagctgatcccgccctgacccagaggaagcctctatttatttattagcttttgtttacaccgtggaattgaccccttcctccaggggtcttgggtgggggagcccagggcccctgtgacccctcctttcttcctccaatccccagtttgtatttagctgccaaataagattcccattggctccctgtgttctcttggggggtcagggtgctgtcccctcccctctgtttacatctcccctctaccccgctgtatcgcatattgctgagttttctatttttgcaaaataaagtgatggaaactcaaaaaaaaaaaaaaaaaaaaaaaaaaaaaaaaaaaa

SEQ ID NO: 1490 - DNA, 10998 bp, Homo sapiens
gattcacagggcctctgagcattatcccccatactcctccccatcattctccacccagctgttggagccatctgtctgatcaccttggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaagggatgaactttttgggattctccaaatactccatcagtgtatcctgtcttcaggtgatgcttttgttcttactggcgtctgttgttcctggaggcagaatggcaagccaccatattcacaaaaggaagataaggaagtacaaactggatacatgaatgctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctcatgcatatgatttccattatgcctacagatatggaccctttttctgtcttgacttcttgatcattgacctctgtttacaacaggaggagggtactaaagtcggaggatttccttttcttgtagctcactgcccacagactttctacagagtcaccaatctgtcagtaacaacagagagtccagcaataatcggtgactggtgtgcatagcggaggttgcggcattactttgcacaactagctctttgtttcatgaaggaagtttttattttttcaccgattattgccagtccgcaggatggcatgaaaagggtccatagcagtagcaacaatagcattataatatattacagggtaaatgggcatgaagactatatatagctaaaagagatattgtttatatattgttttaagtaatataaaatgtagttactggtgtagcttttcctgttgaattgataaggcactttcattttgcacctttttctttaaattaaatgctagcgtgttcactgtcgtgtcgcatgtgcaccagaaacacaagtttaactgagaaggcttggaaggtacgttgggaggtatttatgctgctgtttacaaaattatttttaagagactggctggtcatatctagaaatcaccacgttggattttttttttaacatgtgaatttggaattagaaacggaactctccctaaattatactttgctttttggtaagtttaatgatagatgtgtttatgcttcatacaaagttgaatgattgattggcgtggtggacatataccatcatgctcattttttttttttaaagctttttaaaatgccacctcatggaggcgagggggaggagaagctcattttacacaattcagtagttaaatatggactcggtctcaacttggaattcttatgctttgagaacaaatcaacaaccagaatatttattggaatctagcttttattataagaaggacccaaagattatatcctgagcaaatgcacactccccatgtgaggacatgaagtatttactttgtgaatgtttatgttcttggtataatctaggaaccctatgagtttatctcagagtgaactaattctagatttgttgtcaatagatgctataattcaagaatgttgctctccatatttgaaaaacgatggataggagggtgagggaagcatacaatgttgaaccagtttctcttatttaaatattaaatactttaagcctttaaagtgaagttgatgctagctgcaaacatttactcttgtatttatcttcactaggaaactgtggactgtaatttattttattaaatatttagaagattatttggcttgtgtgttcaggtgagaaatactgagttgtttttgtttaatttcatggtttttttttttttaatgatccctagtgggggaaggggaaaggaatagtctgataaacagatgtgcatattttaaaaacaagtgaccttttgggaatgtaggcatttagacgatgattttagtcgcactaggggtgggattcaaactactggtcaaagaccattttgtacagaaaagggaacatctccgatgggtgttaaggtaggagtttccatgcagccctttatgtctgagaaatagtctcctctgccattggggtccctgcggaatcttctacaggaattgcagctcttcacgtcatgctaggttaccagcatgggcttcccagagcacttcactctgtttctaactccactgacttttctgacttgtttcttgagggacttggaaaaggggaaggtattattcacacagatgtgtgtatgaagcctaaataacatccaactttttttccaaaaacatagtaagagtttaaccataaatagaagagtaatattcctttaaatttcttacaggcatgtaaaattttatgtgtttatagagagatgctaactgtcagcatatagtatttatattggggcaagaagggttaaatcaaatctttaatttaagtaagcatagttcctttaaagatcagtagtatttatactctgaaaagagtaccaagcttagttcagttatttattcatccattttttttctattgtttctcctctggggggaaatggtgttttgtttttgtttgagttttgtgttttagttttttggttttggttttgttttgtttttttgtcattcagattcactaaatttggggatggttttattaaagtatattaacttctttttaaccaaagctttctgaatatgaccagcctcaggtgctagcgcattaaagagcaactaaacctaattccagtgtcgatttgtgaaataataaaagctaattgaatttctctaagggtgagagagaacataatgatgaacttaaaaagaaattccttttcccagaagggattctgcatgtacctacaaacaatcatgctctaaccacagtaatagtcatgccatggtgacattgcttttacggtaaaccaagataggtaatatgatgcttcttcccaggtgtttctgaaagaaaagcagcggtggagcttaagagccaagtccactgattgacataataggatggaattgtagacagagacatgctccatgaaacaaggaaacaactgactactatttggatctaagttgggatctgatgttaaacaataaattcagtttaaaaaaaatatggagctcagaaaaggatgtgaaaaactttgcattttcctttcttcattattacaaaaacacctatgtgatgacataaaatacttgggtgatatcagaacaattatccttaatagtttttataattaaagtttcctaaacttcagtctccaatagtcttttaaggattggaaccacatcactgtcagccccgctgctacaatgcctttgtacaatttttttacataaggcaaataaggcttttgtacaaagcctgaataccttctgttccaatggtgtccaaatggttattatattgtgaaaaacctggccttggtcacaatgcaaacaaaagtacagatgaaagtgctttttggacagtttgcaaattgtgttaaagctacggattttttttaaagtgttcagcatcttaacgtgtattaaagctatggatttttttttaaagtcttcagcatcctaattcaccctttctaacttaagaaaaacatgacttaagacactgcttctaagtttggttgttctttatagtgtggatacccagttatctgtgagcgtatgggggtgggctgagggtcaggtgaggaaggagtgtgtgtgtgtgtgtgtgtgtgtgtgtgtgtgtgtgtgatttgcatgtgtatgatgtgtgtgcgtcggaccgcttctaggctactaagtgtcaatggaaaagaaaatgtattcaaaatacttaaatcaaaactagaagatggggaaaaaaagatttattctatacaaagccttgtctggaccactttagagagacttctatttttttaacccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacagttctttgtgctgactggtgaaaaacaagggtaaataagcaccttataattgacttactgtgaatgacaatccatcttggtatcaacgatagaagccctatcattttggagttggggttaagagtcagaaacaatgtgctcagggatctcctaaaactcttaaaacagggtggccagtactactgggacaaattgtgttttttattattaataataatgataataatactatccctccaaggcacaagtgaactatatagaactgcgtgtgtgtaaactctttactctcgtctcattttgttgagtttagaacttgatgtgctcgtcagtcttgtgtttcaaaacactgaataacttccaaagcaaagttatgccagtgtgttcaaaagataaattaataatgtaccagcaaagagcatcattcaaagtatagtccttgcatattccagttaccatttctctaataattaaaatattcatgataaatatatatatagcatcatatgttaaaaactatttcaaattctacatattaaggatgaaaattttaaaatccagtaataagaggagagacctgcctatcagtacagtgatataggtaaaagatgaaatatgtttttaaaataccagcaattaactattgttttcatgggttctcctctagaagcaaaccaaaaattccttcatggaaaacaattcttacttctacatgtgtagtttatatctgatgcattacaagagctaatgtttaaagacaaaacaaaacctgcctgtatgacagcagcaactcgagccaacatttagtgttacatgttatatttttgaaataccgttttgttatcatattccacatattactttccataaagtcagagaagttcaatgtaattgttggctctgattcttccaccttgggatacacattcacaagaagatttatatattttcttactatgatagaggaacataatctgggaaaacttcccatgtctgtaagatgaaaaggatacctttaccatgttgtttttgataataaagaatatggaaaatggtagaaatctctcctctctatgtgtatttgtatatgtgtgtatacacacacacgttgacatttttacataacatgtgattgccacttcttataaagttatgatatagaaccccatgaaaacaactttatattatagatcaaataatgtgcccagaaacgcaattgcaacagtaaatcttgatctattggtaagagtctatgatacaggtcttcattctatccctaaacataatgttagtaaagaggttccatcagattgtattatagagaccttcctattgctatttatttttaagagatgagaagactgactagcaatgtctccacagtgcaattggtttcacttctgggtctgtctgtctgtttgtgtaggtgagatcagtgttgtcaggctctcagaataatttttaaaagaatccagaagcctgacttcacaccaagtagccatcctagatgggcgggggggatctccatgttcaaccaaaccctcagaacttagagcaataaatacattcagtcatttatttataaatgaatgacagaatattcaatccaaatagaaacaaccttttgtcagtgatgcaacataacatggagtcttatattgagaaagtgaatatgaatattttaaatagatgcctaggaaatctgtgtttgctgtttacatttaatgtactttgccacattagcagtaccacacttcttttactttcatccttctaagaactaatgaaagatagcttgctattagctttgacatgttgcacatgccattatgttgttctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatgatttcacaaaaaaaatccatatgtactgtatacatcttcctgaatccaaaattctcctgttatccacacagtttgaaatctcatattaaacagtggtaaatttttaaacattaggacattagctggctgcttctataaatgtacctgtattgtctgcctgctccttttgtggagatgtgtttttgtattggatgtttgggccaatgggaggcttcaagctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaataatctagccataactgaatgtcaagcaataaaacaaatgacttttgtgcatagacttaaaaaatacaaattttagacatctgcatgtaaatgcaatctcttgtttactgctttcttcaacttgagcaatcgattccttatttactattaacttaagaacttgtaacggcctgtaaacattttctctcttactcttctttcaaatttacctgtccctgcttttgagtcataatatttaatgttgttctgcacatctctatacagttaactttttggctttcattctgtatagataagaaaatgttatattataaacagcctactcagtgcaaatatttatctgtttatcaaatccacaatatgctgtataataccggttttactatataatctattttagacatagctgtttagaactagagtgtgctatttttgtgtttttctgatgtgtggtgctagacaagttacttttgtgaacaacaaaaattatcccttttattcctagacaataccacctttgggtcttgttaatttcactgagtataactatatatttgtatatatatacatatatatatatatctacctatgcccaactggcagctgtatcagagtgctggatttgggacatgcttttctctttaaatacataatatcattatataaattattctagagtgtatttaattaggataaaattacttccttagtatggatatttgacatctatagggtgaatttgtttataaatatggctatatggaaacttattagcatttactttatgtttgctacttggctttacagcatatctcctaagctgaaaaataatttgccaggccttcaagatcctaaagaaacttgtttaatggagtaatatacttttttttcttattaaggaattgtattactggcacctaacacagttgtattcttagctcctattatagataatgggcatttacataaaatatcctagatggcttgatggcagaataaacctttcccctcctacctgagtcatgagaaggatggagacgtcctctgccataacatgggccataaagcaaattcgacatgggatgttctgtttcagtatgacctcaaccagttccatgaactgagtgaaggaccttcattttcaaagttatttaataagtagcttaattaagcctttctacccattctcccaagatctactggcattattgaaaagcaaagtttatcaaatatctaactaaggatgtagttaaccttattaaatattgattagaattgttctgtaatattactgaatttgtaagatctttagcaaagatttttgagcaatttataaatgtagagcaaatgtttctgtttactgcactttttgtaactgaaggtgataaattctcaagccatgattattggcttccatgcactgcaatatttatccacaattctagacattttccatttttgtggaagagttgctgttaccttaattataaatgcaattgtgtggttaatgagagctaatgctagtagttaaccttttaaagtggattggctacagttgagggagaaatctcttttaatataaatcacatcattccttaactgcctctcttggaaagagattgaaaccttttttttaaagcacgatttagcatcctaagcttcctgagggtagagattgtatctttttgcgtctgcacaatggctagcacatgtcagcatttgacaattgttaaatgataacaagtgtgccccaattaaaacgtttttcctgggttgttttgttaaatttacaaagtaagccaagccttacggttaacattctcctctacaaccaagtattaaagccacatttaaaaagaccacatgaaatgctgattctaattgtgtgtaggtcttgaggattaagcacacaaatttcacaaacttctgtttgagtaaacaaactcagccttctgtaaatatacatgcaagtttggaaacagtaatactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccagctgtttattttattgagtcctgaatttaaaaaaaaaatattttgattcattttgtaaatacaagctgtacaaaaaagagagatttaatgttgtcttttaaatactccaattttcattctaatatgaatgttgttatattgtacttagaaactgtacctttaatattacattacctttattaaaagtgcattgaacacatcaattttagatgtgctttatgtactgttatcctataataaaacttcagcttctaatggaa

SEQ ID NO: 1491 - DNA, 10974 bp, Homo sapiens
gattcacagggcctctgagcattatcccccatactcctccccatcattctccacccagctgttggagccatctgtctgatcaccttggactccatagtacactggggcaaagcacagccccagtttctggaggcagatgggtaaccaggaaaaggcatgaatgagggggccccaggagacagtgacttagagactgaggcaagagtgccgtggtcaatcatgggtcattgtcttcgaactggacaggccagaatgtctgccacacccacacctgcaggtgaaggagccagaagctcttcaacctgtagctccctgagcaggctgttctggtctcaacttgagcacataaactgggatggagccacagccaagaactttattaatttaagggagttcttctcttttctgctccctgcattgagaaaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctcatgcatatgatttccattatgcctacagatatggaccctttttctgtcttgacttcttgatcattgacctctgtttacaacaggaggagggtactaaagtcggaggatttccttttcttgtagctcactgcccacagactttctacagagtcaccaatctgtcagtaacaacagagagtccagcaataatcggtgactggtgtgcatagcggaggttgcggcattactttgcacaactagctctttgtttcatgaaggaagtttttattttttcaccgattattgccagtccgcaggatggcatgaaaagggtccatagcagtagcaacaatagcattataatatattacagggtaaatgggcatgaagactatatatagctaaaagagatattgtttatatattgttttaagtaatataaaatgtagttactggtgtagcttttcctgttgaattgataaggcactttcattttgcacctttttctttaaattaaatgctagcgtgttcactgtcgtgtcgcatgtgcaccagaaacacaagtttaactgagaaggcttggaaggtacgttgggaggtatttatgctgctgtttacaaaattatttttaagagactggctggtcatatctagaaatcaccacgttggattttttttttaacatgtgaatttggaattagaaacggaactctccctaaattatactttgctttttggtaagtttaatgatagatgtgtttatgcttcatacaaagttgaatgattgattggcgtggtggacatataccatcatgctcattttttttttttaaagctttttaaaatgccacctcatggaggcgagggggaggagaagctcattttacacaattcagtagttaaatatggactcggtctcaacttggaattcttatgctttgagaacaaatcaacaaccagaatatttattggaatctagcttttattataagaaggacccaaagattatatcctgagcaaatgcacactccccatgtgaggacatgaagtatttactttgtgaatgtttatgttcttggtataatctaggaaccctatgagtttatctcagagtgaactaattctagatttgttgtcaatagatgctataattcaagaatgttgctctccatatttgaaaaacgatggataggagggtgagggaagcatacaatgttgaaccagtttctcttatttaaatattaaatactttaagcctttaaagtgaagttgatgctagctgcaaacatttactcttgtatttatcttcactaggaaactgtggactgtaatttattttattaaatatttagaagattatttggcttgtgtgttcaggtgagaaatactgagttgtttttgtttaatttcatggtttttttttttttaatgatccctagtgggggaaggggaaaggaatagtctgataaacagatgtgcatattttaaaaacaagtgaccttttgggaatgtaggcatttagacgatgattttagtcgcactaggggtgggattcaaactactggtcaaagaccattttgtacagaaaagggaacatctccgatgggtgttaaggtaggagtttccatgcagccctttatgtctgagaaatagtctcctctgccattggggtccctgcggaatcttctacaggaattgcagctcttcacgtcatgctaggttaccagcatgggcttcccagagcacttcactctgtttctaactccactgacttttctgacttgtttcttgagggacttggaaaaggggaaggtattattcacacagatgtgtgtatgaagcctaaataacatccaactttttttccaaaaacatagtaagagtttaaccataaatagaagagtaatattcctttaaatttcttacaggcatgtaaaattttatgtgtttatagagagatgctaactgtcagcatatagtatttatattggggcaagaagggttaaatcaaatctttaatttaagtaagcatagttcctttaaagatcagtagtatttatactctgaaaagagtaccaagcttagttcagttatttattcatccattttttttctattgtttctcctctggggggaaatggtgttttgtttttgtttgagttttgtgttttagttttttggttttggttttgttttgtttttttgtcattcagattcactaaatttggggatggttttattaaagtatattaacttctttttaaccaaagctttctgaatatgaccagcctcaggtgctagcgcattaaagagcaactaaacctaattccagtgtcgatttgtgaaataataaaagctaattgaatttctctaagggtgagagagaacataatgatgaacttaaaaagaaattccttttcccagaagggattctgcatgtacctacaaacaatcatgctctaaccacagtaatagtcatgccatggtgacattgcttttacggtaaaccaagataggtaatatgatgcttcttcccaggtgtttctgaaagaaaagcagcggtggagcttaagagccaagtccactgattgacataataggatggaattgtagacagagacatgctccatgaaacaaggaaacaactgactactatttggatctaagttgggatctgatgttaaacaataaattcagtttaaaaaaaatatggagctcagaaaaggatgtgaaaaactttgcattttcctttcttcattattacaaaaacacctatgtgatgacataaaatacttgggtgatatcagaacaattatccttaatagtttttataattaaagtttcctaaacttcagtctccaatagtcttttaaggattggaaccacatcactgtcagccccgctgctacaatgcctttgtacaatttttttacataaggcaaataaggcttttgtacaaagcctgaataccttctgttccaatggtgtccaaatggttattatattgtgaaaaacctggccttggtcacaatgcaaacaaaagtacagatgaaagtgctttttggacagtttgcaaattgtgttaaagctacggattttttttaaagtgttcagcatcttaacgtgtattaaagctatggatttttttttaaagtcttcagcatcctaattcaccctttctaacttaagaaaaacatgacttaagacactgcttctaagtttggttgttctttatagtgtggatacccagttatctgtgagcgtatgggggtgggctgagggtcaggtgaggaaggagtgtgtgtgtgtgtgtgtgtgtgtgtgtgtgtgtgtgtgatttgcatgtgtatgatgtgtgtgcgtcggaccgcttctaggctactaagtgtcaatggaaaagaaaatgtattcaaaatacttaaatcaaaactagaagatggggaaaaaaagatttattctatacaaagccttgtctggaccactttagagagacttctatttttttaacccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacagttctttgtgctgactggtgaaaaacaagggtaaataagcaccttataattgacttactgtgaatgacaatccatcttggtatcaacgatagaagccctatcattttggagttggggttaagagtcagaaacaatgtgctcagggatctcctaaaactcttaaaacagggtggccagtactactgggacaaattgtgttttttattattaataataatgataataatactatccctccaaggcacaagtgaactatatagaactgcgtgtgtgtaaactctttactctcgtctcattttgttgagtttagaacttgatgtgctcgtcagtcttgtgtttcaaaacactgaataacttccaaagcaaagttatgccagtgtgttcaaaagataaattaataatgtaccagcaaagagcatcattcaaagtatagtccttgcatattccagttaccatttctctaataattaaaatattcatgataaatatatatatagcatcatatgttaaaaactatttcaaattctacatattaaggatgaaaattttaaaatccagtaataagaggagagacctgcctatcagtacagtgatataggtaaaagatgaaatatgtttttaaaataccagcaattaactattgttttcatgggttctcctctagaagcaaaccaaaaattccttcatggaaaacaattcttacttctacatgtgtagtttatatctgatgcattacaagagctaatgtttaaagacaaaacaaaacctgcctgtatgacagcagcaactcgagccaacatttagtgttacatgttatatttttgaaataccgttttgttatcatattccacatattactttccataaagtcagagaagttcaatgtaattgttggctctgattcttccaccttgggatacacattcacaagaagatttatatattttcttactatgatagaggaacataatctgggaaaacttcccatgtctgtaagatgaaaaggatacctttaccatgttgtttttgataataaagaatatggaaaatggtagaaatctctcctctctatgtgtatttgtatatgtgtgtatacacacacacgttgacatttttacataacatgtgattgccacttcttataaagttatgatatagaaccccatgaaaacaactttatattatagatcaaataatgtgcccagaaacgcaattgcaacagtaaatcttgatctattggtaagagtctatgatacaggtcttcattctatccctaaacataatgttagtaaagaggttccatcagattgtattatagagaccttcctattgctatttatttttaagagatgagaagactgactagcaatgtctccacagtgcaattggtttcacttctgggtctgtctgtctgtttgtgtaggtgagatcagtgttgtcaggctctcagaataatttttaaaagaatccagaagcctgacttcacaccaagtagccatcctagatgggcgggggggatctccatgttcaaccaaaccctcagaacttagagcaataaatacattcagtcatttatttataaatgaatgacagaatattcaatccaaatagaaacaaccttttgtcagtgatgcaacataacatggagtcttatattgagaaagtgaatatgaatattttaaatagatgcctaggaaatctgtgtttgctgtttacatttaatgtactttgccacattagcagtaccacacttcttttactttcatccttctaagaactaatgaaagatagcttgctattagctttgacatgttgcacatgccattatgttgttctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatgatttcacaaaaaaaatccatatgtactgtatacatcttcctgaatccaaaattctcctgttatccacacagtttgaaatctcatattaaacagtggtaaatttttaaacattaggacattagctggctgcttctataaatgtacctgtattgtctgcctgctccttttgtggagatgtgtttttgtattggatgtttgggccaatgggaggcttcaagctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaataatctagccataactgaatgtcaagcaataaaacaaatgacttttgtgcatagacttaaaaaatacaaattttagacatctgcatgtaaatgcaatctcttgtttactgctttcttcaacttgagcaatcgattccttatttactattaacttaagaacttgtaacggcctgtaaacattttctctcttactcttctttcaaatttacctgtccctgcttttgagtcataatatttaatgttgttctgcacatctctatacagttaactttttggctttcattctgtatagataagaaaatgttatattataaacagcctactcagtgcaaatatttatctgtttatcaaatccacaatatgctgtataataccggttttactatataatctattttagacatagctgtttagaactagagtgtgctatttttgtgtttttctgatgtgtggtgctagacaagttacttttgtgaacaacaaaaattatcccttttattcctagacaataccacctttgggtcttgttaatttcactgagtataactatatatttgtatatatatacatatatatatatatctacctatgcccaactggcagctgtatcagagtgctggatttgggacatgcttttctctttaaatacataatatcattatataaattattctagagtgtatttaattaggataaaattacttccttagtatggatatttgacatctatagggtgaatttgtttataaatatggctatatggaaacttattagcatttactttatgtttgctacttggctttacagcatatctcctaagctgaaaaataatttgccaggccttcaagatcctaaagaaacttgtttaatggagtaatatacttttttttcttattaaggaattgtattactggcacctaacacagttgtattcttagctcctattatagataatgggcatttacataaaatatcctagatggcttgatggcagaataaacctttcccctcctacctgagtcatgagaaggatggagacgtcctctgccataacatgggccataaagcaaattcgacatgggatgttctgtttcagtatgacctcaaccagttccatgaactgagtgaaggaccttcattttcaaagttatttaataagtagcttaattaagcctttctacccattctcccaagatctactggcattattgaaaagcaaagtttatcaaatatctaactaaggatgtagttaaccttattaaatattgattagaattgttctgtaatattactgaatttgtaagatctttagcaaagatttttgagcaatttataaatgtagagcaaatgtttctgtttactgcactttttgtaactgaaggtgataaattctcaagccatgattattggcttccatgcactgcaatatttatccacaattctagacattttccatttttgtggaagagttgctgttaccttaattataaatgcaattgtgtggttaatgagagctaatgctagtagttaaccttttaaagtggattggctacagttgagggagaaatctcttttaatataaatcacatcattccttaactgcctctcttggaaagagattgaaaccttttttttaaagcacgatttagcatcctaagcttcctgagggtagagattgtatctttttgcgtctgcacaatggctagcacatgtcagcatttgacaattgttaaatgataacaagtgtgccccaattaaaacgtttttcctgggttgttttgttaaatttacaaagtaagccaagccttacggttaacattctcctctacaaccaagtattaaagccacatttaaaaagaccacatgaaatgctgattctaattgtgtgtaggtcttgaggattaagcacacaaatttcacaaacttctgtttgagtaaacaaactcagccttctgtaaatatacatgcaagtttggaaacagtaatactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccagctgtttattttattgagtcctgaatttaaaaaaaaaatattttgattcattttgtaaatacaagctgtacaaaaaagagagatttaatgttgtcttttaaatactccaattttcattctaatatgaatgttgttatattgtacttagaaactgtacctttaatattacattacctttattaaaagtgcattgaacacatcaattttagatgtgctttatgtactgttatcctataataaaacttcagcttctaatggaa

SEQ ID NO: 1492 - DNA, 10669 bp, Homo sapiens
tgtggctcgggcggcggcggcgcggcggcggcagagggggctccggggtcggaccatccgctctccctgcgctctccgcaccgcggcttaaatgatgtattttgtgatcgcagcgatgaaagctcaaattgaaattattccatgcaagatctgtggagacaaatcatcaggaatccattatggtgtcattacatgtgaaggctgcaagggctttttcaggagaagtcagcaaagcaatgccacctactcctgtcctcgtcagaagaactgtttgattgatcgaaccagtagaaaccgctgccaacactgtcgattacagaaatgccttgccgtagggatgtctcgagatgctgtaaaatttggccgaatgtcaaaaaagcagagagacagcttgtatgcagaagtacagaaacaccggatgcagcagcagcagcgcgaccaccagcagcagcctggagaggctgagccgctgacgcccacctacaacatctcggccaacgggctgacggaacttcacgacgacctcagtaactacattgacgggcacacccctgaggggagtaaggcagactccgccgtcagcagcttctacctggacatacagccttccccagaccagtcaggtcttgatatcaatggaatcaaaccagaaccaatatgtgactacacaccagcatcaggcttctttccctactgttcgttcaccaacggcgagacttccccaactgtgtccatggcagaattagaacaccttgcacagaatatatctaaatcgcatctggaaacctgccaatacttgagagaagagctccagcagataacgtggcagacctttttacaggaagaaattgagaactatcaaaacaagcagcgggaggtgatgtggcaattgtgtgccatcaaaattacagaagctatacagtatgtggtggagtttgccaaacgcattgatggatttatggaactgtgtcaaaatgatcaaattgtgcttctaaaagcaggttctctagaggtggtgtttatcagaatgtgccgtgcctttgactctcagaacaacaccgtgtactttgatgggaagtatgccagccccgacgtcttcaaatccttaggttgtgaagactttattagctttgtgtttgaatttggaaagagtttatgttctatgcacctgactgaagatgaaattgcattattttctgcatttgtactgatgtcagcagatcgctcatggctgcaagaaaaggtaaaaattgaaaaactgcaacagaaaattcagctagctcttcaacacgtcctacagaagaatcaccgagaagatggaatactaacaaagttaatatgcaaggtgtctacattaagagccttatgtggacgacatacagaaaagctaatggcatttaaagcaatatacccagacattgtgcgacttcattttcctccattatacaaggagttgttcacttcagaatttgagccagcaatgcaaattgatgggtaaatgttatcacctaagcacttctagaatgtctgaagtacaaacatgaaaaacaaacaaaaaaattaaccgagacactttatatggccctgcacagacctggagcgccacacactgcacatcttttggtgatcggggtcaggcaaaggaggggaaacaatgaaaacaaataaaagttgaacttgtttttctcatgcatatgatttccattatgcctacagatatggaccctttttctgtcttgacttcttgatcattgacctctgtttacaacaggaggagggtactaaagtcggaggatttccttttcttgtagctcactgcccacagactttctacagagtcaccaatctgtcagtaacaacagagagtccagcaataatcggtgactggtgtgcatagcggaggttgcggcattactttgcacaactagctctttgtttcatgaaggaagtttttattttttcaccgattattgccagtccgcaggatggcatgaaaagggtccatagcagtagcaacaatagcattataatatattacagggtaaatgggcatgaagactatatatagctaaaagagatattgtttatatattgttttaagtaatataaaatgtagttactggtgtagcttttcctgttgaattgataaggcactttcattttgcacctttttctttaaattaaatgctagcgtgttcactgtcgtgtcgcatgtgcaccagaaacacaagtttaactgagaaggcttggaaggtacgttgggaggtatttatgctgctgtttacaaaattatttttaagagactggctggtcatatctagaaatcaccacgttggattttttttttaacatgtgaatttggaattagaaacggaactctccctaaattatactttgctttttggtaagtttaatgatagatgtgtttatgcttcatacaaagttgaatgattgattggcgtggtggacatataccatcatgctcattttttttttttaaagctttttaaaatgccacctcatggaggcgagggggaggagaagctcattttacacaattcagtagttaaatatggactcggtctcaacttggaattcttatgctttgagaacaaatcaacaaccagaatatttattggaatctagcttttattataagaaggacccaaagattatatcctgagcaaatgcacactccccatgtgaggacatgaagtatttactttgtgaatgtttatgttcttggtataatctaggaaccctatgagtttatctcagagtgaactaattctagatttgttgtcaatagatgctataattcaagaatgttgctctccatatttgaaaaacgatggataggagggtgagggaagcatacaatgttgaaccagtttctcttatttaaatattaaatactttaagcctttaaagtgaagttgatgctagctgcaaacatttactcttgtatttatcttcactaggaaactgtggactgtaatttattttattaaatatttagaagattatttggcttgtgtgttcaggtgagaaatactgagttgtttttgtttaatttcatggtttttttttttttaatgatccctagtgggggaaggggaaaggaatagtctgataaacagatgtgcatattttaaaaacaagtgaccttttgggaatgtaggcatttagacgatgattttagtcgcactaggggtgggattcaaactactggtcaaagaccattttgtacagaaaagggaacatctccgatgggtgttaaggtaggagtttccatgcagccctttatgtctgagaaatagtctcctctgccattggggtccctgcggaatcttctacaggaattgcagctcttcacgtcatgctaggttaccagcatgggcttcccagagcacttcactctgtttctaactccactgacttttctgacttgtttcttgagggacttggaaaaggggaaggtattattcacacagatgtgtgtatgaagcctaaataacatccaactttttttccaaaaacatagtaagagtttaaccataaatagaagagtaatattcctttaaatttcttacaggcatgtaaaattttatgtgtttatagagagatgctaactgtcagcatatagtatttatattggggcaagaagggttaaatcaaatctttaatttaagtaagcatagttcctttaaagatcagtagtatttatactctgaaaagagtaccaagcttagttcagttatttattcatccattttttttctattgtttctcctctggggggaaatggtgttttgtttttgtttgagttttgtgttttagttttttggttttggttttgttttgtttttttgtcattcagattcactaaatttggggatggttttattaaagtatattaacttctttttaaccaaagctttctgaatatgaccagcctcaggtgctagcgcattaaagagcaactaaacctaattccagtgtcgatttgtgaaataataaaagctaattgaatttctctaagggtgagagagaacataatgatgaacttaaaaagaaattccttttcccagaagggattctgcatgtacctacaaacaatcatgctctaaccacagtaatagtcatgccatggtgacattgcttttacggtaaaccaagataggtaatatgatgcttcttcccaggtgtttctgaaagaaaagcagcggtggagcttaagagccaagtccactgattgacataataggatggaattgtagacagagacatgctccatgaaacaaggaaacaactgactactatttggatctaagttgggatctgatgttaaacaataaattcagtttaaaaaaaatatggagctcagaaaaggatgtgaaaaactttgcattttcctttcttcattattacaaaaacacctatgtgatgacataaaatacttgggtgatatcagaacaattatccttaatagtttttataattaaagtttcctaaacttcagtctccaatagtcttttaaggattggaaccacatcactgtcagccccgctgctacaatgcctttgtacaatttttttacataaggcaaataaggcttttgtacaaagcctgaataccttctgttccaatggtgtccaaatggttattatattgtgaaaaacctggccttggtcacaatgcaaacaaaagtacagatgaaagtgctttttggacagtttgcaaattgtgttaaagctacggattttttttaaagtgttcagcatcttaacgtgtattaaagctatggatttttttttaaagtcttcagcatcctaattcaccctttctaacttaagaaaaacatgacttaagacactgcttctaagtttggttgttctttatagtgtggatacccagttatctgtgagcgtatgggggtgggctgagggtcaggtgaggaaggagtgtgtgtgtgtgtgtgtgtgtgtgtgtgtgtgtgtgtgatttgcatgtgtatgatgtgtgtgcgtcggaccgcttctaggctactaagtgtcaatggaaaagaaaatgtattcaaaatacttaaatcaaaactagaagatggggaaaaaaagatttattctatacaaagccttgtctggaccactttagagagacttctatttttttaacccttctataaatatttgatggcacttgaaatattcctgcaataaaatgtgatttgtgtaaagaaaaaaagattttgtaatgtgaaacaaagaaagaaagtaatgtaattttctaaaaaaaaaaatacaaacaaacaaactttgtattattttcttgatggaatttgtctatctgtctttggaaaactttttatttcattgaatgtgccatagtagaaatgtgtgtttttagttttagactaaggaatagctagttgttgtgttccgacattccaaaatgcaaaacaacctagtagtatctttcatgaaaaggtttaagtagtatgtaagcttctctcattgttgcttttttgcacatgttcttcattcctctctagtgcaatatgtacatagagcacttgcgggtgtaccttgatccctcagggaaaaatacatatttgtacagttttttggggtttttttgttttttggttttttttgttttgccttttgtttttggctaaggaatgtcgatcgaatcacttgttattgttgaggggcagccagataataatcctaaagccactgtttccaacattgattgtttaaatcatatgtccttccaatgctattattttaagataataataaaaagttattttctgacagttctttgtgctgactggtgaaaaacaagggtaaataagcaccttataattgacttactgtgaatgacaatccatcttggtatcaacgatagaagccctatcattttggagttggggttaagagtcagaaacaatgtgctcagggatctcctaaaactcttaaaacagggtggccagtactactgggacaaattgtgttttttattattaataataatgataataatactatccctccaaggcacaagtgaactatatagaactgcgtgtgtgtaaactctttactctcgtctcattttgttgagtttagaacttgatgtgctcgtcagtcttgtgtttcaaaacactgaataacttccaaagcaaagttatgccagtgtgttcaaaagataaattaataatgtaccagcaaagagcatcattcaaagtatagtccttgcatattccagttaccatttctctaataattaaaatattcatgataaatatatatatagcatcatatgttaaaaactatttcaaattctacatattaaggatgaaaattttaaaatccagtaataagaggagagacctgcctatcagtacagtgatataggtaaaagatgaaatatgtttttaaaataccagcaattaactattgttttcatgggttctcctctagaagcaaaccaaaaattccttcatggaaaacaattcttacttctacatgtgtagtttatatctgatgcattacaagagctaatgtttaaagacaaaacaaaacctgcctgtatgacagcagcaactcgagccaacatttagtgttacatgttatatttttgaaataccgttttgttatcatattccacatattactttccataaagtcagagaagttcaatgtaattgttggctctgattcttccaccttgggatacacattcacaagaagatttatatattttcttactatgatagaggaacataatctgggaaaacttcccatgtctgtaagatgaaaaggatacctttaccatgttgtttttgataataaagaatatggaaaatggtagaaatctctcctctctatgtgtatttgtatatgtgtgtatacacacacacgttgacatttttacataacatgtgattgccacttcttataaagttatgatatagaaccccatgaaaacaactttatattatagatcaaataatgtgcccagaaacgcaattgcaacagtaaatcttgatctattggtaagagtctatgatacaggtcttcattctatccctaaacataatgttagtaaagaggttccatcagattgtattatagagaccttcctattgctatttatttttaagagatgagaagactgactagcaatgtctccacagtgcaattggtttcacttctgggtctgtctgtctgtttgtgtaggtgagatcagtgttgtcaggctctcagaataatttttaaaagaatccagaagcctgacttcacaccaagtagccatcctagatgggcgggggggatctccatgttcaaccaaaccctcagaacttagagcaataaatacattcagtcatttatttataaatgaatgacagaatattcaatccaaatagaaacaaccttttgtcagtgatgcaacataacatggagtcttatattgagaaagtgaatatgaatattttaaatagatgcctaggaaatctgtgtttgctgtttacatttaatgtactttgccacattagcagtaccacacttcttttactttcatccttctaagaactaatgaaagatagcttgctattagctttgacatgttgcacatgccattatgttgttctctaagaacaactaaattctctccagtgttcatgtgtgattcctttttcatcattattactttaatgtggatgaatactatttctaggaacttgattatcactgaacagattgcatatgtaaatgcagataattcttgagcaatatagtgaaaatgatttcacaaaaaaaatccatatgtactgtatacatcttcctgaatccaaaattctcctgttatccacacagtttgaaatctcatattaaacagtggtaaatttttaaacattaggacattagctggctgcttctataaatgtacctgtattgtctgcctgctccttttgtggagatgtgtttttgtattggatgtttgggccaatgggaggcttcaagctacaacatattttcccactttaaataatatttaacatatgacaaaccccagacaaggcttttaatatgtataaagaactgcagtgttaggtggtttatttgcaaactgttttcagtgttgtccatttttatggcacctttaacaatattcttgtttccaaagtacaaaaaaaataggttaaataatctagccataactgaatgtcaagcaataaaacaaatgacttttgtgcatagacttaaaaaatacaaattttagacatctgcatgtaaatgcaatctcttgtttactgctttcttcaacttgagcaatcgattccttatttactattaacttaagaacttgtaacggcctgtaaacattttctctcttactcttctttcaaatttacctgtccctgcttttgagtcataatatttaatgttgttctgcacatctctatacagttaactttttggctttcattctgtatagataagaaaatgttatattataaacagcctactcagtgcaaatatttatctgtttatcaaatccacaatatgctgtataataccggttttactatataatctattttagacatagctgtttagaactagagtgtgctatttttgtgtttttctgatgtgtggtgctagacaagttacttttgtgaacaacaaaaattatcccttttattcctagacaataccacctttgggtcttgttaatttcactgagtataactatatatttgtatatatatacatatatatatatatctacctatgcccaactggcagctgtatcagagtgctggatttgggacatgcttttctctttaaatacataatatcattatataaattattctagagtgtatttaattaggataaaattacttccttagtatggatatttgacatctatagggtgaatttgtttataaatatggctatatggaaacttattagcatttactttatgtttgctacttggctttacagcatatctcctaagctgaaaaataatttgccaggccttcaagatcctaaagaaacttgtttaatggagtaatatacttttttttcttattaaggaattgtattactggcacctaacacagttgtattcttagctcctattatagataatgggcatttacataaaatatcctagatggcttgatggcagaataaacctttcccctcctacctgagtcatgagaaggatggagacgtcctctgccataacatgggccataaagcaaattcgacatgggatgttctgtttcagtatgacctcaaccagttccatgaactgagtgaaggaccttcattttcaaagttatttaataagtagcttaattaagcctttctacccattctcccaagatctactggcattattgaaaagcaaagtttatcaaatatctaactaaggatgtagttaaccttattaaatattgattagaattgttctgtaatattactgaatttgtaagatctttagcaaagatttttgagcaatttataaatgtagagcaaatgtttctgtttactgcactttttgtaactgaaggtgataaattctcaagccatgattattggcttccatgcactgcaatatttatccacaattctagacattttccatttttgtggaagagttgctgttaccttaattataaatgcaattgtgtggttaatgagagctaatgctagtagttaaccttttaaagtggattggctacagttgagggagaaatctcttttaatataaatcacatcattccttaactgcctctcttggaaagagattgaaaccttttttttaaagcacgatttagcatcctaagcttcctgagggtagagattgtatctttttgcgtctgcacaatggctagcacatgtcagcatttgacaattgttaaatgataacaagtgtgccccaattaaaacgtttttcctgggttgttttgttaaatttacaaagtaagccaagccttacggttaacattctcctctacaaccaagtattaaagccacatttaaaaagaccacatgaaatgctgattctaattgtgtgtaggtcttgaggattaagcacacaaatttcacaaacttctgtttgagtaaacaaactcagccttctgtaaatatacatgcaagtttggaaacagtaatactgtacctataaatatatgctgtctgttttgtgtacagtatgtaaaaactccttttctgccacactaaaaatgcaagccatttatgggaatcctaaaactagtattgaactaaaactttgctaatgatctttattagaggatcgtccaacttttcacttaccttgggttttcttttcaattcactcttacactagtctgcttatttccagctgtttattttattgagtcctgaatttaaaaaaaaaatattttgattcattttgtaaatacaagctgtacaaaaaagagagatttaatgttgtcttttaaatactccaattttcattctaatatgaatgttgttatattgtacttagaaactgtacctttaatattacattacctttattaaaagtgcattgaacacatcaattttagatgtgctttatgtactgttatcctataataaaacttcagcttctaatggaa

SEQ ID NO: 1493 - DNA, 3604 bp, Homo sapiens
tctctcccctctctttctctctcgctgctcccttcctccctgtaactgaacagtgaaaattcacattgtggatccgctaacaggcacagatgtcatgtgaaaacgcacatgctctgccatccacaccgcctttctttcttttctttctgtttccttttttcccccttgttccttctccctcttctttgtaactaacaaaaccaccaccaactcctcctcctgctgctgcccttcctcctcctcctcagtccaagtgatcacaaaagaaatcttctgagccggaggcggtggcattttttaaaaagcaagcacattggagagaaagaaaaagaaaaacaaaaccaaaacaaaacccaggcaccagacagccagaacatttttttttcacccttcctgaaaacaaacaaacaaacaaacaatcatcaaaacagtcaccaccaacatcaaaactgttaacatagcggcggcggcggcaaacgtcaccctgcagccacggcgtccgcctaaagggatggttttctcggcagagcagctcttcgccgaccaccttcttcactcgtgctgagcgggatttttgggctctccggggttcgggctgggagcagcttcatgactacgcggagcgggagagcggccacaccatgcgagcacaaattgaagtgataccatgcaaaatttgtggcgataagtcctctgggatccactacggagtcatcacatgtgaaggctgcaagggattctttaggaggagccagcagaacaatgcttcttattcctgcccaaggcagagaaactgtttaattgacagaacgaacagaaaccgttgccaacactgccgactgcagaagtgtcttgccctaggaatgtcaagagatgctgtgaagtttgggaggatgtccaagaagcaaagggacagcctgtatgctgaggtgcagaagcaccagcagcggctgcaggaacagcggcagcagcagagtggggaggcagaagcccttgccagggtgtacagcagcagcattagcaacggcctgagcaacctgaacaacgagaccagcggcacttatgccaacgggcacgtcattgacctgcccaagtctgagggttattacaacgtcgattccggtcagccgtcccctgatcagtcaggacttgacatgactggaatcaaacagataaagcaagaacctatctatgacctcacatccgtacccaacttgtttacctatagctctttcaacaatgggcagttagcaccagggataaccatgactgaaatcgaccgaattgcacagaacatcattaagtcccatttggagacatgtcaatacaccatggaagagctgcaccagctggcgtggcagacccacacctatgaagaaattaaagcatatcaaagcaagtccagggaagcactgtggcaacaatgtgccatccagatcactcacgccatccaatacgtggtggagtttgcaaagcggataacaggcttcatggagctctgtcaaaatgatcaaattctacttctgaagtcaggttgcttggaagtggttttagtgagaatgtgccgtgccttcaacccattaaacaacactgttctgtttgaaggaaaatatggaggaatgcaaatgttcaaagccttaggttctgatgacctagtgaatgaagcatttgactttgcaaagaatttgtgttccttgcagctgaccgaggaggagatcgctttgttctcatctgctgttctgatatctccagaccgagcctggcttatagaaccaaggaaagtccagaagcttcaggaaaaaatttattttgcacttcaacatgtgattcagaagaatcacctggatgatgagaccttggcaaagttaatagccaagataccaaccatcacggcagtttgcaacttgcacggggagaagctgcaggtatttaagcaatctcatccagagatagtgaatacactgtttcctccgttatacaaggagctctttaatcctgactgtgccaccggctgcaaatgaaggggacaagagaactgtctcatagtcatggaatgcatcaccattaagacaaaagcaatgtgttcatgaagacttaagaaaaatgtcactactgcaacattaggaatgtcctgcacttaatagaattatttttcaccgctacagtttgaagaatgtaaatatgcacctgagtggggctcttttatttgtttgtttgtttttgaaatgaccataaatatacaaatataggacactgggtgttatcctttttttaattttattcgggtatgttttgggagacaactgtttatagaattttattgtagatatatacaagaaaagagcggtactttacatgattacttttcctgttgattgttcaaatataatttaagaaaattccacttaataggcttacctatttctatgtttttaggtagttgatgcatgtgtaaatttgtagctgtcttggaaagtactgtgcatgtatgtaataagtatataatatgtgagaatattatatatgactattacttatacatgcacatgcactgtggcttaaataccatacctactagcaatggaggttcagtcaggctctcttctatgatttaccttctgtgttatatgttacctttatgttagacaatcaggattttgttttcccagccagagttttcatctatagtcaatggcaggacggtaccaactcagagttaagtctacaaaggaataaacataatgtgtggcctctatatacaaactctatttctgtcaatgacatcaaagccttgtcaagatggttcatattgggaaggagacagtattttaagccattttcctgtttcaagaattaggccacagataacattgcaaggtccaagacttttttgaccaaacagtagatattttctatttttcaccagaacacataaaaacactttttttcttttggatttctggttgtgaaacaagcttgatttcagtgcttattgtgtcttcaactgaaaaatacaatctgtggattatgactaccagcaatttttttctaggaaagttaaaagaataaatcagaacccagggcaacaatgccatttcatgtaaacattttctctctcaccatgttttggcaagaaaaggtagaaagagaagacccagagtgaagaagtaattctttatattcctttctttaatgtatttgttaggaaaagtggcaataaagggggaggcatattataaaatgctataatataaaaatgtagcaaaaacttgacagactagaaaaaaaaagatctgtgttattctagggaactaatgtaccccaaagccaaaactaattcctgtgaagtttacagttacatcatccatttaccctagaattatttttttagcaacttttagaaataaagaatacaactgtgacattaggatcagagattttagacttccttgtacaaattctcacttctccacctgctcaccaatgaaattaatcataagaaaagcatatattccaagaaatttgttctgcctgtgtcctggaggcctatacctctgttattttctgatacaaaataaaacttaaaaaaaagaaaacaagctaa

SEQ ID NO: 1494 - DNA, 3084 bp, Homo sapiens
gccaggtgctcccgccttccaccctccgccctcctccctcccctgggccctgctccctgccctcctgggcagccagggcagccaggacggcaccaagggagctgccccatggacagggccccacagagacagcaccgagcctcacgggagctgctggctgcaaagaagacccacacctcacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttacattttctgcctctgccttcctcccagctcagcaaggaagtatttgggcaccctaccctttacctggggtctaaccaaaaatggatgggatgaggatgagaggctggagataattgttttatgggatttgggtgtgggactagggtacaatgaaggccaagagcatctcagacatagagttaaaactcaaacctcttatgtgcactttaaagatagactttaggggctggcacaaatctgatcagagacacatatccatacacaggtgaaacacatacagactcaacagcaatcatgcagttccagagacacatgaacctgacacaatctctcttatccttgaggccacagcttggaggagcctagaggcctcaggggaaagtcccaatcctgagggaccctcccaaacatttccatggtgctccagtccactgatcttgggtctggggtgatccaaataccaccccagctccagctgtcttctaccactagaagacccaagagaagcagaagtcgctcgcactggtcagtcggaaggcaagatcagatcctggaggactttcctggcctgcccgccagccctgctcttgttgtggagaaggaagcagatgtgatcacatcaccccgtcattgggcaccgctgactccagcatggaggacaccagggagcagggcctgggcctgtttccccagctgtgatcttgcccagaacctctcttggcttcataaacagctgtgaaccctcccctgagggattaacagcaatgatgggcagtcgtggagttgggggggttgggggtgggattgtgtcctctaaggggacgggttcatctgagtaaacataaaccccaacttgtgccattctttataaaatgattttaaaggcaaaaaaaaaaaaaaaaaaaa

SEQ ID NO: 1495 - DNA, 3054 bp, Homo sapiens
agagagctaggtgcagagcttcaggctgaggcgctgctgagagggcctcgccccgcctctgccgccagctgcaccccactcctggaccaccccctgctgagaaggacagggagccaaggccggcagagccaaggctcagtcatgagaacacaaattgaagtgatcccttgcaaaatctgtggggacaagtcgtctgggatccactacggggttatcacctgtgaggggtgcaagggcttcttccgccggagccagcgctgtaacgcggcctactcctgcacccgtcagcagaactgccccatcgaccgcaccagccgaaaccgatgccagcactgccgcctgcagaaatgcctggcgctgggcatgtcccgagatgctgtcaagttcggccgcatgtccaagaagcagagggacagcctgcatgcagaagtgcagaaacagctgcagcagcggcaacagcagcaacaggaaccagtggtcaagacccctccagcaggggcccaaggagcagataccctcacctacaccttggggctcccagacgggcagctgcccctgggctcctcgcctgacctgcctgaggcttctgcctgtccccctggcctcctgaaagcctcaggctctgggccctcatattccaacaacttggccaaggcagggctcaatggggcctcatgccaccttgaatacagccctgagcggggcaaggctgagggcagagagagcttctatagcacaggcagccagctgacccctgaccgatgtggacttcgttttgaggaacacaggcatcctgggcttggggaactgggacagggcccagacagctacggcagccccagtttccgcagcacaccggaggcaccctatgcctccctgacagagatagagcacctggtgcagagcgtctgcaagtcctacagggagacatgccagctgcggctggaggacctgctgcggcagcgctccaacatcttctcccgggaggaagtgactggctaccagaggaagtccatgtgggagatgtgggaacggtgtgcccaccacctcaccgaggccattcagtacgtggtggagttcgccaagaggctctcaggctttatggagctctgccagaatgaccagattgtgcttctcaaagcaggagcaatggaagtggtgctggttaggatgtgccgggcctacaatgctgacaaccgcacggtcttttttgaaggcaaatacggtggcatggagctgttccgagccttgggctgcagcgagctcatcagctccatctttgacttctcccactccctaagtgccttgcacttttccgaggatgagattgccctctacacagcccttgttctcatcaatgcccatcggccagggctccaagagaaaaggaaagtagaacagctgcagtacaatctggagctggcctttcatcatcatctctgcaagactcatcgccaaagcatcctggcaaagctgccacccaaggggaagcttcggagcctgtgtagccagcatgtggaaaggctgcagatcttccagcacctccaccccatcgtggtccaagccgctttccctccactctacaaggagctcttcagcactgaaaccgagtcacctgtggggctgtccaagtgacctggaagagggactccttgcctctccctatggcctgctggcccacctccctggaccccgttccaccctcacccttttcctttcccatgaaccctggagggtggtccccaccagctctttggaagtgagcagatgctgcggctggctttctgtcagcaggccggcctggcagtgggacaatcgccagagggtggggctggcagaacaccatctccagcctcagctttgacctgtctcatttcccatattccttcacacccagcttctggaaggcatggggtggctgggatttaaggacttctgggggaccaagacatcctcaagaaaacaggggcatccagggctccctggatgaatagaatgcaattcattcagaagctcagaagctaagaataagcctttgaaatacctcattgcatttccctttgggcttcggcttggggagatggatcaagctcagagactggcagtgagagcccagaaggacctgtataaaatgaatctggagctttacattttctgcctctgccttcctcccagctcagcaaggaagtatttgggcaccctaccctttacctggggtctaaccaaaaatggatgggatgaggatgagaggctggagataattgttttatgggatttgggtgtgggactagggtacaatgaaggccaagagcatctcagacatagagttaaaactcaaacctcttatgtgcactttaaagatagactttaggggctggcacaaatctgatcagagacacatatccatacacaggtgaaacacatacagactcaacagcaatcatgcagttccagagacacatgaacctgacacaatctctcttatccttgaggccacagcttggaggagcctagaggcctcaggggaaagtcccaatcctgagggaccctcccaaacatttccatggtgctccagtccactgatcttgggtctggggtgatccaaataccaccccagctccagctgtcttctaccactagaagacccaagagaagcagaagtcgctcgcactggtcagtcggaaggcaagatcagatcctggaggactttcctggcctgcccgccagccctgctcttgttgtggagaaggaagcagatgtgatcacatcaccccgtcattgggcaccgctgactccagcatggaggacaccagggagcagggcctgggcctgtttccccagctgtgatcttgcccagaacctctcttggcttcataaacagctgtgaaccctcccctgagggattaacagcaatgatgggcagtcgtggagttgggggggttgggggtgggattgtgtcctctaaggggacgggttcatctgagtaaacataaaccccaacttgtgccattctttataaaatgattttaaaggcaaaaaaaaaaaaaaaaaaaa

SEQ ID NO: 1496 - DNA, 1951 bp, Homo sapiens
cgcctgcttttgcccgggtcctgagaacaggggctccccacactttttttttttttggttttgttttatttcgtttccgcgcgtctctttctactgcaaacagaaatgggagggtggacaggcgggtaggagcggatcagacgcccaggacgcagcagcccgagtccgcacagggtttgcgggaggtggtgaccgcgctggggacgccaggacgcgaatgaacctccggggcgcgctcggggcctgcgctcagagcttggaaaactggagtttgcttttcctccggccacggagagaacgcgggtaacctgtgtggggggctcgggcgcctgcgcccccctcctgcgcgcgcgctctcccttccaaaaatgggatctttcccccttcgcaccaaggtgtacggacgccaaacagtgatgaaatgagaagaaagccaattgccggcctggggggtgggggagacacagcgtctctgcgtgcgtccgccgcggagcccggagaccagtaattgcaccagacaggcagcgcatggggggctgggcgaggtcgccgcgtataaatagtgagatttccaatggaaaggcgtaaataacagcgctggtgatccacccgcgcgcacgggccgtcctctccgcgcggggagacgcgcgcatccaccagccccggctgctcgccagccccggccccagccatggaagagctcacggcttttgtatccaagtcttttgaccagaaaagcaaggacggtaacggcggaggcggaggcggcggaggtaagaaggattccattacgtaccgggaagttttggagagcggactggcgcgctcccgggagctggggacgtcggattccagcctccaggacatcacggagggcggcggccactgcccggtgcatttgttcaaggaccacgtagacaatgacaaggagaaactgaaagaattcggcaccgcgagagtggcagaagggatttatgaatgcaaagagaagcgcgaggacgtgaagtcggaggacgaggacgggcagaccaagctgaaacagaggcgcagccgcaccaacttcacgctggagcagctgaacgagctcgagcgactcttcgacgagacccattaccccgacgccttcatgcgcgaggagctcagccagcgcctggggctctccgaggcgcgcgtgcaggtttggttccagaaccggagagccaagtgccgcaaacaagagaatcagatgcataaaggcgtcatcttgggcacagccaaccacctagacgcctgccgagtggcaccctacgtcaacatgggagccttacggatgcctttccaacagatggagttttgctcttgtcgcccgggctggagtataatggcatgatctcgactcactgcaacctccgcctcccgagttcaagcgattctcctgcctcagcctcccgagtagctgggattacaggtgcccaccaccatgtcaagataatgtttgtattttcagtagagatggggtttgaccatgttggccaggctggtctcgaactcctgacctcaggtgatccacccgccttagcctcccaaagtgctgggatgacaggcgtgagcccctgcgcccggcctttgtaactttatttttaattttttttttttttttaagaaagacagagtcttgctctgtcacccaggctggagcacactggtgcgatcatagctcactgcagcctcaaactcctgggctcaagcaatcctcccacctcagcctcctgagtagctgggactacaggcacccaccaccacacccagctaatttttttgatttttactagagacgggatcttgctttgctgctgaggctggtcttgagctcctgagctccaaagatcctctcacctccacctcccaaagtgttagaattacaagcatgaaccactgcccgtggtctccaaaaaaaggactgttacgtgga

SEQ ID NO: 1497 - DNA, 1842 bp, Homo sapiens
gctatcgatcaagggtaaaattccattctgatatcaaaatgcagtattcgcaccactgtgagcaccttttagagagactgaacaaacagcgggaagcaggttttctctgtgactgtaccatagtgattggggaattccagtttaaagctcataggaatgtgctggcctcctttagtgagtattttggtgcgatctacagaagcacttctgagaacaatgtctttcttgatcagagtcaggtgaaggctgatggatttcagaaactgttggagtttatatacacaggaactttaaatcttgacagttggaatgttaaagaaattcatcaggctgctgactatctcaaagtggaagaggtggtcactaaatgcaaaataaagatggaagattttgcttttattgctaatccttcttctacagagatatctagtattactggaaacattgaattgaatcaacagacttgtcttcttactctgcgagattataataatcgagagaaatcagaagtatctacagatttgattcaggcaaatcctaaacaaggcgcgttagcgaaaaagtcatctcaaacgaaaaagaagaagaaggctttcaactccccgaaaacagggcagaataaaacagtgcgatatcccagtgacatcttagagaatgcatctgttgaattattcctagatgcaaataaactgcccacaccagtagtagaacaagttgcacaaataaatgataattcagaactcgagttgacatcagttgtggaaaatacttttccagcacaagatattgtgcacactgttacagtgaaacggaaacgtggaaaatcacagccaaactgtgctctgaaagaacactctatgtctaatatagccagcgtcaagagtccttatgaggcggagaactccggggaagagctggatcagaggtattccaaggccaagccaatgtgtaacacatgtgggaaagtgttttcagaagccagcagtttgagaaggcacatgagaatacataaaggagtcaaaccttacgtctgccacttatgtggaaaggcatttacccaatgtaaccagctgaaaacgcatgtaagaactcatacaggtgagaagccatacaaatgtgaattgtgtgataaaggatttgctcagaaatgtcagctagtcttccatagtcgcatgcatcatggtgaagaaaaaccctataaatgtgatgtatgcaacttacagtttgcaacttctagcaatctcaagattcatgcaaggaagcatagtggagagaagccatatgtctgtgataggtgtggacagagatttgctcaagccagcacactgacctatcatgtccgtaggcatactggagaaaagccttatgtatgtgatacctgtgggaaggcatttgctgtctctagttctcttatcactcattctcgaaaacatacaggtgaaaaaccatacatatgtggtatttgtgggaaaagttttatttcctcaggagagctcaacaaacactttcggtcccatacaggtgcagataaaactctagactccagtgcagaggatcatactttgagtgaacaggattccatacaaaaaagtcctttatcagaaactatggatgtgaagccttctgatatgactttaccattagctcttccacttgggactgaggaccatcacatgcttctgcctgtcacggatactcagtctcctacatcagatacattgttgaggtcaactgtgaatgggtattcagaaccacagttgatttttttacaacaattatactgactttgtaaggaatatggaattgctaagatatcattggtagcaaacatctctggtaagg

SEQ ID NO: 1498 - DNA, 3576 bp, Homo sapiens
  modified_base (1261)..(1261): a, c, t, g, unknown or other
  modified_base (1307)..(1307): a, c, t, g, unknown or other
  modified_base (2728)..(2728): a, c, t, g, unknown or other
  modified_base (3454)..(3454): a, c, t, g, unknown or other
  modified_base (3569)..(3569): a, c, t, g, unknown or other
gaattccgggtggctgcgctgcccttggtgactgcaagcccctcactgccttcctggaacccaagaacrrctttcttcacaggggccccacccagcctccacctccccatgtctcgatcaagttggagcccgccagtagctttgcggtggacttcaatgagcccctggacttctcgcagaagggcctggcctggtccaagtgaagcaggaaaacatctcctttctgagcccttcttccctggtcccctatgactgctccatggagcccatcgacctgtccatccccaagaacttcaggaaaggggacaaggatttggccactcccagcgaasscaagaagcctgaggaggaggcggggagcagcgagcagccctctccctgcccagcacccggcccttctcttcctgtaactttggggcccagcggaatcctggaaagccccatggcccctgctccggcggccaccccggaacccccagcacagcccctgcagggccctgttcagctggcggtcccaatctactcctcagccctggtcagcagccctccactcgtgggcagctcagccctcctgagtggcacagccttgctgcgtccactgcggcccaagcccccgctgcttttgccaaagccccccgtgacagaagagctgcccccgctggcctccattgcccagatcatctcatctgtatcctcggcccccaccctgctgaaaaccaaggtggcggacccagggcccgcaagcactggcagtaacaccacggcttcagacagcttaggaggttctgtccccaaagccgccaccaccgccacccccgctgccaccaccagcccaaaagagtctagtgagcctcccgctccagccagcagcccagaggctgcctctcccaccgagcagggcccagcgcggacgtcgaagaagaggggccggaaaagggggatgaggagccgaccccgcgccaacagcggcggggtggacctggactccagcggggagtttgccagcatcgagaagatgctggccaccacagacaccaacaagttcagtccgtttctgcagacagcggaggacaacactcaggatgaggtggccggagcccctgccgaccaccatgggcccagtgatgaagagcagggcagtcccccagaagacaagctgctgagggccaagcggaactcgtacaccaactgcctgcagaagatcacctgtccccactgtccccgggttttcccttgggccagctccctacagaggcacatnctcacacacactgacagtcagtcggatgcggagactgcagccgccncgggcgaagtgctagacctcacctcacgggacagagagcagccgtcggagggcgccactgagctccgccaggtcgcaggggatgcgcctgtggagcaggccacggcggaaacggcctcgccggtgcaccgggaagagcacgggcgtggggagagccatgagccggaggaggagcatggcactgaggagagcactggggacgccgacggcggaagaggacgcgtcgagcaaccagagcctggacctggacttcgccaccaagctcatggacttcaagctggcggagggcgacggcgaggcaggcccgggggcgcggcctcgcaggagcagaagctcgcctgcgacacctgtgggaagagcttcaagttcctgggcaccctgagccgccaccggaaggcgcacggccgccaggagcccaaggacgagaagggagatggcgccacgactgcagaggagggscccagccctgcccctgaacaggaggagaagccscccgagaccccggcagaggtggtggagtcggccccgggtgccggggaggccccggcggaaaagctcgcggaggagacggagggcccctccgacggggagagcgcggccgagaaaaggtcctcagagaagagcgacgatgacaagaaaccaaagacagactcccccaaaagcgtggccagcaaggcagacaagaggaagaaggtctgcagcgtgtgcaacaagcggttctggtcgctgcaggacctgacccggcacatgcgctcccacacaggggaaaggccatacaaatgtcagacctgcgagcgaaccttcaccttgaagcacagcctggttcgccaccagcggatccaccagaaagccaggcatgccaaacaccacgggaaggacagcgacaaggaagagcggggtgaggaggacagcgagaatgagtccacccacagcggcaacaacgccgtctcagagaacgaggctgagctggctcccaatgccagcaaccacatggctgtcacccggagccggaaggagggcttggccagtgccaccaaggactgcagccacagggaggagaaggtcacggcagggtggccgtctgagcctggccagggtgaccttaacccagagagcccggcggccctggggcaggacctgctggagccgcgcagcaagaggcctgcccacccaatcctggccacagctgatggcgcctcccagcacgtggggatggagtgacagcctcagtccccctcagcacagacaaaagccagcagagcaaagcgtctatacttcatggggtttcctcagtgccctttggctgttgaggagtgagagagagagagagagagagagagagagagagagagagacaagcaggagcgtggctgctcgctcagtgccatagccttaccgcagcctgcgcgggaggcccacagnccgtgccgattccagtgccttaactacttaccggatccctccatattatcatgggtgttgtatttttccaaaatgacttcttaaacaaaacaaatattataatgaattgtctggagaggacctcttcatttgagcattagcgttattttgtattggtgtgtgtgagcttgttcttgtgaatctgtgatagcaccgtttgttctgtgagctggaaacagaaggaaaaaacatacccttgggtacccatagccaataactggaagaaaatgatgtgaatttcatgtaaatgaccagaggaaagatggataagatgataatttcttaaatagacattttccttttttctttgtgcttcatggtggagctgtcatctggtccttggtattacaggatgtggttgatgaaggtttccaatatggtttcaggccaaaaccagggaagattctagcttcagcctcatgtcattccagtctgtcagcattagacatggtcactgttcaagtttcaagacatccattcttaactatagagaagagttactcccctggcgtcttaacctatggaaaacatgcacggataggatatatttgattgcctcctcttccctttcagtatatgtattattaatattattattattattattattattagttcatcagtttgctgttctctgcagtgagcagaatcaaatgggcaatatttgtcctgggagacctgtgccgnacccaggtccccgtgttaacgtgtgcctgcggttgtggttggcaccctcgggtggtagctcttctactgtaatgagacaagcctttcttctgtcactgcagaatttagaaggggnggaattc

SEQ ID NO: 1499 - DNA, 6861 bp, Homo sapiens
gggagagggaagggggcggagctagccggagccgcgagtccattttggggctgtgcttggcgcgtaccgtgcggtccctgtagttggaggacgggcggtcgcgcggcctttcccactagccggaggtcggagataagtacccgccgcccggctcctctcgggaaagcggggtggtcctcgaaccttcagcgagggtggggagttgcccagtagcctctagttcgttagtcaaaacgtgaaaaaaaagacctgctttgccctgggaaatagtaaccctgccaaatacatcagcttgtaggagacagaggatgtgatggagctgcttgaagaagatctcacatgccctatttgttgtagtctgtttgatgatccacgggttttgccttgctcccacaacttctgcaaaaaatgcttagaaggtatcttagaagggagtgtgcggaattccttgtggagaccagctccattcaagtgtcctacatgccgtaaggaaacttcagctactggaattaatagcctgcaggttaattactccctgaagggtattgtggaaaagtataacaagatcaagatctctcccaaaatgccagtatgcaaaggacacttggggcagcctctcaacattttctgcctgactgatatgcagctgatttgtgggatctgtgctactcgtggggagcacaccaaacatgtcttctgttctattgaagatgcctatgctcaggaaagggatgcctttgagtccctcttccagagctttgagacctggcgtcggggagatgctctttctcgcttggataccttggaaactagtaagaggaaatccctacagttactgactaaagattcagataaagtgaaggaattttttgagaagttacaacacacactggatcaaaagaagaatgaaattctgtctgactttgagaccatgaaacttgctgttatgcaagcatatgacccagagatcaacaaactcaacaccatcttgcaggagcaacggatggcctttaacattgctgaggctttcaaagatgtgtcagaacccattgtatttctgcaacagatgcaggagtttagagagaaaatcaaagtaatcaaggaaactcctttacctccctctaatttgcctgcaagccctttaatgaagaactttgataccagtcagtgggaagacataaaactagtcgatgtggataaactttctttgcctcaagacactggcacattcattagcaagattccctggagcttttataagttatttttgctaatccttctgcttggccttgtcattgtctttggtcctaccatgttcctagaatggtcattatttgatgacctggcaacttggaaaggctgtctttcaaacttcagttcctatctgactaaaacagccgatttcatagaacaatcagttttttactgggaacaggtgacagatgggtttttcattttcaatgaaagattcaagaattttactttggtggtactgaacaatgtggcagaatttgtgtgcaaatataaactattataaaatctgtttcaagtatgcagttttcttttgttagaaattgttagagaatagagagtggtaattcagatttggtcaacgattctagtcacatattttcctccaaaagtattccttccaaaaataatctatacatgttcaaattaggtagcataaagataaaagtgaaatttagtagtataggcctgaacctttttttgtttaaaagagtgcttttgaaataagcatccaccccaaatgttggttgtatttatgctgtgataaaaataggtgagagatcatatgatctaatattgtattgatggaagtataggtagtatagtagtgattgttcttcaagcatgcagtaaagatcacttttttttttttttttttttttgagatggagtcttgctctgtcgcccaggctggagtgcagtgatgcaatcttggctcactgcagcctctacctcccaggttcaagtgattatcctgccttagcctcctgagtagctgggattacaggcgcgtgccaccacgcccagctaattttttgtatttttagttgagacagggtttcactgtcccttaagaccatcctgttagccaagatggtcttgatctcctgacctcgtgatccgcctgcctcggcctcccaaagtgctgggattacaggtgtgagccaccgtgcccagccaaagactgctcttaaagcacctttttgacagtgaacatggtctaaaaaagggaagatattgtagaagatttcacacacacacgcgtgtgtgggagacaactaaaggtattgaaggtactaattaattagatttccaaaattttctacagagagttaattatcaccaaaatgtgaatggtacatacaaaacctggcattttcttgtgataagtttacatttttaggagagtggagctttcaatctgcccttttctcctttgtttttgtagttttcaccaaagatgatcaactagaaatgttaagtggctatgcaagcaaaagcatagataggttaaaaaaaaggatcagctggctgggcagggtggctcatgtctataatctcagcattctaggacagtgatgtgggaggattatttgaggctaggagttccagttcgaaaccagcttcgtaaacatagcaagacccagtctctaccaaaaaaaaaaaaaaaaaaaaaaaaaaaaaaaatatatatatatatatacacacacacacacacatatgtacacatacatatatatacatatatatgtatatatagaacacatggcaagagcaggaaatgggaagactaccttttttctggcagctatgtgttgttttgttcgaaagatggcaagtgtacaaccaaaccaatccacttgcttacagaaagaatgtttagtgtagttaagactaatttgacaacagataaaacagtctgtcagctattacaaagtaatcagctgaacactaatgctgttctgtctgctcacaagagataaagataccctctcatggaataaacaccttgcttagaattcatataacaaagaagtaaccttataactgctctctagtctgccttatttgtgtcatagagtaagatattccttgaaagcccattaagtggaatagactttctgaaaataagagttctttacctcagtcctcctctaatttggttgagaggaggtaatgaaaatggggacaggataaaaggtggcaactaaatttaaagcacagaagaaatgatttccttctagctatgagaatagtcaaattgagcttgccaggctgtctcattcctaacatgtaattcatgatttagccactaaatttctaaggagatcataagaaattaagaaaaacgtttaagtctagcctctgcgtggtagacaggtatggggagggagaatgcttttcccctcccagtaataaaaaaaaaaaaaaaaaaaatatatatatatatatatatatatatatatatatatatatatatatatatatatatagttttactaggttttcatggataagtttttaaatgtaagacaggaaagggatctatttgatgtctatcttcagatatattggcagttttccttaagctatttagttcctcatctgttgctttttcattttgtatactgcaagttcccaggcaactcgaatttgcaaacacagccatggatacactatttaccttacagtagtttcctgggaatctaagtctggtttttgttattcttccctcccctccactgcataatcatgtataactagcaacatttatggttataggttgatttcctaagtgtggctgatggtagcctctagtttgaagtgagggaagaatgagtagtcaggaactggtcactttgaatgtgggagggaagatattcacgacaaggttttctacgataaagcagtttcctgcttctcgtttggcacgcatgttagatggcagagaccaagaattcaagatggttggtggccagatttttgtagacagagatggtgatttgtttagtttcatcttagattttttgagaactcaccagcttttattacccactgaattttcagactatcttaggcttcagagagaggctcttttctatgaacttcgttctctagttgatctcttaaacccatacctgctacagccaagacctgctcttgtggaggtacatttcctaagccggaacactcaagcttttttcagggtgtttggctcttgcagcaaaacaattgagatgctaacagggaggattacagtgtttacagaacaaccttcagcgccgacctggaatggtaactttttccctcctcagatgaccttacttccactgcctccacaaagaccttcttaccatgacctggttttccagtgtggttctgacagcactactgataaccaaactggagtcaggtattttgtactttgcagtatttctcttgtataccagtttgtgatgttttctctaaaaacttgaagttcctcaggcctgtaacttctggaaaagatgattattcaaaataatgttttggggtaaccagtggagttgggtagaatgaccaaataattattttccaaactgggatactttttagagtgaaaggggctattattaggtgggacaaaaggaataaatgaagactgcccagaaaaaactgagactatggacattcaaatcatgggagaaaataattttgtagattatgttccattgctaatgaatttgacttagaaaagaattgccttatttttaagagattgtttcagtggttcacataaaggctcgctcactggtttctcttgagttccttacacactatataagttgttctttcagttttatgattcaactactgtttttccttcagctgactttatttttaaacacccttaaagacagatatatctcatggcaaatttggtatcctgttacagccttggctcttaaacaactcaaaatattgggataggctgtcagtatgttaaggatagttgctcctgagtcaattcttcacttactccctctgttgttcttggctggatcctaacgctgatttccactctgctgtcacaaacatttttccccccgtaaaatgtcttaatgctgtcctaccattattttaccaactgtgaaagctggctttaatttttaggaggaaaagaaaagcctgcatgtgttctttattggtatcatttaaaatatacttttttttttttttttggtaaaggtaggcgtattttaagatattttcttaacttgagcagtagccaacaggaaggataccagtgtctctctctcttagcgacacactccttggtcttgcttaccaactggaggacactaggtagaataaccgagtatgacaattcttaattgtttacattttataacttcctgtccttcaaaagagtttgaaatgtcattttgggaaaagagagccagtcaagctagtaggctgattgtgaagaaaatctaataccttatctttatctcaaacctctgtacaactttattttcattgatgggatactttaacaaaaatgaaattttttttggtttttaaaatatgagtgattatgacctctttggggatcatgcttcaaaaagtcagaaacctagagacaaaactgtcattgatttttaagaagaaacacactaggtcaaaagaagatgtcctggaaatatgaagtactctttaaaaaccatgcatttggagaaagtaattgtttccttgaaaaacatgattaaaaactaaaactgggatgttcctgtgtgtacacagtgccaaatggttttccctttttatgttgtgttttagaaacagcacgaaagttttttccattttaaagtgagaaaacattatatttagacttccataattccaaaatcagaagctatttttaaaattagcattttcttgcatcaccaaatggtattcaattgtttgaagctcaaaatttttaccattccataaatgtttgtgaatttttagacagtgccaatttaaaagtagagatagccaatctgaatacggtgaaattatggggatctctggtgattgggatgaaaactctggccttaaaaggtccacttttagtatataattgcctaattagcaatcatttttattttttgctcactccctggtctgaatctatctgtctattcagatattttttggtaggtttggaaaatggagaagtgagcctaattggtgcctaattgtctggtgtatcattcactttattcagtttgttctatcaatatgatttacccctcaaggttaacctagcaggttgctcagttattatctctcaaggtcacagtactagaaatacttggcttgcatctttcagatgccattcatgttatcaagctcaaattatagttggtcacaggattctaaagtctttatttgacttctcctttttgaactggctcaaatggaaaagtgtagttgcttttaaatgttaaaaataagtttaaactttatatttcccattggtttcccctattttgtcctttctttgtgtgcttgaaatattttatttttcagtttgtcctcatagggaatcaagtattttagctaggtgatgtcttgcaagtacgttccactttgttacaatctactatctgtatatactatttgtatcttaattcttttatgagatgttctgtaacatttttctcactttgacaaatgtttttagactgtacagtcaagatctggcgcttgggggtaagtggaatgatttgctaatattgagaatctgttgtatcaaacataataaactttttttgagatgtgaaaaaaaaaaaaaaaaaaaaa
